United States Patent 11,410,750 (METHYLATION MARKERS AND TARGETED METHYLATION PROBE PANEL) - sequence listing, part 2

SEQ ID NO: 13485 - DNA, 355 bp, Homo sapiens
  chr19:51198793-51199148
  hyper
cctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggc

SEQ ID NO: 13486 - DNA, 206 bp, Homo sapiens; identical to SEQ ID NO: 4677
  chr19:51227602-51227808
  hyper

SEQ ID NO: 13487 - DNA, 21 bp, Homo sapiens
  chr19:51228248-51228269
  hyper
gcctccttctctacccggccc

SEQ ID NO: 13488 - DNA, 271 bp, Homo sapiens; identical to SEQ ID NO: 4679
  chr19:51228368-51228639
  hyper

SEQ ID NO: 13489 - DNA, 91 bp, Homo sapiens; identical to SEQ ID NO: 4680
  chr19:51228702-51228793
  hyper

SEQ ID NO: 13490 - DNA, 49 bp, Homo sapiens
  chr19:51412508-51412557
  hyper
tctggaaacagtgtgcggctgacagcacccactgcggatgcaccaggac

SEQ ID NO: 13491 - DNA, 44 bp, Homo sapiens
  chr19:51520138-51520182
  hyper
ctcaaggagaatcagcgggagaggagtgacgggcccagaaatgc

SEQ ID NO: 13492 - DNA, 114 bp, Homo sapiens; identical to SEQ ID NO: 1394
  chr19:51830889-51831003
  hyper

SEQ ID NO: 13493 - DNA, 270 bp, Homo sapiens; identical to SEQ ID NO: 1395
  chr19:51831120-51831390
  hyper

SEQ ID NO: 13494 - DNA, 30 bp, Homo sapiens
  chr19:52074302-52074332
  hyper
gccctttgacgatggcggcctccaatatca

SEQ ID NO: 13495 - DNA, 89 bp, Homo sapiens
  chr19:52207371-52207460
  hyper
cgggacgttctcctgcgtgatcaagcaagaccagcgccccctggcccggctctacttctttcttaacggtggggcggggcgcggccgcg

SEQ ID NO: 13496 - DNA, 105 bp, Homo sapiens
  chr19:52222448-52222553
  hyper
ctctactcacctgcacgtagtccaccgaatctccgagcgccttgaaggctgtgtacatgacctcgcgcttgccgccccagcgctgcgccacgcacacgcacctgc

SEQ ID NO: 13497 - DNA, 179 bp, Homo sapiens
  chr19:52531480-52531659
  hyper
agaactcgactcacccgagcccgaacctctccagacaccactggcagcgacaaaacgccgcatccacgtccgaaaacgcttcctattcagacgcgctcctgcgcggactccgggaagctgagcggtaaagaccgtgaagcgaggcgaggaccacggagcctgcccgggatcgcgagttc

SEQ ID NO: 13498 - DNA, 67 bp, Homo sapiens
  chr19:52839463-52839530
  hyper
ccgctctctatgctgcgcgcgcgcagttttttgcagacccggaagcggatcgcgtgggtagaaggtc

SEQ ID NO: 13499 - DNA, 30 bp, Homo sapiens
  chr19:52839996-52840026
  hyper
ttttcctccttgatccgggccttcctactc

SEQ ID NO: 13500 - DNA, 25 bp, Homo sapiens
  chr19:52872905-52872930
  hyper
cctcagcatccgggtagctaggacc

SEQ ID NO: 13501 - DNA, 70 bp, Homo sapiens
  chr19:52873135-52873205
  hyper
acccgggcctggcctcgcctcgcctctcagctgcgcgcgcagtttcctggagacccggaagcagattacg

SEQ ID NO: 13502 - DNA, 34 bp, Homo sapiens
  chr19:52900940-52900974
  hyper
aaccctgaaaacaagcgcagccagtcaagcgaac

SEQ ID NO: 13503 - DNA, 27 bp, Homo sapiens
  chr19:52900975-52901002
  hyper
gaagcgcaggcccggcccaggctttgt

SEQ ID NO: 13504 - DNA, 252 bp, Homo sapiens
  chr19:52956606-52956858
  hyper
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgcagtttcctgaagacccggaagccgatcgcgtggggagccggtcttggagcagc

SEQ ID NO: 13505 - DNA, 333 bp, Homo sapiens; identical to SEQ ID NO: 4683
  chr19:53073440-53073773
  hyper

SEQ ID NO: 13506 - DNA, 46 bp, Homo sapiens; identical to SEQ ID NO: 4684
  chr19:53073819-53073865
  hyper

SEQ ID NO: 13507 - DNA, 172 bp, Homo sapiens; identical to SEQ ID NO: 4685
  chr19:53073866-53074038
  hyper

SEQ ID NO: 13508 - DNA, 201 bp, Homo sapiens
  chr19:53141418-53141619
  hyper
tatccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtg

SEQ ID NO: 13509 - DNA, 59 bp, Homo sapiens
  chr19:53193364-53193423
  hyper
ggcgggaatccacttcgcgggtgaggacgttaaaaagcgcggggcgggaggagtctgaa

SEQ ID NO: 13510 - DNA, 82 bp, Homo sapiens
  chr19:53194281-53194363
  hyper
taggagcaggaagatcgctgagccctggggtccaggccagcctgggcgacaaagtaacaccccctcccgcaaggccaccttc

SEQ ID NO: 13511 - DNA, 264 bp, Homo sapiens
  chr19:53400445-53400709
  hyper
gagggaggtggggagcgacggagccttcggacaggggtggcgtctgcaggatcttaggaccaggcagaggacgcggcctcccgggaaccggggttgaggcgcggcgctcctgaagccgccgagagcgacggtgggaggcgcctagggctggaatccagctcgcgggtgaggacttgaaacagcgcgaggcgggaggacaggtcaggaagggttttgagaaggaaaattccgcgataggaggtgtctgcacgaccccactgcaga

SEQ ID NO: 13512 - DNA, 20 bp, Homo sapiens
  chr19:53497275-53497295
  hyper
ggatgcgggatggagtgctc

SEQ ID NO: 13513 - DNA, 30 bp, Homo sapiens
  chr19:53561529-53561559
  hyper
ggactggtctcagagcgagttttacccaca

SEQ ID NO: 13514 - DNA, 103 bp, Homo sapiens
  chr19:53635501-53635604
  hyper
cacacattcacaggacggtttggggtaagacgcctgcatcctggaggagcgcattttccacggggtggaggagggcaggcaagaacatcgggtgtcacaggac

SEQ ID NO: 13515 - DNA, 54 bp, Homo sapiens
  chr19:53635906-53635960
  hyper
gaagaagcaaaaggccggggacggggagcagcctcaaagcgacttcaacccaaa

SEQ ID NO: 13516 - DNA, 208 bp, Homo sapiens
  chr19:53661683-53661891
  hyper
ggactttaaaaagcccggggcgggaggaggggtcaggaaagggttttaagcgggaggaagacgcgaaaggccggggacagggagaagcctcagagctacttcaacccaaagagaagcgactccgaacccacaccgcgagtcagctggggtggagggcgcggtgcggggatcttaaggtctgtagctgccgggcgcagtggctcacgct

SEQ ID NO: 13517 - DNA, 482 bp, Homo sapiens; identical to SEQ ID NO: 4686
  chr19:53696167-53696649
  hyper

SEQ ID NO: 13518 - DNA, 13 bp, Homo sapiens
  chr19:53696650-53696663
  hyper
gtggggaaaggcc

SEQ ID NO: 13519 - DNA, 35 bp, Homo sapiens
  chr19:53700349-53700384
  hyper
ctgtagacccggaagcggatcgcggggagtgaagg

SEQ ID NO: 13520 - DNA, 31 bp, Homo sapiens
  chr19:53700646-53700677
  hyper
cctaaaatcctttaccgatttttcttcccgc

SEQ ID NO: 13521 - DNA, 30 bp, Homo sapiens
  chr19:53757742-53757772
  hyper
ggtgtgtatccaccccgagtgagggcttta

SEQ ID NO: 13522 - DNA, 46 bp, Homo sapiens
  chr19:53758129-53758175
  hyper
aggaacctgcgcgtacgcgagtgcactggggcggcgcaaggggcaa

SEQ ID NO: 13523 - DNA, 142 bp, Homo sapiens; identical to SEQ ID NO: 4688
  chr19:53970501-53970643
  hyper

SEQ ID NO: 13524 - DNA, 261 bp, Homo sapiens; identical to SEQ ID NO: 4689
  chr19:53970763-53971024
  hyper

SEQ ID NO: 13525 - DNA, 101 bp, Homo sapiens
  chr19:53971344-53971445
  hyper
caaggggtggattctcgcccacttcggccggtggagcgcagaaccgcggccccagtcccgggaaggccgcgtcctctgtctggtcccgggatcctgcagac

SEQ ID NO: 13526 - DNA, 439 bp, Homo sapiens
  chr19:54024116-54024555
  hyper
aactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggag

SEQ ID NO: 13527 - DNA, 66 bp, Homo sapiens
  chr19:54024818-54024884
  hyper
catctgtaggggtgacgcagccgggctgtgtctctgcacctccgttctgtgcgaggtcaatgctgg

SEQ ID NO: 13528 - DNA, 93 bp, Homo sapiens
  chr19:54409951-54410044
  hyper
ctcccacagtgtggccgcagcggcgagaactttgacaagttcttcacgcgggcggcgccagcgctgacccctccagaccgcctagtcctggcc

SEQ ID NO: 13529 - DNA, 101 bp, Homo sapiens
  chr19:54410263-54410364
  hyper
ttccagctctgcccccgcgggttctagacgcccctcccaagcgttcctggccttctgaactccatacagcctctacagccgtcccgcgttcaagacttgag

SEQ ID NO: 13530 - DNA, 132 bp, Homo sapiens
  chr19:54411454-54411586
  hyper
gagtctggggagtgccggggaccgtgcagatggactacatttccccgcaggcctcgcggcagacccttcccccaagtgcggctccttgccgccagggctgatgggaaatgtagtctccggtcagggccagac

SEQ ID NO: 13531 - DNA, 153 bp, Homo sapiens; identical to SEQ ID NO: 4690
  chr19:54412839-54412992
  hyper

SEQ ID NO: 13532 - DNA, 74 bp, Homo sapiens
  chr19:54413489-54413563
  hyper
gagcccacagggctgcgaggggaccaggcagctcgcggtcaaacccctgagccgccaggcgggggatgggagga

SEQ ID NO: 13533 - DNA, 30 bp, Homo sapiens
  chr19:54463032-54463062
  hyper
cgacgtcccctcctccgtgcatcggagagt

SEQ ID NO: 13534 - DNA, 391 bp, Homo sapiens
  chr19:54466163-54466554
  hyper
tcttctcctctaatgcgagatctcgctccttgccctccaccagccgccgaccatggccgcgctctgaccccctccccggccgcagcctcctcctcgccgcccccctccccagccccgccggccccgggccccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaa

SEQ ID NO: 13535 - DNA, 51 bp, Homo sapiens
  chr19:54481352-54481403
  hyper
caaccctgaagtatccgcccccaccactgccctccccgctcctccagggtt

SEQ ID NO: 13536 - DNA, 197 bp, Homo sapiens; identical to SEQ ID NO: 1396
  chr19:54481771-54481968
  hyper

SEQ ID NO: 13537 - DNA, 229 bp, Homo sapiens
  chr19:54482817-54483046
  hyper
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggc

SEQ ID NO: 13538 - DNA, 77 bp, Homo sapiens; identical to SEQ ID NO: 1397
  chr19:54483391-54483468
  hyper

SEQ ID NO: 13539 - DNA, 94 bp, Homo sapiens; identical to SEQ ID NO: 4693
  chr19:54485553-54485647
  hyper

SEQ ID NO: 13540 - DNA, 325 bp, Homo sapiens; identical to SEQ ID NO: 4694
  chr19:54485672-54485997
  hyper

SEQ ID NO: 13541 - DNA, 93 bp, Homo sapiens
  chr19:55684842-55684935
  hyper
gggtgggagtcagggcgcaggcagcagcctcactcggtccgggggccgcagcgagtgccactgggcaatgggccgccgcgggttggccagcat

SEQ ID NO: 13542 - DNA, 97 bp, Homo sapiens
  chr19:55690949-55691046
  hyper
ccgcgaggtggggagcgggcagcctgtggtccgagcgcccacagccgactgctccctccgcacctggtcctgggagctgagacgcaggttccctctt

SEQ ID NO: 13543 - DNA, 40 bp, Homo sapiens
  chr19:55953904-55953944
  hyper
gtgccacagcagaagcggtaggagccggtgctgcagttga

SEQ ID NO: 13544 - DNA, 42 bp, Homo sapiens
  chr19:55954477-55954519
  hyper
ggagagtaatggaaacgcgcccgggcacggctgggggagaga

SEQ ID NO: 13545 - DNA, 32 bp, Homo sapiens
  chr19:55963152-55963184
  hyper
agcctcagttccctgcgcgcctccatttccct

SEQ ID NO: 13546 - DNA, 121 bp, Homo sapiens
  chr19:55963603-55963724
  hyper
tgggggccaggggaccggaccttctgggaggggtctgggctcccagggtcggcggtgggggctccgattgcccaacgcggggcgggctgactgacagctctgacgccggtgtctctgagga

SEQ ID NO: 13547 - DNA, 131 bp, Homo sapiens; identical to SEQ ID NO: 4695
  chr19:56728658-56728789
  hyper

SEQ ID NO: 13548 - DNA, 53 bp, Homo sapiens; identical to SEQ ID NO: 1398
  chr19:56879501-56879554
  hyper

SEQ ID NO: 13549 - DNA, 90 bp, Homo sapiens; identical to SEQ ID NO: 1399
  chr19:56879555-56879645
  hyper

SEQ ID NO: 13550 - DNA, 322 bp, Homo sapiens; identical to SEQ ID NO: 1400
  chr19:56879646-56879968
  hyper

SEQ ID NO: 13551 - DNA, 193 bp, Homo sapiens; identical to SEQ ID NO: 1401
  chr19:56904511-56904704
  hyper

SEQ ID NO: 13552 - DNA, 274 bp, Homo sapiens; identical to SEQ ID NO: 1402
  chr19:56904723-56904997
  hyper

SEQ ID NO: 13553 - DNA, 50 bp, Homo sapiens; identical to SEQ ID NO: 1403
  chr19:56904998-56905048
  hyper

SEQ ID NO: 13554 - DNA, 482 bp, Homo sapiens
  chr19:56915168-56915650
  hyper
gcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 13555 - DNA, 242 bp, Homo sapiens
  chr19:56915651-56915893
  hyper
ccgcgccggccccggactccatttcccagcggcccctgcggcctgccctagggctgcggcgcctttgtgagcgcggccgccggccaggatcgagccctggcccgggccctggcccagccccggcctccaaggaccgcgccgaaggaggtgcccactggagggaggaggcggtgaggagcgcgggatggagctgacgccgggagcggccatgccaccatgtgtgggaccgtgtgtgacagtgt

SEQ ID NO: 13556 - DNA, 107 bp, Homo sapiens; identical to SEQ ID NO: 4702
  chr19:56988557-56988664
  hyper

SEQ ID NO: 13557 - DNA, 47 bp, Homo sapiens
  chr19:57018744-57018791
  hyper
gccagagtcacaacacggtcggggttcctcgtcgctgtcttattcca

SEQ ID NO: 13558 - DNA, 282 bp, Homo sapiens
  chr19:57019202-57019484
  hyper
aggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcg

SEQ ID NO: 13559 - DNA, 58 bp, Homo sapiens
  chr19:57079102-57079160
  hyper
gcgaatctgcgcctgcgtgcatggcccggcggcgtgcggaaggcggtgtgtgttggaa

SEQ ID NO: 13560 - DNA, 30 bp, Homo sapiens
  chr19:57149347-57149377
  hyper
agggctttccccaggcggatgggttctttg

SEQ ID NO: 13561 - DNA, 460 bp, Homo sapiens
  chr19:57154254-57154714
  hyper
ccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggca

SEQ ID NO: 13562 - DNA, 183 bp, Homo sapiens; identical to SEQ ID NO: 1404
  chr19:57182944-57183127
  hyper

SEQ ID NO: 13563 - DNA, 87 bp, Homo sapiens
  chr19:57610741-57610828
  hyper
gccatggaccgccatcgccgctggacgtcagggccgccaggcccagcgagatgtcacctcctctgaggagccttccaggatcgcacc

SEQ ID NO: 13564 - DNA, 227 bp, Homo sapiens; identical to SEQ ID NO: 4704
  chr19:57617489-57617716
  hyper

SEQ ID NO: 13565 - DNA, 85 bp, Homo sapiens
  chr19:57618082-57618167
  hyper
ttcaaggtctgtcaccgtagggggcgggggggcgcgtggagccgctgggggttcggcccaccccgcgaaccgagctcccggccct

SEQ ID NO: 13566 - DNA, 62 bp, Homo sapiens
  chr19:57683265-57683327
  hyper
caggcaagggaaatgcgtccccgggccggggggcgcgagcgggggtccggggccgcgagctg

SEQ ID NO: 13567 - DNA, 94 bp, Homo sapiens
  chr19:57683592-57683686
  hyper
ggggcgcgccgggctcgtcctctccgcggcgctcagtggcagcagggagggccggtgagatgccagagcaaggtagggtcctgtatttggggac

SEQ ID NO: 13568 - DNA, 58 bp, Homo sapiens
  chr19:57683805-57683863
  hyper
cggttgatgtcaggcagtgctgggaggcgttgctctccgggttcgcttctctcctgtt

SEQ ID NO: 13569 - DNA, 181 bp, Homo sapiens
  chr19:57862457-57862638
  hyper
acatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgac

SEQ ID NO: 13570 - DNA, 238 bp, Homo sapiens
  chr19:57862639-57862877
  hyper
tatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtcctt

SEQ ID NO: 13571 - DNA, 15 bp, Homo sapiens
  chr19:57989033-57989048
  hyper
aacactagtaagcgg

SEQ ID NO: 13572 - DNA, 275 bp, Homo sapiens
  chr19:58011070-58011345
  hyper
atctccatcatctaccgtctccaatctccatctccgaagttatgcccacttcctcgaagtttggagccacgcgaactacactgcccagaaggcgccgcgccgtgagccgcgatgcttggccaatgaaaagaggtctacccgagagtgcgacgcgcaatgggcgggacttccggcgtctcccctcggcggttgctttcgctgccctcaagagaactcagcttgccggaagctggttgttcgctgcggcgaccagctccggaaagcgcggtggggac

SEQ ID NO: 13573 - DNA, 160 bp, Homo sapiens
  chr19:58011346-58011506
  hyper
cgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctc

SEQ ID NO: 13574 - DNA, 200 bp, Homo sapiens; identical to SEQ ID NO: 4705
  chr19:58038923-58039123
  hyper

SEQ ID NO: 13575 - DNA, 480 bp, Homo sapiens; identical to SEQ ID NO: 1405
  chr19:58094988-58095468
  hyper

SEQ ID NO: 13576 - DNA, 308 bp, Homo sapiens; identical to SEQ ID NO: 1406
  chr19:58095469-58095777
  hyper

SEQ ID NO: 13577 - DNA, 268 bp, Homo sapiens
  chr19:58111564-58111832
  hyper
gggttttctgcagcccggaccgcactgtccggcacagtgaggcgctggtgctggatctcgtttctggtagtgtggcagggagcgggagagcgacacggtcagggggctgcgcgggcaacagcttggagctgcgcctgagccgggaggctggggagacccaggccggcctcacgcgtgcaggtagcagagggtggggcagcgccgcgctgcattggccccactgagtttcaccagcacactgagggccacagcgcgtaggacagaagag

SEQ ID NO: 13578 - DNA, 590 bp, Homo sapiens
  chr19:58125422-58126012
  hyper
tttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggca

SEQ ID NO: 13579 - DNA, 140 bp, Homo sapiens
  chr19:58175834-58175974
  hyper
aggagtcggcgcggtcgtgcggccgtggaggacagcgagacccggggctgcggctgcaggccgaggggcccctgggacagtgagaagcagcggcgggagctagtcacggggcagggagcgctcagcggtaaagacggctt

SEQ ID NO: 13580 - DNA, 467 bp, Homo sapiens; identical to SEQ ID NO: 1407
  chr19:58219926-58220393
  hyper

SEQ ID NO: 13581 - DNA, 217 bp, Homo sapiens; identical to SEQ ID NO: 1408
  chr19:58220515-58220732
  hyper

SEQ ID NO: 13582 - DNA, 413 bp, Homo sapiens; identical to SEQ ID NO: 1409
  chr19:58238326-58238739
  hyper

SEQ ID NO: 13583 - DNA, 25 bp, Homo sapiens
  chr19:58238987-58239012
  hyper
gctacaaggaggagccggaagtccc

SEQ ID NO: 13584 - DNA, 188 bp, Homo sapiens; identical to SEQ ID NO: 1411
  chr19:58239013-58239201
  hyper

SEQ ID NO: 13585 - DNA, 239 bp, Homo sapiens
  chr19:58281000-58281239
  hyper
tcaagccaggacttccggcgtcctagccgtggcagccattttggcctgtcaggtccatccggcgatgctgggtctggacgagctcgggaggagtggttgtggccattgcacacaggcggatctgaggttcggcgacgccgctggtcgcgacccgggacaggacaacgacaggaacaccgccgagcccgcgttccccccccgcccagagtcatggcggcagcagccgctctgagggcgcc

SEQ ID NO: 13586 - DNA, 123 bp, Homo sapiens
  chr19:58400052-58400175
  hyper
agagccgtgaacaggcgctgctacctcgctgcttttgggtgacgatgaggtgacctgaggacacagaaggccccacaattacctgagcggagagcctcagcgtagccgcggcagccatcgaac

SEQ ID NO: 13587 - DNA, 112 bp, Homo sapiens; identical to SEQ ID NO: 1412
  chr19:58400406-58400518
  hyper

SEQ ID NO: 13588 - DNA, 41 bp, Homo sapiens
  chr19:58446443-58446484
  hyper
agacctgtgaacagtcgccgctctctcgctgcttcaggatt

SEQ ID NO: 13589 - DNA, 68 bp, Homo sapiens
  chr19:58459164-58459232
  hyper
taatgttcccacaggcgcacggcgggagagtgagggtcgcctccacctccttccggaagtaaaggcca

SEQ ID NO: 13590 - DNA, 78 bp, Homo sapiens
  chr19:58513793-58513871
  hyper
gcggcgcagcaggatcggggtctgcccgcctggggcgtttggcttttgtcccgcgccgaggtccggcccaggagtgcg

SEQ ID NO: 13591 - DNA, 128 bp, Homo sapiens
  chr19:58514138-58514266
  hyper
aggcctcacctcagccgcggacaatggcggctgcttccccggcgtcgaccggagcgcgccgcggggtctgctgggagctgtagttccaggcgggcacttccggcgtcgggcagcggcgccgccatgac

SEQ ID NO: 13592 - DNA, 30 bp, Homo sapiens
  chr19:58520911-58520941
  hyper
cctgacgctgatgctcgtctggctgcccgt

SEQ ID NO: 13593 - DNA, 15 bp, Homo sapiens
  chr19:58521301-58521316
  hyper
cggcagtaccttgcc

SEQ ID NO: 13594 - DNA, 186 bp, Homo sapiens
  chr19:58545202-58545388
  hyper
cagcagcgtccctgacgctgcgcgacccgttgccaaggcgactggaaccgcggcccgaggtaactggagggcacggcgggggcggggcgctcatcccaggcggcttctgattggcctcggccgcctcgtgcgtcacagccccgcccctgcccgggagtcccgcagcggtgacttgtcaccgacgcc

SEQ ID NO: 13595 - DNA, 38 bp, Homo sapiens
  chr19:58545651-58545689
  hyper
gtcgggggaggcgggcccgggcccgggagggggcgggc

SEQ ID NO: 13596 - DNA, 28 bp, Homo sapiens
  chr19:58609498-58609526
  hyper
tcgctctctgacccccgcgctgcatccc

SEQ ID NO: 13597 - DNA, 32 bp, Homo sapiens; identical to SEQ ID NO: 4715
  chr19:58609712-58609744
  hyper

SEQ ID NO: 13598 - DNA, 62 bp, Homo sapiens; identical to SEQ ID NO: 4716
  chr19:58609745-58609807
  hyper

SEQ ID NO: 13599 - DNA, 245 bp, Homo sapiens
  chr19:58662055-58662300
  hyper
gccaagacttccctccgcaggaaacggaggcagcgcagggctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactt

SEQ ID NO: 13600 - DNA, 222 bp, Homo sapiens
  chr19:58666273-58666495
  hyper
cccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 13601 - DNA, 183 bp, Homo sapiens
  chr19:58666550-58666733
  hyper
cgcggcgctccaccgcttccgccctcgggttgcgttagccgcgacgatggcgccccccagtggcagcagggaggctgtgggggtgctgggcgttgcggtgtgcaggttttctgggaggatacctggcgccgaccttgaagggaccccaacgtgagagggaaagacgcccgtgatgccaaggct

SEQ ID NO: 13602 - DNA, 30 bp, Homo sapiens
  chr19:58694552-58694582
  hyper
tagtgtggggccctgcggcctagcgtccct

SEQ ID NO: 13603 - DNA, 30 bp, Homo sapiens
  chr19:58695225-58695255
  hyper
gcggtagctccccagcggacaccttaagcc

SEQ ID NO: 13604 - DNA, 30 bp, Homo sapiens
  chr19:58951079-58951109
  hyper
gggccggaatcccagcgggtgagggcctgg

SEQ ID NO: 13605 - DNA, 74 bp, Homo sapiens; identical to SEQ ID NO: 1413
  chr19:58951525-58951599
  hyper

SEQ ID NO: 13606 - DNA, 178 bp, Homo sapiens; identical to SEQ ID NO: 1414
  chr19:58951600-58951778
  hyper

SEQ ID NO: 13607 - DNA, 279 bp, Homo sapiens; identical to SEQ ID NO: 1415
  chr19:58951779-58952058
  hyper

SEQ ID NO: 13608 - DNA, 28 bp, Homo sapiens
  chr20:291135-291163
  hyper
cgttgccatagaaaccggccgcacaggc

SEQ ID NO: 13609 - DNA, 153 bp, Homo sapiens; identical to SEQ ID NO: 1417
  chr20:291220-291373
  hyper

SEQ ID NO: 13610 - DNA, 145 bp, Homo sapiens
  chr20:590348-590493
  hyper
acactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgccca

SEQ ID NO: 13611 - DNA, 274 bp, Homo sapiens; identical to SEQ ID NO: 1418
  chr20:644552-644826
  hyper

SEQ ID NO: 13612 - DNA, 320 bp, Homo sapiens; identical to SEQ ID NO: 1419
  chr20:644985-645305
  hyper

SEQ ID NO: 13613 - DNA, 139 bp, Homo sapiens
  chr20:656937-657076
  hyper
aagagagggggaagccgaggggaacggagggaaagcggtcccgagcaggcggggttcaggcacatggggccgcagggaaggggatgcagaggaaagagtgcgcactggccagcggccaccctcccgcctccagtcctct

SEQ ID NO: 13614 - DNA, 47 bp, Homo sapiens
  chr20:708643-708690
  hyper
ccactggttcccttccgtactcgggcttcccccgctgttgttactcc

SEQ ID NO: 13615 - DNA, 72 bp, Homo sapiens; identical to SEQ ID NO: 4724
  chr20:982727-982799
  hyper

SEQ ID NO: 13616 - DNA, 253 bp, Homo sapiens; identical to SEQ ID NO: 4725
  chr20:982891-983144
  hyper

SEQ ID NO: 13617 - DNA, 38 bp, Homo sapiens
  chr20:1783339-1783377
  hyper
cagccattgcttgtgcgtcttcgcggagagagaggggg

SEQ ID NO: 13618 - DNA, 698 bp, Homo sapiens; identical to SEQ ID NO: 4726
  chr20:1783608-1784306
  hyper

SEQ ID NO: 13619 - DNA, 96 bp, Homo sapiens
  chr20:2539456-2539552
  hyper
gcgctcccgctccttcgcggcccttccccttcccccgtgagggactgatgcccccctccccggggagaggcagcccgtgccctcgctctggcttcc

SEQ ID NO: 13620 - DNA, 169 bp, Homo sapiens
  chr20:2539553-2539722
  hyper
tgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtgga

SEQ ID NO: 13621 - DNA, 136 bp, Homo sapiens
  chr20:2668792-2668928
  hyper
acactctggggcctccggggggcgctatggcccaacacacagcgtggccaagcgcgcctcagcctaactcaccacttcctatctgttttatacggtttgcacccgcttaaggcggcggaggcgtgggggagttctg

SEQ ID NO: 13622 - DNA, 35 bp, Homo sapiens
  chr20:2731640-2731675
  hyper
gctatctgaaaagggcggtgcggggatcaggaaaa

SEQ ID NO: 13623 - DNA, 219 bp, Homo sapiens; identical to SEQ ID NO: 1420
  chr20:2780903-2781122
  hyper

SEQ ID NO: 13624 - DNA, 589 bp, Homo sapiens; identical to SEQ ID NO: 1421
  chr20:2781123-2781712
  hyper

SEQ ID NO: 13625 - DNA, 30 bp, Homo sapiens
  chr20:2781916-2781946
  hyper
agttcttttaccacccgggagccaaccact

SEQ ID NO: 13626 - DNA, 38 bp, Homo sapiens
  chr20:2785819-2785857
  hyper
agcccgtattctcctcggggagccggcagccctgggtc

SEQ ID NO: 13627 - DNA, 152 bp, Homo sapiens; identical to SEQ ID NO: 1422
  chr20:3052540-3052692
  hyper

SEQ ID NO: 13628 - DNA, 380 bp, Homo sapiens; identical to SEQ ID NO: 1423
  chr20:3052693-3053073
  hyper

SEQ ID NO: 13629 - DNA, 73 bp, Homo sapiens
  chr20:3063708-3063781
  hyper
ttctcctcctggcagcgcagcgcctcagccgtgcccacgaagcagcccagctcgtccgcgcagcagatgctgg

SEQ ID NO: 13630 - DNA, 107 bp, Homo sapiens; identical to SEQ ID NO: 4731
  chr20:3073285-3073392
  hyper

SEQ ID NO: 13631 - DNA, 295 bp, Homo sapiens; identical to SEQ ID NO: 4732
  chr20:3073560-3073855
  hyper

SEQ ID NO: 13632 - DNA, 58 bp, Homo sapiens
  chr20:3218776-3218834
  hyper
ctccagtcctgggaccgcgtcccggccgcctggaagccagagccgttggtccaaaagg

SEQ ID NO: 13633 - DNA, 69 bp, Homo sapiens
  chr20:3220874-3220943
  hyper
ggaacggggacaggccggggcaagcccacctctgcgaaggaagggcttctggcgcgttggggaagcctc

SEQ ID NO: 13634 - DNA, 36 bp, Homo sapiens
  chr20:3229576-3229612
  hyper
gttcctactacagctcggccgcggcaggctggggcc

SEQ ID NO: 13635 - DNA, 164 bp, Homo sapiens; identical to SEQ ID NO: 4733
  chr20:3641773-3641937
  hyper

SEQ ID NO: 13636 - DNA, 49 bp, Homo sapiens
  chr20:3662664-3662713
  hyper
tcggcctctaggcagcggctcgcaactccggctccgcccaggctggatt

SEQ ID NO: 13637 - DNA, 30 bp, Homo sapiens
  chr20:3663038-3663068
  hyper
cgtggtgggatgaggcggtgggcaaaggcc

SEQ ID NO: 13638 - DNA, 130 bp, Homo sapiens
  chr20:3713321-3713451
  hyper
gggaggcctcagggccgggcgcacgtcgagggctgcggccgccgcagcgggcacggccaacgagctgcgggcccgggatcgcggcggctggacggggctggagctgtcgggagggcggaggtgagttctg

SEQ ID NO: 13639 - DNA, 30 bp, Homo sapiens
  chr20:3759057-3759087
  hyper
gacccctcacctgcacggtctcttgagagg

SEQ ID NO: 13640 - DNA, 93 bp, Homo sapiens
  chr20:4202639-4202732
  hyper
ggagacggaggaaggcgcgcttgaactcgcggctggaacaggggtagatgagcgggttcacgcagctgttgaagtagccgagccagaagatga

SEQ ID NO: 13641 - DNA, 113 bp, Homo sapiens
  chr20:4229392-4229505
  hyper
tcccccgcggagctccggttgtcctcgccgctgcctgcgcccaccacgccgccgccgccgcccgcgccccccggcacgccgcccaccgccgggccctccgagggggccgcgcc

SEQ ID NO: 13642 - DNA, 132 bp, Homo sapiens
  chr20:4229786-4229918
  hyper
ggcggccgggctccccgaggccggccgtggagtagcaccgaagagccggggcccgctacgcgcgcggcgctctgagcgtgcccggcaagcgggcaaagcggcggctccggggccgggcggtgcaggcagcgg

SEQ ID NO: 13643 - DNA, 30 bp, Homo sapiens
  chr20:4230306-4230336
  hyper
gggtcttcgggatcccggctttggccgcca

SEQ ID NO: 13644 - DNA, 751 bp, Homo sapiens
  chr20:4803129-4803880
  hyper
cagcccagacccacacggcgcccgaggtgaaacagaaccctcagtctccctatgaggccactggcactctcggctgtccccagagctctccgacttagagctgaatgcaaagtaagcgctcgaaatgcagaagtagccggggccgcccacggcacctgcctcgctcggggcgagagaagacgccaggctgaggtcccagcgacctcaggcaccagctccgaaggagggcggggagaccgcaaaggggaagtgcccggagggccaacggcccccgcgcaccctgcgcccctctgaagcgcgccgcctccccgcgccggggactgggacctgcctctggggaatccgcctagaagacggcggcggactggggtcgggcactctccagggctgtcaggccctccccagccctgcacctgccgcgccgccccacctcgccaggaagtctcagagaccccggggatggggtgggagcgccttcccatcgcgggctcaaaaagaaggaaggacgcccccaggggtcgtagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggc

SEQ ID NO: 13645 - DNA, 341 bp, Homo sapiens
  chr20:5296251-5296592
  hyper
tttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactcc

SEQ ID NO: 13646 - DNA, 198 bp, Homo sapiens; identical to SEQ ID NO: 4734
  chr20:5296850-5297048
  hyper

SEQ ID NO: 13647 - DNA, 194 bp, Homo sapiens; identical to SEQ ID NO: 4735
  chr20:5297225-5297419
  hyper

SEQ ID NO: 13648 - DNA, 223 bp, Homo sapiens
  chr20:6032982-6033205
  hyper
cggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtc

SEQ ID NO: 13649 - DNA, 256 bp, Homo sapiens
  chr20:6033206-6033462
  hyper
aggctgcgcagtgtgcgcggtaggcagccgggcaggcgctccaggttgcggttcgccagggtcaaggccgtcgcatccgcggcgggcagcccctcgcagggcgagtcggtggcgttgctgccactgctcccccaggggccctgctgagtgacccggaagagcgggaccttctcctggggagggtctgcccagctggggcgcagcaccgtcagcagcagcagcggtagggtttgccgcatggcgtctggggagagaa

SEQ ID NO: 13650 - DNA, 277 bp, Homo sapiens; identical to SEQ ID NO: 4736
  chr20:8112335-8112612
  hyper

SEQ ID NO: 13651 - DNA, 49 bp, Homo sapiens
  chr20:8112940-8112989
  hyper
atgtgctgaatggtgcgctttgaggcggcggcggcggaggagcagaatc

SEQ ID NO: 13652 - DNA, 144 bp, Homo sapiens
  chr20:8113461-8113605
  hyper
gggtggggcaaggggcgcgttatgcaatgggcgcactgggagcgggcaggggcagcctcgggcgcacaggttggcatctgccaaagcggatgtccaagggcagaagctttgcgcgcgctcctgtttcatcgggcttcagtagtt

SEQ ID NO: 13653 - DNA, 85 bp, Homo sapiens
  chr20:9487635-9487720
  hyper
tcagtgccaggctcccgggagctgcagctggctccaagtgcgtggccggaggcgtcccccatctgcacgagtccccagagtcacc

SEQ ID NO: 13654 - DNA, 17 bp, Homo sapiens
  chr20:9487788-9487805
  hyper
cgcgttgcctgctgtgg

SEQ ID NO: 13655 - DNA, 118 bp, Homo sapiens
  chr20:9488332-9488450
  hyper
cctggcgggctggaccgggacagggggcggtgcgcaccggggctcccaagcagccttagcggtggagaccttccgaggggaggcgagcctgcggtttgtctcccgttaaggtggaaga

SEQ ID NO: 13656 - DNA, 205 bp, Homo sapiens; identical to SEQ ID NO: 1424
  chr20:9489503-9489708
  hyper

SEQ ID NO: 13657 - DNA, 172 bp, Homo sapiens
  chr20:9495337-9495509
  hyper
cgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctcc

SEQ ID NO: 13658 - DNA, 30 bp, Homo sapiens
  chr20:9496079-9496109
  hyper
ttgttttgtttgttccgcagatacaatggc

SEQ ID NO: 13659 - DNA, 30 bp, Homo sapiens
  chr20:9496596-9496626
  hyper
cgccccggggccgggcgagctgagggggcg

SEQ ID NO: 13660 - DNA, 164 bp, Homo sapiens
  chr20:9819538-9819702
  hyper
gggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgg

SEQ ID NO: 13661 - DNA, 199 bp, Homo sapiens
  chr20:10198532-10198731
  hyper
tcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 13662 - DNA, 5 bp, Homo sapiens
  chr20:10198940-10198945
  hyper
cgggg

SEQ ID NO: 13663 - DNA, 295 bp, Homo sapiens
  chr20:10199333-10199628
  hyper
aggtttgcaggccagcgcactgggaaccgagtcaagcgcgccgcagcccgggccccgcccccgcccccgccgtgccccgcccccacttcctcccgcccctcgctgggcggctattaaaagctgctgacgtcaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggta

SEQ ID NO: 13664 - DNA, 37 bp, Homo sapiens
  chr20:10200078-10200115
  hyper
ggggagttcccgccccgggcaagctgagctgctgcag

SEQ ID NO: 13665 - DNA, 35 bp, Homo sapiens
  chr20:13200599-13200634
  hyper
agggggaaagggaggcgtgccgtcaagaaagagtt

SEQ ID NO: 13666 - DNA, 96 bp, Homo sapiens; identical to SEQ ID NO: 4738
  chr20:17206513-17206609
  hyper

SEQ ID NO: 13667 - DNA, 147 bp, Homo sapiens
  chr20:17208510-17208657
  hyper
cccacccccatcccccggagaaagaatagtttcctacagacgaggctggacgtttggacactgcaattcacctcggtgtttctcccaccccgcgccgggaggacttccctcccagggacttcggtccctgctcctctccgggaacaa

SEQ ID NO: 13668 - DNA, 64 bp, Homo sapiens
  chr20:17208739-17208803
  hyper
cgcccacccctggagcgcacttctggttggctccctagttctcaactcccggctacaggagctg

SEQ ID NO: 13669 - DNA, 57 bp, Homo sapiens
  chr20:19192824-19192881
  hyper
ccaggcactgccccccgccaaccctggcccgaccagcctcgccgctgcaggctgccg

SEQ ID NO: 13670 - DNA, 19 bp, Homo sapiens
  chr20:19739612-19739631
  hyper
cgggcggaggaggagcccc

SEQ ID NO: 13671 - DNA, 39 bp, Homo sapiens
  chr20:20344449-20344488
  hyper
ggaaggggaaaggatcggggtcgccgcagcctttctggt

SEQ ID NO: 13672 - DNA, 377 bp, Homo sapiens
  chr20:20344800-20345177
  hyper
agcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggact

SEQ ID NO: 13673 - DNA, 10 bp, Homo sapiens
  chr20:20346166-20346176
  hyper
gggtggtgaa

SEQ ID NO: 13674 - DNA, 377 bp, Homo sapiens; identical to SEQ ID NO: 1426
  chr20:20347333-20347710
  hyper

SEQ ID NO: 13675 - DNA, 486 bp, Homo sapiens; identical to SEQ ID NO: 1427
  chr20:20347736-20348222
  hyper

SEQ ID NO: 13676 - DNA, 26 bp, Homo sapiens
  chr20:20348257-20348283
  hyper
cggctccggctcgcggattgaaccct

SEQ ID NO: 13677 - DNA, 564 bp, Homo sapiens
  chr20:20348849-20349413
  hyper
gccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctca

SEQ ID NO: 13678 - DNA, 446 bp, Homo sapiens
  chr20:20349851-20350297
  hyper
gccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctg

SEQ ID NO: 13679 - DNA, 281 bp, Homo sapiens; identical to SEQ ID NO: 1429
  chr20:21080676-21080957
  hyper

SEQ ID NO: 13680 - DNA, 817 bp, Homo sapiens; identical to SEQ ID NO: 1430
  chr20:21081028-21081845
  hyper

SEQ ID NO: 13681 - DNA, 30 bp, Homo sapiens; identical to SEQ ID NO: 1431
  chr20:21082094-21082124
  hyper

SEQ ID NO: 13682 - DNA, 741 bp, Homo sapiens; identical to SEQ ID NO: 1432
  chr20:21082215-21082956
  hyper

SEQ ID NO: 13683 - DNA, 416 bp, Homo sapiens; identical to SEQ ID NO: 4747
  chr20:21083498-21083914
  hyper

SEQ ID NO: 13684 - DNA, 70 bp, Homo sapiens; identical to SEQ ID NO: 4748
  chr20:21084291-21084361
  hyper

SEQ ID NO: 13685 - DNA, 365 bp, Homo sapiens; identical to SEQ ID NO: 4749
  chr20:21085787-21086152
  hyper

SEQ ID NO: 13686 - DNA, 257 bp, Homo sapiens; identical to SEQ ID NO: 4750
  chr20:21086194-21086451
  hyper

SEQ ID NO: 13687 - DNA, 170 bp, Homo sapiens; identical to SEQ ID NO: 1433
  chr20:21086917-21087087
  hyper

SEQ ID NO: 13688 - DNA, 15 bp, Homo sapiens
  chr20:21372178-21372193
  hyper
gatggtggcggcgcc

SEQ ID NO: 13689 - DNA, 200 bp, Homo sapiens; identical to SEQ ID NO: 1435
  chr20:21372294-21372494
  hyper

SEQ ID NO: 13690 - DNA, 36 bp, Homo sapiens
  chr20:21372695-21372731
  hyper
aggatcctggagctgcgatctcgccagactctattc

SEQ ID NO: 13691 - DNA, 130 bp, Homo sapiens; identical to SEQ ID NO: 1436
  chr20:21376207-21376337
  hyper

SEQ ID NO: 13692 - DNA, 32 bp, Homo sapiens; identical to SEQ ID NO: 1437
  chr20:21376702-21376734
  hyper

SEQ ID NO: 13693 - DNA, 253 bp, Homo sapiens; identical to SEQ ID NO: 1438
  chr20:21376876-21377129
  hyper

SEQ ID NO: 13694 - DNA, 168 bp, Homo sapiens; identical to SEQ ID NO: 1439
  chr20:21377473-21377641
  hyper

SEQ ID NO: 13695 - DNA, 837 bp, Homo sapiens; identical to SEQ ID NO: 1440
  chr20:21377737-21378574
  hyper

SEQ ID NO: 13696 - DNA, 701 bp, Homo sapiens; identical to SEQ ID NO: 4759
  chr20:21485959-21486660
  hyper

SEQ ID NO: 13697 - DNA, 132 bp, Homo sapiens; identical to SEQ ID NO: 4760
  chr20:21486785-21486917
  hyper

SEQ ID NO: 13698 - DNA, 627 bp, Homo sapiens; identical to SEQ ID NO: 4761
  chr20:21486954-21487581
  hyper

SEQ ID NO: 13699 - DNA, 32 bp, Homo sapiens
  chr20:21488385-21488417
  hyper
agtgggatggatccccgcgcataattcaaagg

SEQ ID NO: 13700 - DNA, 30 bp, Homo sapiens
  chr20:21488767-21488797
  hyper
gcagtgagcaaagtgcgcacaagtgagcca

SEQ ID NO: 13701 - DNA, 146 bp, Homo sapiens; identical to SEQ ID NO: 1441
  chr20:21489301-21489447
  hyper

SEQ ID NO: 13702 - DNA, 80 bp, Homo sapiens; identical to SEQ ID NO: 1442
  chr20:21489621-21489701
  hyper

SEQ ID NO: 13703 - DNA, 523 bp, Homo sapiens; identical to SEQ ID NO: 1443
  chr20:21490175-21490698
  hyper

SEQ ID NO: 13704 - DNA, 91 bp, Homo sapiens
  chr20:21490914-21491005
  hyper
attgccaaagattctcgctccctggcttcctggggccaaagatcctagggagggctgcagtatcccctccctcccccgagcccagaacccc

SEQ ID NO: 13705 - DNA, 88 bp, Homo sapiens; identical to SEQ ID NO: 1444
  chr20:21491258-21491346
  hyper

SEQ ID NO: 13706 - DNA, 319 bp, Homo sapiens; identical to SEQ ID NO: 1445
  chr20:21492507-21492826
  hyper

SEQ ID NO: 13707 - DNA, 764 bp, Homo sapiens; identical to SEQ ID NO: 1446
  chr20:21493230-21493994
  hyper

SEQ ID NO: 13708 - DNA, 205 bp, Homo sapiens; identical to SEQ ID NO: 4768
  chr20:21494557-21494762
  hyper

SEQ ID NO: 13709 - DNA, 34 bp, Homo sapiens
  chr20:21496260-21496294
  hyper
tggctacctgatgctcgttcgccccagaggagtg

SEQ ID NO: 13710 - DNA, 453 bp, Homo sapiens; identical to SEQ ID NO: 4769
  chr20:21496683-21497136
  hyper

SEQ ID NO: 13711 - DNA, 74 bp, Homo sapiens
  chr20:21497413-21497487
  hyper
tttggcagcaagtgtcgtttctcgcatatccccagagccctcttaggtgggggagtgcccgcagaggcctccca

SEQ ID NO: 13712 - DNA, 312 bp, Homo sapiens; identical to SEQ ID NO: 4770
  chr20:21497802-21498114
  hyper

SEQ ID NO: 13713 - DNA, 370 bp, Homo sapiens; identical to SEQ ID NO: 4771
  chr20:21498479-21498849
  hyper

SEQ ID NO: 13714 - DNA, 101 bp, Homo sapiens
  chr20:21499374-21499475
  hyper
cctgttgtgggggtgcgctctaaacaacagcaaaccaggcaagaaaggaagatacaggagagcaggcgaggcctcggcacaccctacggaggggagccttt

SEQ ID NO: 13715 - DNA, 30 bp, Homo sapiens
  chr20:21500104-21500134
  hyper
gttggagactcagagcgtggcatgcacttg

SEQ ID NO: 13716 - DNA, 303 bp, Homo sapiens; identical to SEQ ID NO: 1447
  chr20:21501450-21501753
  hyper

SEQ ID NO: 13717 - DNA, 58 bp, Homo sapiens; identical to SEQ ID NO: 1448
  chr20:21502087-21502145
  hyper

SEQ ID NO: 13718 - DNA, 257 bp, Homo sapiens; identical to SEQ ID NO: 1449
  chr20:21502443-21502700
  hyper

SEQ ID NO: 13719 - DNA, 30 bp, Homo sapiens
  chr20:21503051-21503081
  hyper
ggaccagacagtcagcgcctggcagcgagg

SEQ ID NO: 13720 - DNA, 281 bp, Homo sapiens; identical to SEQ ID NO: 4775
  chr20:21503617-21503898
  hyper

SEQ ID NO: 13721 - DNA, 21 bp, Homo sapiens
  chr20:21503899-21503920
  hyper
acttcgcgggaggtcacagac

SEQ ID NO: 13722 - DNA, 57 bp, Homo sapiens; identical to SEQ ID NO: 1450
  chr20:21682399-21682456
  hyper

SEQ ID NO: 13723 - DNA, 455 bp, Homo sapiens; identical to SEQ ID NO: 4778
  chr20:21683317-21683772
  hyper

SEQ ID NO: 13724 - DNA, 17 bp, Homo sapiens
  chr20:21683899-21683916
  hyper
cgcggactctgctaccg

SEQ ID NO: 13725 - DNA, 109 bp, Homo sapiens; identical to SEQ ID NO: 4780
  chr20:21686184-21686293
  hyper

SEQ ID NO: 13726 - DNA, 369 bp, Homo sapiens; identical to SEQ ID NO: 4781
  chr20:21686294-21686663
  hyper

SEQ ID NO: 13727 - DNA, 217 bp, Homo sapiens
  chr20:21687009-21687226
  hyper
gacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctg

SEQ ID NO: 13728 - DNA, 116 bp, Homo sapiens
  chr20:21689945-21690061
  hyper
gggcggcggctacctcgccccgggcccgccgtggccgcctgcgcaaggtcctcctctggcgccccccggggccggcgtagctgtgcatggcggggaactcgcggcagcaatgacct

SEQ ID NO: 13729 - DNA, 61 bp, Homo sapiens; identical to SEQ ID NO: 4782
  chr20:21694499-21694560
  hyper

SEQ ID NO: 13730 - DNA, 71 bp, Homo sapiens
  chr20:21748445-21748516
  hyper
cccccttctggccctcgtcccgccggagctgcgcttgcgtgaacagccctcaaatgcgtgtttgccctgct

SEQ ID NO: 13731 - DNA, 226 bp, Homo sapiens
  chr20:22557414-22557640
  hyper
gcgataaagattgggcgtttaaattggccatttggaagattacatctcttcagcgagggtctttctttcaaaactcgcactgaattaagggtcatggctactccgtacccggctctcaaaggcacggcacctttgaattaggttgcggagtggcctgggcgaggggacccggggccatcaaaggcccgagggaaggccgtggggcgacacccgtctaatgacaagt

SEQ ID NO: 13732 - DNA, 46 bp, Homo sapiens
  chr20:22558637-22558683
  hyper
ggactcgaacccctgcgcgccaaggggagggcgtcaccatgctccg

SEQ ID NO: 13733 - DNA, 16 bp, Homo sapiens
  chr20:22559660-22559676
  hyper
cgttatctcggaaccc

SEQ ID NO: 13734 - DNA, 13 bp, Homo sapiens
  chr20:22559677-22559690
  hyper
ggctaggggaggg

SEQ ID NO: 13735 - DNA, 30 bp, Homo sapiens
  chr20:22562721-22562751
  hyper
gttgttgatggagaacgggtggttgaaggc

SEQ ID NO: 13736 - DNA, 149 bp, Homo sapiens
  chr20:22567416-22567565
  hyper
agcactattggtggccggggtcagggacaccagagagcgctcggcgggggcttccacagtgacagggcgccccctgtcggccgccaggcccgcgggaccgacccgagtcctcatttacccccgcgatcccaaccccgcagctccggcac

SEQ ID NO: 13737 - DNA, 124 bp, Homo sapiens
  chr20:23029875-23029999
  hyper
ccgatccagaggcgccggcggccaacgccgccgtcgccgttcagtagcaaggaaatgacatcggcagccaccgaggagcgcactgtcattaggtggccccgcagtccgtcgcagatctgactgg

SEQ ID NO: 13738 - DNA, 62 bp, Homo sapiens
  chr20:23030295-23030357
  hyper
gcagcctctgacatgcggatcggccagggctcgagtttataagtgcccggccctccctccct

SEQ ID NO: 13739 - DNA, 30 bp, Homo sapiens
  chr20:23030745-23030775
  hyper
acaggacctgcaagacgctgggaggggtga

SEQ ID NO: 13740 - DNA, 30 bp, Homo sapiens
  chr20:23031047-23031077
  hyper
atcgggtggggaagtcgcggggacactgtc

SEQ ID NO: 13741 - DNA, 163 bp, Homo sapiens
  chr20:23031307-23031470
  hyper
ccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaaga

SEQ ID NO: 13742 - DNA, 804 bp, Homo sapiens; identical to SEQ ID NO: 4783
  chr20:24449900-24450704
  hyper

SEQ ID NO: 13743 - DNA, 200 bp, Homo sapiens; identical to SEQ ID NO: 4784
  chr20:24450819-24451019
  hyper

SEQ ID NO: 13744 - DNA, 81 bp, Homo sapiens
  chr20:24451426-24451507
  hyper
acgcagaggcttgggcgcttggcacccagacttcaggtgcgcacagtcctcctgcgacgtcagatgcgctggcgccgcggc

SEQ ID NO: 13745 - DNA, 36 bp, Homo sapiens
  chr20:25058448-25058484
  hyper
ccccagcgcttctcccgcttgcgccatttggccctg

SEQ ID NO: 13746 - DNA, 43 bp, Homo sapiens; identical to SEQ ID NO: 1451
  chr20:25061746-25061789
  hyper

SEQ ID NO: 13747 - DNA, 334 bp, Homo sapiens; identical to SEQ ID NO: 1452
  chr20:25061978-25062312
  hyper

SEQ ID NO: 13748 - DNA, 136 bp, Homo sapiens; identical to SEQ ID NO: 1453
  chr20:25062510-25062646
  hyper

SEQ ID NO: 13749 - DNA, 111 bp, Homo sapiens; identical to SEQ ID NO: 1454
  chr20:25062707-25062818
  hyper

SEQ ID NO: 13750 - DNA, 71 bp, Homo sapiens; identical to SEQ ID NO: 1455
  chr20:25062870-25062941
  hyper

SEQ ID NO: 13751 - DNA, 180 bp, Homo sapiens; identical to SEQ ID NO: 1456
  chr20:25063727-25063907
  hyper

SEQ ID NO: 13752 - DNA, 518 bp, Homo sapiens; identical to SEQ ID NO: 1457
  chr20:25063993-25064511
  hyper

SEQ ID NO: 13753 - DNA, 30 bp, Homo sapiens
  chr20:25064790-25064820
  hyper
ttaacccagtcacatcggacacagagacgt

SEQ ID NO: 13754 - DNA, 28 bp, Homo sapiens
  chr20:25065179-25065207
  hyper
ccacccagagcccagcgtcaagttatac

SEQ ID NO: 13755 - DNA, 187 bp, Homo sapiens; identical to SEQ ID NO: 1459
  chr20:25065208-25065395
  hyper

SEQ ID NO: 13756 - DNA, 29 bp, Homo sapiens
  chr20:25129464-25129493
  hyper
cgcccatccccgtgcgcacgtgttcgctg

SEQ ID NO: 13757 - DNA, 206 bp, Homo sapiens
  chr20:25565991-25566197
  hyper
gtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctccc

SEQ ID NO: 13758 - DNA, 151 bp, Homo sapiens
  chr20:26188811-26188962
  hyper
aaacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccac

SEQ ID NO: 13759 - DNA, 19 bp, Homo sapiens
  chr20:26189582-26189601
  hyper
ggcccgcagaggcgctcag

SEQ ID NO: 13760 - DNA, 30 bp, Homo sapiens
  chr20:26189977-26190007
  hyper
ctcactcaaccgcctcgaaccccacaccga

SEQ ID NO: 13761 - DNA, 136 bp, Homo sapiens
  chr20:30063113-30063249
  hyper
cctggagcatccagccgctggagctgcgagggaccctggacccctcccacgccgaggtaaagccctgcgctacgcgccgccaacttgctcaagttggagcagagttcgccaggcgattgaagggggattcggcagc

SEQ ID NO: 13762 - DNA, 262 bp, Homo sapiens
  chr20:30063250-30063512
  hyper
ttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccg

SEQ ID NO: 13763 - DNA, 39 bp, Homo sapiens
  chr20:30582939-30582978
  hyper
ctggcagatgctgttcgagagcgccgacgtgagcatgct

SEQ ID NO: 13764 - DNA, 136 bp, Homo sapiens
  chr20:30639183-30639319
  hyper
aatggagcaggcctgcggaagagaaaccgctgaccacagacctgcctggaagtctcgggccgcggagttggggagggccgggccagaagggaggggtcggagtggtggggaaaagagatcacgatgcttccggggt

SEQ ID NO: 13765 - DNA, 236 bp, Homo sapiens
  chr20:30639800-30640036
  hyper
gaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctg

SEQ ID NO: 13766 - DNA, 16 bp, Homo sapiens
  chr20:30640240-30640256
  hyper
caagctgcgaggatcc

SEQ ID NO: 13767 - DNA, 103 bp, Homo sapiens
  chr20:30640257-30640360
  hyper
ggctgcccgcgagacgaggagcgggcgcccaggtgagtgccgcgcacaggggaccgggaatacccggcccgcgaggggtcccaggaggcggagggagcccagg

SEQ ID NO: 13768 - DNA, 209 bp, Homo sapiens
  chr20:30777956-30778165
  hyper
cgccccccagcttctcgggcccgggccgcggggaccgtgcgcgcgtccccctcccgggcaaggccgggcggcgggcgcgccgcggcttctggggtccccgccctcttgtccgccatcgcctgcgggagcctctggcctggaggggctcggggcgcgctggcgactgcgggctcggcgacaggggcggctggtggcgggaggacagtggg

SEQ ID NO: 13769 - DNA, 38 bp, Homo sapiens
  chr20:32804098-32804136
  hyper
tctccgagtaggtgccgcgcgggcgggcgctggcgcca

SEQ ID NO: 13770 - DNA, 254 bp, Homo sapiens
  chr20:33146323-33146577
  hyper
tgcgggagaagctcccgcgctgcccatgacgtcacgggactgtgacgcgcccagaagccccgcccctcgcgtcccggtccgcggacccaggctctctgcgccgtgacgtcacgggtccgggcgggcgggttgtgcgtcggcccaatgggagcggcgcactggcctcccctttaaggaatgttgtgacctgacgtcaccgggcgagttacctcccgcagccgcagccgccgtgctcagcgcgagccccggagccc

SEQ ID NO: 13771 - DNA, 24 bp, Homo sapiens
  chr20:34188608-34188632
  hyper
ttctttttcttctttcgggtgagc

SEQ ID NO: 13772 - DNA, 342 bp, Homo sapiens; identical to SEQ ID NO: 1461
  chr20:34188747-34189089
  hyper

SEQ ID NO: 13773 - DNA, 326 bp, Homo sapiens; identical to SEQ ID NO: 1462
  chr20:34189166-34189492
  hyper

SEQ ID NO: 13774 - DNA, 375 bp, Homo sapiens; identical to SEQ ID NO: 1463
  chr20:34189679-34190054
  hyper

SEQ ID NO: 13775 - DNA, 74 bp, Homo sapiens
  chr20:35491337-35491411
  hyper
tccaggcccagcaggcgcgcctcctccgacgcgcagtccgacacctccgagctgctatccgtgaggctgggggg

SEQ ID NO: 13776 - DNA, 40 bp, Homo sapiens
  chr20:36013211-36013251
  hyper
ggcaccggatggccccggttgggcccgcgccaggatgcgc

SEQ ID NO: 13777 - DNA, 174 bp, Homo sapiens
  chr20:36531812-36531986
  hyper
ctcggcggcgccacgcggcccgccggccacgcgccctgggacaaccacgtctccggccacggtgagttcggtcgccgcccccgcggacttccccaccaaaccccaacccgggccgcgccactccaacttggccgccccggggctcgaaccggcgccagtcgtggcgggcatccc

SEQ ID NO: 13778 - DNA, 69 bp, Homo sapiens
  chr20:36888892-36888961
  hyper
gcgttaccatggtgacgggctgccagcggcgggcggcgcggctcctctcctgggcgcggggtctgtggg

SEQ ID NO: 13779 - DNA, 796 bp, Homo sapiens; identical to SEQ ID NO: 1464
  chr20:37302580-37303376
  hyper

SEQ ID NO: 13780 - DNA, 122 bp, Homo sapiens
  chr20:37351701-37351823
  hyper
acttccagtcacagccgctacttctccattcaggctgggactgccaggtggagccctgcggtttactgctcaggaggagcccggccaggacatcagctggggacttacgcagggacccattc

SEQ ID NO: 13781 - DNA, 401 bp, Homo sapiens; identical to SEQ ID NO: 1465
  chr20:37352115-37352516
  hyper

SEQ ID NO: 13782 - DNA, 20 bp, Homo sapiens
  chr20:37352606-37352626
  hyper
cggggcgcccagaccagtcc

SEQ ID NO: 13783 - DNA, 250 bp, Homo sapiens
  chr20:37352977-37353227
  hyper
cgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgaggg

SEQ ID NO: 13784 - DNA, 284 bp, Homo sapiens; identical to SEQ ID NO: 1467
  chr20:37353435-37353719
  hyper

SEQ ID NO: 13785 - DNA, 1026 bp, Homo sapiens; identical to SEQ ID NO: 1468
  chr20:37353806-37354832
  hyper

SEQ ID NO: 13786 - DNA, 239 bp, Homo sapiens; identical to SEQ ID NO: 1469
  chr20:37354993-37355232
  hyper

SEQ ID NO: 13787 - DNA, 541 bp, Homo sapiens; identical to SEQ ID NO: 1470
  chr20:37355502-37356043
  hyper

SEQ ID NO: 13788 - DNA, 297 bp, Homo sapiens; identical to SEQ ID NO: 1471
  chr20:37356168-37356465
  hyper

SEQ ID NO: 13789 - DNA, 73 bp, Homo sapiens
  chr20:37356716-37356789
  hyper
gcatgatgaactggacgcacatcgcagcctgcgtgctcaagggcctcttcgcgctcgtcgcctacctcacctg

SEQ ID NO: 13790 - DNA, 295 bp, Homo sapiens
  chr20:37357254-37357549
  hyper
agcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctct

SEQ ID NO: 13791 - DNA, 365 bp, Homo sapiens; identical to SEQ ID NO: 1472
  chr20:37357825-37358190
  hyper

SEQ ID NO: 13792 - DNA, 224 bp, Homo sapiens; identical to SEQ ID NO: 1473
  chr20:37434129-37434353
  hyper

SEQ ID NO: 13793 - DNA, 234 bp, Homo sapiens; identical to SEQ ID NO: 1474
  chr20:37434488-37434722
  hyper

SEQ ID NO: 13794 - DNA, 158 bp, Homo sapiens; identical to SEQ ID NO: 1475
  chr20:37434736-37434894
  hyper

SEQ ID NO: 13795 - DNA, 440 bp, Homo sapiens; identical to SEQ ID NO: 1476
  chr20:37434930-37435370
  hyper

SEQ ID NO: 13796 - DNA, 229 bp, Homo sapiens; identical to SEQ ID NO: 1477
  chr20:37435487-37435716
  hyper

SEQ ID NO: 13797 - DNA, 132 bp, Homo sapiens; identical to SEQ ID NO: 1478
  chr20:37435717-37435849
  hyper

SEQ ID NO: 13798 - DNA, 228 bp, Homo sapiens
  chr20:39316107-39316335
  hyper
gcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggt

SEQ ID NO: 13799 - DNA, 515 bp, Homo sapiens
  chr20:39317052-39317567
  hyper
cgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcggg

SEQ ID NO: 13800 - DNA, 146 bp, Homo sapiens; identical to SEQ ID NO: 4813
  chr20:39319058-39319204
  hyper

SEQ ID NO: 13801 - DNA, 512 bp, Homo sapiens; identical to SEQ ID NO: 4814
  chr20:39995034-39995546
  hyper

SEQ ID NO: 13802 - DNA, 67 bp, Homo sapiens; identical to SEQ ID NO: 4815
  chr20:39995547-39995614
  hyper

SEQ ID NO: 13803 - DNA, 131 bp, Homo sapiens
  chr20:41817785-41817916
  hyper
agcttcctgtatctccgaggaaaaaagaaaagccgccgccccggcagcctcggcctgctggggacctgtcctccccactaaaagcgcgcgctgcccgaggagctgcccgggagagaacgctccaccccggg

SEQ ID NO: 13804 - DNA, 15 bp, Homo sapiens
  chr20:41818007-41818022
  hyper
cgcggaaagttactc

SEQ ID NO: 13805 - DNA, 236 bp, Homo sapiens; identical to SEQ ID NO: 1479
  chr20:41818513-41818749
  hyper

SEQ ID NO: 13806 - DNA, 211 bp, Homo sapiens; identical to SEQ ID NO: 1480
  chr20:41818804-41819015
  hyper

SEQ ID NO: 13807 - DNA, 102 bp, Homo sapiens
  chr20:42136090-42136192
  hyper
tgtgatgcaggggttcgggggcaggaaaaatctcgacccgccacgcccgtgcggcaaacctgtcctaggttgagggggcatgaggcgcgcacaaccagggcc

SEQ ID NO: 13808 - DNA, 71 bp, Homo sapiens
  chr20:42136403-42136474
  hyper
tgggctcagaccttgcgtcccctgggcgccgcgccaccccgctccgtccagggcggcgagggctcaggtct

SEQ ID NO: 13809 - DNA, 836 bp, Homo sapiens; identical to SEQ ID NO: 1481
  chr20:42543698-42544534
  hyper

SEQ ID NO: 13810 - DNA, 257 bp, Homo sapiens; identical to SEQ ID NO: 1482
  chr20:42544727-42544984
  hyper

SEQ ID NO: 13811 - DNA, 170 bp, Homo sapiens
  chr20:42587835-42588005
  hyper
ggaggaatctgaggacgagaggggtaagatccctgcccactgccatgcagcagcttagtgcagagcctggacttgaacctagatctgcctgcttccagagctgtgctgcaccagtgttctcgcagctcccagtccaaaggccgacgttgagacagcgcttaaaaatatat

SEQ ID NO: 13812 - DNA, 798 bp, Homo sapiens
  chr20:43438334-43439132
  hyper
cgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgc

SEQ ID NO: 13813 - DNA, 27 bp, Homo sapiens
  chr20:43439192-43439219
  hyper
gcggcgccccccgccggcagcgcgagg

SEQ ID NO: 13814 - DNA, 263 bp, Homo sapiens
  chr20:43439247-43439510
  hyper
cgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatg

SEQ ID NO: 13815 - DNA, 1 bp, Homo sapiens
  chr20:43726629-43726630
  hyper
g

SEQ ID NO: 13816 - DNA, 24 bp, Homo sapiens
  chr20:43726764-43726788
  hyper
cgagtagcccgggttctccatggt

SEQ ID NO: 13817 - DNA, 187 bp, Homo sapiens
  chr20:44452827-44453014
  hyper
tcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgacc

SEQ ID NO: 13818 - DNA, 30 bp, Homo sapiens
  chr20:44540105-44540135
  hyper
ggggtggggtggggtcgcaggagttatctg

SEQ ID NO: 13819 - DNA, 37 bp, Homo sapiens
  chr20:44540652-44540689
  hyper
ggcttcagtgcaccacgcggctcggcgagggactggg

SEQ ID NO: 13820 - DNA, 62 bp, Homo sapiens
  chr20:44639434-44639496
  hyper
aggctgggagagcttcgcgcaggcgggatttcagcccgcacttatttcggagcccttgcctt

SEQ ID NO: 13821 - DNA, 233 bp, Homo sapiens
  chr20:44650230-44650463
  hyper
gattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctga

SEQ ID NO: 13822 - DNA, 47 bp, Homo sapiens
  chr20:44659209-44659256
  hyper
cgcgcctgctgtctgcgctcagcgccttcaaacgttcccctgggcac

SEQ ID NO: 13823 - DNA, 78 bp, Homo sapiens
  chr20:44660871-44660949
  hyper
ctagttgcagggtctcgggccaggaagcccctattcctgtcccctgagcgccacccgcccccgcgaaggaggaggcgc

SEQ ID NO: 13824 - DNA, 90 bp, Homo sapiens
  chr20:44686525-44686615
  hyper
aaggttgggagaaggcgcggaaaggagaggagctggggccttggggacccccaggtagtccatgcggcccattcctccccttcccactcc

SEQ ID NO: 13825 - DNA, 164 bp, Homo sapiens
  chr20:44686627-44686791
  hyper
cgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaa

SEQ ID NO: 13826 - DNA, 41 bp, Homo sapiens
  chr20:44687186-44687227
  hyper
tcaagaggaagaaaccgagaggcccgcgccccaccgaggaa

SEQ ID NO: 13827 - DNA, 4 bp, Homo sapiens
  chr20:44803122-44803126
  hyper
gccc

SEQ ID NO: 13828 - DNA, 562 bp, Homo sapiens
  chr20:44803172-44803734
  hyper
cggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagg

SEQ ID NO: 13829 - DNA, 127 bp, Homo sapiens
  chr20:44880040-44880167
  hyper
cggccgccgggatgtcgcccccgacggggcacccggacgggcccgcggccctgaacgccgcccagccgcgggggtacccggctggagggggagggggcgcggccgcatccggggcatggacagcccc

SEQ ID NO: 13830 - DNA, 157 bp, Homo sapiens
  chr20:44936314-44936471
  hyper
cgcggctggagtcagcctccgggtgtccccggacgcggcacgacctcgcacacacacaccgcgcgcacacgctcgcgccgtgcggtattttcccggccccggaccccgcctctgggaggggccggggagccgagccccgctagcagggttgggggac

SEQ ID NO: 13831 - DNA, 127 bp, Homo sapiens
  chr20:44941500-44941627
  hyper
gcccttggctgggggcgccaggacggggaggggcgagcctgcgggagccacaggcgccgaggccgtgcgcccttaagcacctccacctcatggcgttaatcctcgcagaccccgcagccagactgcc

SEQ ID NO: 13832 - DNA, 71 bp, Homo sapiens
  chr20:45141858-45141929
  hyper
ttcaccttcaccaagcgccttcttcgggcaaatcagggccctagagagagctcgcccgtggcctgcaggtc

SEQ ID NO: 13833 - DNA, 43 bp, Homo sapiens
  chr20:45142185-45142228
  hyper
cccggaagagcctggcgaaccggaagggcgtccaggtaaaaaa

SEQ ID NO: 13834 - DNA, 128 bp, Homo sapiens; identical to SEQ ID NO: 1483
  chr20:45279854-45279982
  hyper

SEQ ID NO: 13835 - DNA, 218 bp, Homo sapiens; identical to SEQ ID NO: 1484
  chr20:45280039-45280257
  hyper

SEQ ID NO: 13836 - DNA, 410 bp, Homo sapiens
  chr20:45523248-45523658
  hyper
accggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggcc

SEQ ID NO: 13837 - DNA, 140 bp, Homo sapiens
  chr20:45523893-45524033
  hyper
tgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccc

SEQ ID NO: 13838 - DNA, 55 bp, Homo sapiens
  chr20:45524523-45524578
  hyper
aggttcctgcttccccgaagccgaggctgagagttgacagcgtgcaccctgccgc

SEQ ID NO: 13839 - DNA, 218 bp, Homo sapiens; identical to SEQ ID NO: 4822
  chr20:47443719-47443937
  hyper

SEQ ID NO: 13840 - DNA, 297 bp, Homo sapiens; identical to SEQ ID NO: 4823
  chr20:47443944-47444241
  hyper

SEQ ID NO: 13841 - DNA, 186 bp, Homo sapiens; identical to SEQ ID NO: 4824
  chr20:47444242-47444428
  hyper

SEQ ID NO: 13842 - DNA, 129 bp, Homo sapiens; identical to SEQ ID NO: 4825
  chr20:47444452-47444581
  hyper

SEQ ID NO: 13843 - DNA, 184 bp, Homo sapiens; identical to SEQ ID NO: 4826
  chr20:47444609-47444793
  hyper

SEQ ID NO: 13844 - DNA, 295 bp, Homo sapiens; identical to SEQ ID NO: 4827
  chr20:47444920-47445215
  hyper

SEQ ID NO: 13845 - DNA, 134 bp, Homo sapiens; identical to SEQ ID NO: 4828
  chr20:47934853-47934987
  hyper

SEQ ID NO: 13846 - DNA, 606 bp, Homo sapiens; identical to SEQ ID NO: 4829
  chr20:47934988-47935594
  hyper

SEQ ID NO: 13847 - DNA, 50 bp, Homo sapiens
  chr20:47935928-47935978
  hyper
gttgcaagcttctttcgggcggaggggtcacaaggcgaatggagaaggtg

SEQ ID NO: 13848 - DNA, 30 bp, Homo sapiens
  chr20:48099143-48099173
  hyper
ggcgcgcgtcacggccgtcttctcacctcc

SEQ ID NO: 13849 - DNA, 30 bp, Homo sapiens
  chr20:48099543-48099573
  hyper
tcccgaacctggccccgccatggggagaga

SEQ ID NO: 13850 - DNA, 225 bp, Homo sapiens
  chr20:48184381-48184606
  hyper
ttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagc

SEQ ID NO: 13851 - DNA, 54 bp, Homo sapiens
  chr20:48788965-48789019
  hyper
ccagagctgaccctgcggcgcctttcccaggctcgcgtccggtgagttcctatt

SEQ ID NO: 13852 - DNA, 255 bp, Homo sapiens
  chr20:49639257-49639512
  hyper
tggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctgga

SEQ ID NO: 13853 - DNA, 83 bp, Homo sapiens
  chr20:49639774-49639857
  hyper
tcgggacagtggcagcggcgccaccgtcacggggcgtccaggcgcccaatcgggaccccgcaccttggatccgggggccctgg

SEQ ID NO: 13854 - DNA, 38 bp, Homo sapiens
  chr20:49639882-49639920
  hyper
cggccagttcctgagcccgcgtccgggactgctcgcgc

SEQ ID NO: 13855 - DNA, 48 bp, Homo sapiens
  chr20:49836918-49836966
  hyper
ccgtcctgcaggtggcgcgcctgagcccgtgcacggcagcctctccgg

SEQ ID NO: 13856 - DNA, 30 bp, Homo sapiens
  chr20:50157990-50158020
  hyper
tcctcctccctctaacgaatgctcctgtta

SEQ ID NO: 13857 - DNA, 30 bp, Homo sapiens
  chr20:50158389-50158419
  hyper
aggtgatgggagctgcgtggcctcacttca

SEQ ID NO: 13858 - DNA, 809 bp, Homo sapiens; identical to SEQ ID NO: 1485
  chr20:50720392-50721201
  hyper

SEQ ID NO: 13859 - DNA, 437 bp, Homo sapiens; identical to SEQ ID NO: 1486
  chr20:50721234-50721671
  hyper

SEQ ID NO: 13860 - DNA, 30 bp, Homo sapiens
  chr20:51589878-51589908
  hyper
gaaacggctccgcttcggggctgccctgtg

SEQ ID NO: 13861 - DNA, 30 bp, Homo sapiens
  chr20:52789445-52789475
  hyper
acaggatcagcagcccgtagccttctttgc

SEQ ID NO: 13862 - DNA, 15 bp, Homo sapiens
  chr20:52789934-52789949
  hyper
tggggcccggcaggg

SEQ ID NO: 13863 - DNA, 48 bp, Homo sapiens
  chr20:53091752-53091800
  hyper
ctccccagacacacacgcaaaatcggcccttctcggggaaagggcagg

SEQ ID NO: 13864 - DNA, 67 bp, Homo sapiens
  chr20:53092166-53092233
  hyper
gctggatccctcagccgccgccgctcctcctcctggcaggccggccgcggagtcagctgacgccggc

SEQ ID NO: 13865 - DNA, 100 bp, Homo sapiens
  chr20:53092234-53092334
  hyper
ctccagcctcgcctccccgcgccgcgctctgcgctccccgaaagtggctgcaagccggccgcccactgtcagggttggggggacagagaaagtgatgtgc

SEQ ID NO: 13866 - DNA, 41 bp, Homo sapiens
  chr20:53092335-53092376
  hyper
ccttctaaagcctcgcccagcgccgccgaagcagcttcacc

SEQ ID NO: 13867 - DNA, 32 bp, Homo sapiens
  chr20:53092763-53092795
  hyper
ctttctgatggtggccgcgtgttgggcttcag

SEQ ID NO: 13868 - DNA, 30 bp, Homo sapiens
  chr20:53093219-53093249
  hyper
tgatacctggcatagcgcaagtgctcccta

SEQ ID NO: 13869 - DNA, 218 bp, Homo sapiens; identical to SEQ ID NO: 4832
  chr20:54578507-54578725
  hyper

SEQ ID NO: 13870 - DNA, 405 bp, Homo sapiens
  chr20:54580117-54580522
  hyper
aaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 13871 - DNA, 42 bp, Homo sapiens
  chr20:54580621-54580663
  hyper
cgctccgggaagatgagcctcagaagccgcaggggcgcgcct

SEQ ID NO: 13872 - DNA, 65 bp, Homo sapiens
  chr20:54919287-54919352
  hyper
cgagcgcgcaactctcagcctcggagcgtgctggaaatgctgatgggaaccgtttgaatgaccgg

SEQ ID NO: 13873 - DNA, 413 bp, Homo sapiens; identical to SEQ ID NO: 1487
  chr20:55199898-55200311
  hyper

SEQ ID NO: 13874 - DNA, 98 bp, Homo sapiens; identical to SEQ ID NO: 1488
  chr20:55200615-55200713
  hyper

SEQ ID NO: 13875 - DNA, 320 bp, Homo sapiens; identical to SEQ ID NO: 4835
  chr20:55201037-55201357
  hyper

SEQ ID NO: 13876 - DNA, 2 bp, Homo sapiens
  chr20:55201450-55201452
  hyper
gg

SEQ ID NO: 13877 - DNA, 305 bp, Homo sapiens; identical to SEQ ID NO: 4837
  chr20:55201764-55202069
  hyper

SEQ ID NO: 13878 - DNA, 268 bp, Homo sapiens; identical to SEQ ID NO: 4838
  chr20:55202358-55202626
  hyper

SEQ ID NO: 13879 - DNA, 111 bp, Homo sapiens
  chr20:55202996-55203107
  hyper
atgctaaagttcaaacgaacccgagaaggaacagcgaggcagtggatgccgccattccgtggatgggagagtcatgtctactgcaggtgcggacaccgtactgataggcat

SEQ ID NO: 13880 - DNA, 254 bp, Homo sapiens
  chr20:55204135-55204389
  hyper
ggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatttccttctcattaaggcgctcgggtcccccggctatcgccaggacacactgttcgggcgcggctttcc

SEQ ID NO: 13881 - DNA, 47 bp, Homo sapiens
  chr20:55204938-55204985
  hyper
ctcggaaaagtgccccgtctgcaaccctcagacgtggcttttacgca

SEQ ID NO: 13882 - DNA, 89 bp, Homo sapiens
  chr20:55206293-55206382
  hyper
cgggtcccccacctctcctccgccgggcagcacctctacagccccgcgccacccctctcccacactggagtcgccgaatatcagccgcc

SEQ ID NO: 13883 - DNA, 73 bp, Homo sapiens
  chr20:55499791-55499864
  hyper
aaaggggggggaacccgattagttccaaataagcgtctcttaatcacccttatgaaggcgtaatttgcaaaac

SEQ ID NO: 13884 - DNA, 163 bp, Homo sapiens
  chr20:55500507-55500670
  hyper
aactgtagggtgcctcgccgactcggagccgcagagactggcggcgggtcaacttggaccactttgcattcacgctttgaataggcggagcgggaggcgtcctttcccgcggccgcctttcagccgagagagtgacagattggaggtcagcggctggcgggac

SEQ ID NO: 13885 - DNA, 50 bp, Homo sapiens
  chr20:55500671-55500721
  hyper
gaagccctcgccgggcagatggacccgctccgggccgcgccggggacccc

SEQ ID NO: 13886 - DNA, 39 bp, Homo sapiens
  chr20:55501052-55501091
  hyper
cgtaggagcttgccggtctccgaccgctgctggcctgcg

SEQ ID NO: 13887 - DNA, 754 bp, Homo sapiens; identical to SEQ ID NO: 4839
  chr20:56803371-56804125
  hyper

SEQ ID NO: 13888 - DNA, 264 bp, Homo sapiens; identical to SEQ ID NO: 1489
  chr20:57224816-57225080
  hyper

SEQ ID NO: 13889 - DNA, 177 bp, Homo sapiens; identical to SEQ ID NO: 1490
  chr20:57225218-57225395
  hyper

SEQ ID NO: 13890 - DNA, 109 bp, Homo sapiens
  chr20:57875719-57875828
  hyper
ggccggagctggagacgcagcgagcgatcggccggcctcgaacccccacagctggagggcgaggccagctgtacccggccccagtgccctttcgcggccacaagcggcc

SEQ ID NO: 13891 - DNA, 60 bp, Homo sapiens
  chr20:58179203-58179263
  hyper
gaggaagcctcaggtcgctcccctccggtgccggggtgggcgcgtcgggacccactggcc

SEQ ID NO: 13892 - DNA, 190 bp, Homo sapiens
  chr20:58180213-58180403
  hyper
cgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccggg

SEQ ID NO: 13893 - DNA, 106 bp, Homo sapiens
  chr20:58180470-58180576
  hyper
cgggtgctgaccggctgggggaagagaggcagacccgtggccgcctccgcccagcgccggttctgggccattccctccctccccactgccgggccccagctccgga

SEQ ID NO: 13894 - DNA, 30 bp, Homo sapiens
  chr20:58508817-58508847
  hyper
catcccccccacccccgccaacgctcgccg

SEQ ID NO: 13895 - DNA, 16 bp, Homo sapiens
  chr20:59826962-59826978
  hyper
agtgcacactcccacc

SEQ ID NO: 13896 - DNA, 68 bp, Homo sapiens; identical to SEQ ID NO: 4843
  chr20:59828340-59828408
  hyper

SEQ ID NO: 13897 - DNA, 147 bp, Homo sapiens
  chr20:59829066-59829213
  hyper
tcccagaagcttggtcggagggccctgtcgtccaccccatccttccctggccctgtgccatgggctctagacttccccactgagcaggaaaggcgagcgagctccggaggacaggaggagaccccctttccggtcagttaggggagc

SEQ ID NO: 13898 - DNA, 396 bp, Homo sapiens
  chr20:61339658-61340054
  hyper
cccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagac

SEQ ID NO: 13899 - DNA, 374 bp, Homo sapiens; identical to SEQ ID NO: 4844
  chr20:61340304-61340678
  hyper

SEQ ID NO: 13900 - DNA, 79 bp, Homo sapiens
  chr20:61447684-61447763
  hyper
acggttccttcaggccggggatcccggggaggggttcttcccctcggccagggtcatcgttttgcgatctctcctggga

SEQ ID NO: 13901 - DNA, 22 bp, Homo sapiens
  chr20:61560439-61560461
  hyper
tacttcgtttaaagccggattt

SEQ ID NO: 13902 - DNA, 226 bp, Homo sapiens; identical to SEQ ID NO: 4845
  chr20:61560696-61560922
  hyper

SEQ ID NO: 13903 - DNA, 332 bp, Homo sapiens
  chr20:61585342-61585674
  hyper
gggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgag

SEQ ID NO: 13904 - DNA, 368 bp, Homo sapiens
  chr20:61637281-61637649
  hyper
cgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcag

SEQ ID NO: 13905 - DNA, 29 bp, Homo sapiens
  chr20:61637928-61637957
  hyper
ggggaggtcgccgcccgggcccggagtgc

SEQ ID NO: 13906 - DNA, 250 bp, Homo sapiens; identical to SEQ ID NO: 1492
  chr20:61638220-61638470
  hyper

SEQ ID NO: 13907 - DNA, 118 bp, Homo sapiens; identical to SEQ ID NO: 1493
  chr20:61638534-61638652
  hyper

SEQ ID NO: 13908 - DNA, 53 bp, Homo sapiens; identical to SEQ ID NO: 1494
  chr20:61703709-61703762
  hyper

SEQ ID NO: 13909 - DNA, 190 bp, Homo sapiens; identical to SEQ ID NO: 1495
  chr20:61703845-61704035
  hyper

SEQ ID NO: 13910 - DNA, 180 bp, Homo sapiens
  chr20:61733260-61733440
  hyper
cctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgtt

SEQ ID NO: 13911 - DNA, 346 bp, Homo sapiens
  chr20:61733715-61734061
  hyper
gctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcc

SEQ ID NO: 13912 - DNA, 89 bp, Homo sapiens
  chr20:61747845-61747934
  hyper
agctgcagggagctgcgcggggggagccgcagagctgggcacttgcgaattaagtcccggtgaccggtgactgccgaggctctggcagg

SEQ ID NO: 13913 - DNA, 357 bp, Homo sapiens
  chr20:61806443-61806800
  hyper
ccacctgacccgtagcgaagttgccggccccgctgcgcgccggcctttgtgcgcaccgaggcggccgccgggaaccgggagcccgagctggcccggcagcgccgccgcccccaccttcgcgccccttttcactcccccactgtccccggagctggcaaataaacaaatccacaaacaaattatccgtgtgctccggagaggcggcggcgtgggcggcggcggagagaaggcgccgggcaaggcgagactaggcccccgcggagcgggggaagcacagaccccagcccgggcccggcagcagtaagttgacttttatgaaacctacgaagctcgcggggccaccgaaaaggtccccac

SEQ ID NO: 13914 - DNA, 133 bp, Homo sapiens
  chr20:61807785-61807918
  hyper
aagggcgaggaattgcggctgggaagggtcaggttgaagccgcaccaaagggggaggggcgtcctgatggttgaggaccggcggagtcggtgcgggcagaaccaacccgagttcctgccgcccttcctaaccg

SEQ ID NO: 13915 - DNA, 200 bp, Homo sapiens; identical to SEQ ID NO: 1496
  chr20:61808181-61808381
  hyper

SEQ ID NO: 13916 - DNA, 222 bp, Homo sapiens; identical to SEQ ID NO: 1497
  chr20:61808666-61808888
  hyper

SEQ ID NO: 13917 - DNA, 117 bp, Homo sapiens; identical to SEQ ID NO: 1498
  chr20:61808889-61809006
  hyper

SEQ ID NO: 13918 - DNA, 339 bp, Homo sapiens; identical to SEQ ID NO: 1499
  chr20:61809218-61809557
  hyper

SEQ ID NO: 13919 - DNA, 74 bp, Homo sapiens; identical to SEQ ID NO: 1500
  chr20:61809558-61809632
  hyper

SEQ ID NO: 13920 - DNA, 295 bp, Homo sapiens; identical to SEQ ID NO: 1501
  chr20:61809840-61810135
  hyper

SEQ ID NO: 13921 - DNA, 79 bp, Homo sapiens
  chr20:61862380-61862459
  hyper
cccctgatggcctctcgacgtccagccgcttgtgtgttctgccaatgggctcctctccgtgtccagggcttaggtgcct

SEQ ID NO: 13922 - DNA, 265 bp, Homo sapiens; identical to SEQ ID NO: 4857
  chr20:61884691-61884956
  hyper

SEQ ID NO: 13923 - DNA, 113 bp, Homo sapiens
  chr20:61886030-61886143
  hyper
ccgttcttaaaggggcgatggcgcggcctctcgggtagcgaggggcggcgccgcggccccaggacagacctgcagctgaggggagcccgccctggacgcggcagggatgaccg

SEQ ID NO: 13924 - DNA, 49 bp, Homo sapiens
  chr20:62103577-62103626
  hyper
aaattctgcagcttgcggtagaaggcgttgcgcttggggggcttcccgg

SEQ ID NO: 13925 - DNA, 91 bp, Homo sapiens
  chr20:62103667-62103758
  hyper
cgcttgggggcctcggagccggcgatcagcagcgccccgtcccgggtggagtcgggcgcgccggggtccagccccacgaagcccaccttca

SEQ ID NO: 13926 - DNA, 88 bp, Homo sapiens
  chr20:62119922-62120010
  hyper
ggcctcgcgggagtcctgcctgggcggctgctccacggtctgcggggcggccacggggcgggggcagccctaacgctgccactgggcg

SEQ ID NO: 13927 - DNA, 276 bp, Homo sapiens
  chr20:62461349-62461625
  hyper
tcacaatcttgccaccgtaatccactccaaatgcatcgttgagattgcagcacggaaagcgagagaggaaattcgctgcgaatctcaaactttcttttgtttatatttcttcgctgtcagaaaatatccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattcccc

SEQ ID NO: 13928 - DNA, 101 bp, Homo sapiens
  chr20:62947884-62947985
  hyper
ctcgggccgggaacgcgggaggaggcggcgccctgcgccgggaggccccagacaccgtgggcgggcggctgtgcgcggccaggctgcgtgggagcgggcag

SEQ ID NO: 13929 - DNA, 157 bp, Homo sapiens
  chr20:62948007-62948164
  hyper
cgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcct

SEQ ID NO: 13930 - DNA, 215 bp, Homo sapiens
  chr21:15588524-15588739
  hyper
ggaggccgacaggaccgtgtttgttgggaatttagaggcccgagttcgggaagagattctgtacgagctgttccttcaggtaccgtctctgggaaggggcggcggaggggcggagcacgtcgggccggaaacatagcgcgcacctggaccacccggagcccggcccccttccgtcccatcctgagcaggggttttaatttcgtttcctcttggcg

SEQ ID NO: 13931 - DNA, 36 bp, Homo sapiens
  chr21:22370664-22370700
  hyper
ttctgccgccgctgccgccgccgctgcctggatata

SEQ ID NO: 13932 - DNA, 154 bp, Homo sapiens
  chr21:26934572-26934726
  hyper
cgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcg

SEQ ID NO: 13933 - DNA, 362 bp, Homo sapiens; identical to SEQ ID NO: 4858
  chr21:27012346-27012708
  hyper

SEQ ID NO: 13934 - DNA, 235 bp, Homo sapiens
  chr21:27944913-27945148
  hyper
caaatcccctaaacacgagactgctatttccaaggtggaaagggaaagaaaagaaatgcaaaaggtaaaagttaaaggaaaaggaacaaaacaaaaccgcgtgcggctggaagtgcgcgggtttctgccgtcgcctcgcggaaaaggcagaagcgtctgcaaaggtccttctgcaaaggtcccggtccgtccagctcaacccacgttagcccggaccgtgacccaagggcagccc

SEQ ID NO: 13935 - DNA, 64 bp, Homo sapiens
  chr21:28216633-28216697
  hyper
cggtctccgctttcccagtcggccggggctcgtcgtccacgaccccgcacgtgccgccgacgtc

SEQ ID NO: 13936 - DNA, 82 bp, Homo sapiens
  chr21:28216984-28217066
  hyper
ccaaaaagctgctgtcgggccgcagctccagatccagctgctggtcaaaggcgtgcaggcggaggcgcgtggtcccgtgtcc

SEQ ID NO: 13937 - DNA, 70 bp, Homo sapiens
  chr21:28217614-28217684
  hyper
cctccgccttggctgcgatgttgctcactctgctcagggctctcccctctccgtccggtagcgcaccctg

SEQ ID NO: 13938 - DNA, 81 bp, Homo sapiens
  chr21:28218267-28218348
  hyper
caggagctccttagccgccgcctgctctctcttcgccccagcttttctagggaaagcttggccctgcgcttcccccagaaa

SEQ ID NO: 13939 - DNA, 30 bp, Homo sapiens
  chr21:28218688-28218718
  hyper
gctggggctagcaagcgtgcagagggggaa

SEQ ID NO: 13940 - DNA, 30 bp, Homo sapiens
  chr21:28339426-28339456
  hyper
acaatgaatttatagcggcatgccatcctg

SEQ ID NO: 13941 - DNA, 15 bp, Homo sapiens
  chr21:28340034-28340049
  hyper
ctcttgatgctttga

SEQ ID NO: 13942 - DNA, 286 bp, Homo sapiens; identical to SEQ ID NO: 4860
  chr21:28340062-28340348
  hyper

SEQ ID NO: 13943 - DNA, 221 bp, Homo sapiens; identical to SEQ ID NO: 4861
  chr21:31311413-31311634
  hyper

SEQ ID NO: 13944 - DNA, 102 bp, Homo sapiens; identical to SEQ ID NO: 4862
  chr21:31312079-31312181
  hyper

SEQ ID NO: 13945 - DNA, 207 bp, Homo sapiens
  chr21:32716260-32716467
  hyper
ggcgcagcttggagacgcgcttgctcgttctgggaaggggcacgggacgcacggttccccggccccagctgcacagctcagctcggggctctcacctatcctcgttcagagccacattcggctgcctcccctgaccacccgacacaaagagattcgccggtggaaagaatcgatttcaaaattcaagctcaccgctgctcaacaagg

SEQ ID NO: 13946 - DNA, 638 bp, Homo sapiens; identical to SEQ ID NO: 1502
  chr21:34392436-34393074
  hyper

SEQ ID NO: 13947 - DNA, 337 bp, Homo sapiens; identical to SEQ ID NO: 4864
  chr21:34395421-34395758
  hyper

SEQ ID NO: 13948 - DNA, 696 bp, Homo sapiens; identical to SEQ ID NO: 1503
  chr21:34396045-34396741
  hyper

SEQ ID NO: 13949 - DNA, 33 bp, Homo sapiens
  chr21:34397670-34397703
  hyper
tgagatgggaacaggcggcgggaaaccagacag

SEQ ID NO: 13950 - DNA, 141 bp, Homo sapiens
  chr21:34397990-34398131
  hyper
tccccaagaatctcccggccacgggcgcccattggttgtgcgcagggaggaggcgtgtgcccggcctggcgagtttcattgagcggaattagcccggatgacatcagcttcccagccccccggcgggcccagctcattggc

SEQ ID NO: 13951 - DNA, 67 bp, Homo sapiens
  chr21:34398132-34398199
  hyper
aggcagcccctccaggacacgcacattgttccccgcccccgcccccgccaccgctgccgccgtcgcc

SEQ ID NO: 13952 - DNA, 22 bp, Homo sapiens
  chr21:34398200-34398222
  hyper
ctgccaccgggctataaaaacc

SEQ ID NO: 13953 - DNA, 237 bp, Homo sapiens
  chr21:34398223-34398460
  hyper
gccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctcca

SEQ ID NO: 13954 - DNA, 93 bp, Homo sapiens; identical to SEQ ID NO: 1504
  chr21:34399166-34399259
  hyper

SEQ ID NO: 13955 - DNA, 664 bp, Homo sapiens; identical to SEQ ID NO: 1505
  chr21:34399441-34400105
  hyper

SEQ ID NO: 13956 - DNA, 27 bp, Homo sapiens
  chr21:34400231-34400258
  hyper
cgcgaggaggggcgcaggaccatggac

SEQ ID NO: 13957 - DNA, 225 bp, Homo sapiens; identical to SEQ ID NO: 4869
  chr21:34401167-34401392
  hyper

SEQ ID NO: 13958 - DNA, 58 bp, Homo sapiens
  chr21:34442191-34442249
  hyper
ctccttcaacagccccgcttgccttgaaaaggcgcccttactccgctcagggggcctg

SEQ ID NO: 13959 - DNA, 998 bp, Homo sapiens
  chr21:34442594-34443592
  hyper
gggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttgggg

SEQ ID NO: 13960 - DNA, 382 bp, Homo sapiens; identical to SEQ ID NO: 1507
  chr21:34443981-34444363
  hyper

SEQ ID NO: 13961 - DNA, 154 bp, Homo sapiens; identical to SEQ ID NO: 1508
  chr21:34444444-34444598
  hyper

SEQ ID NO: 13962 - DNA, 96 bp, Homo sapiens; identical to SEQ ID NO: 1509
  chr21:36041933-36042029
  hyper

SEQ ID NO: 13963 - DNA, 79 bp, Homo sapiens; identical to SEQ ID NO: 1510
  chr21:36042091-36042170
  hyper

SEQ ID NO: 13964 - DNA, 144 bp, Homo sapiens; identical to SEQ ID NO: 1511
  chr21:36042171-36042315
  hyper

SEQ ID NO: 13965 - DNA, 522 bp, Homo sapiens; identical to SEQ ID NO: 4875
  chr21:36042632-36043154
  hyper

SEQ ID NO: 13966 - DNA, 519 bp, Homo sapiens; identical to SEQ ID NO: 4876
  chr21:38065004-38065523
  hyper

SEQ ID NO: 13967 - DNA, 262 bp, Homo sapiens; identical to SEQ ID NO: 4877
  chr21:38065799-38066061
  hyper

SEQ ID NO: 13968 - DNA, 30 bp, Homo sapiens
  chr21:38066830-38066860
  hyper
gaggtcgtcgctggacgctgggctcccttg

SEQ ID NO: 13969 - DNA, 375 bp, Homo sapiens
  chr21:38069173-38069548
  hyper
cagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggcc

SEQ ID NO: 13970 - DNA, 27 bp, Homo sapiens
  chr21:38069853-38069880
  hyper
cgatgtggactccgcaaggggctaggg

SEQ ID NO: 13971 - DNA, 134 bp, Homo sapiens
  chr21:38070581-38070715
  hyper
cacctgcgccacctgcgcccaccctgtgaccctggctcagcgaccttggcccttaatcgcccaacgccgattcctcaaaattccggctgcgctgaatcgggctgcttttgccgccgccccggcagttgggccct

SEQ ID NO: 13972 - DNA, 71 bp, Homo sapiens
  chr21:38072282-38072353
  hyper
aagcgcaagccagcccgcccagaggggttgccgcggcctggcgtccagagctggggcgtctgagggaggtt

SEQ ID NO: 13973 - DNA, 243 bp, Homo sapiens
  chr21:38072927-38073170
  hyper
agtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccagggg

SEQ ID NO: 13974 - DNA, 112 bp, Homo sapiens
  chr21:38073239-38073351
  hyper
cgcccacgccggttgccgctggtgacagtggctgcccggccaggcacctccgagcagcaggtctgagcgtttttggcgtcccaagcgttccgggccgcgtcttccagagcct

SEQ ID NO: 13975 - DNA, 35 bp, Homo sapiens
  chr21:38076386-38076421
  hyper
tgtcatttgcccacacgaaacgaggtggggttcaa

SEQ ID NO: 13976 - DNA, 131 bp, Homo sapiens; identical to SEQ ID NO: 4878
  chr21:38079932-38080063
  hyper

SEQ ID NO: 13977 - DNA, 213 bp, Homo sapiens; identical to SEQ ID NO: 4879
  chr21:38080174-38080387
  hyper

SEQ ID NO: 13978 - DNA, 134 bp, Homo sapiens; identical to SEQ ID NO: 4880
  chr21:38080550-38080684
  hyper

SEQ ID NO: 13979 - DNA, 181 bp, Homo sapiens
  chr21:38081665-38081846
  hyper
gggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctt

SEQ ID NO: 13980 - DNA, 45 bp, Homo sapiens
  chr21:38082684-38082729
  hyper
cgggtcggccgggtagccctgagcacagctcgccacttccaggtg

SEQ ID NO: 13981 - DNA, 39 bp, Homo sapiens
  chr21:38082930-38082969
  hyper
catgacttaggtcagcgagtcagccgctagctctgcatt

SEQ ID NO: 13982 - DNA, 581 bp, Homo sapiens
  chr21:38119754-38120335
  hyper
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcc

SEQ ID NO: 13983 - DNA, 30 bp, Homo sapiens
  chr21:38593435-38593465
  hyper
cgcgcgaggcccgggcgcccgagcggcgat

SEQ ID NO: 13984 - DNA, 160 bp, Homo sapiens; identical to SEQ ID NO: 4881
  chr21:39286695-39286855
  hyper

SEQ ID NO: 13985 - DNA, 37 bp, Homo sapiens
  chr21:39288011-39288048
  hyper
aaccggcttctccctcgcctttcggctgacttgggca

SEQ ID NO: 13986 - DNA, 30 bp, Homo sapiens
  chr21:39288362-39288392
  hyper
agactccattctgctcgcggctgctccggc

SEQ ID NO: 13987 - DNA, 32 bp, Homo sapiens
  chr21:40032174-40032206
  hyper
cccagatgaagtccccgcggtgtgctctcctg

SEQ ID NO: 13988 - DNA, 73 bp, Homo sapiens
  chr21:40033138-40033211
  hyper
ctcctaactcggggtcgcttttagcgagaagtgatatttttccagcctcattgaaaaccgttgcaaacattga

SEQ ID NO: 13989 - DNA, 241 bp, Homo sapiens
  chr21:42688845-42689086
  hyper
gggcgagggtaggggcggggaaggaggaccccaggggaagcgtcgctccccaaccctgcctgggacccgccacgcttagcaaaagcgggagggctggttcttggcgccgaggctggtcttagacctgggatcaggaatgcgggaagcgattccagagggggcgaacagcgggggtttccagcagggttccccgaccctgtttccccgcgctcgccaggcctgttcccgccgccccagccgg

SEQ ID NO: 13990 - DNA, 56 bp, Homo sapiens
  chr21:42878736-42878792
  hyper
taattttccatgattcgggaggttctcgcggctgggagctccgtgaggtcaggcat

SEQ ID NO: 13991 - DNA, 38 bp, Homo sapiens; identical to SEQ ID NO: 1512
  chr21:44494740-44494778
  hyper

SEQ ID NO: 13992 - DNA, 57 bp, Homo sapiens; identical to SEQ ID NO: 1513
  chr21:44494940-44494997
  hyper

SEQ ID NO: 13993 - DNA, 122 bp, Homo sapiens; identical to SEQ ID NO: 1514
  chr21:44494998-44495120
  hyper

SEQ ID NO: 13994 - DNA, 282 bp, Homo sapiens
  chr21:44495327-44495609
  hyper
cctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacg

SEQ ID NO: 13995 - DNA, 218 bp, Homo sapiens
  chr21:44496505-44496723
  hyper
gcgggactcgatggccgcgctctgtggccgccggacgccgtgcgcagcgccccgcgtgaccgcgcccagagccgggtccgaaccccgagccgaggcgcagaacagtcgccttgcgcggctccggtgcggcccacggccaggggctgccgggcgctctcggggacggggccgactccgcgcagggtggtagcaggggcgccccgcggggctccttcgcc

SEQ ID NO: 13996 - DNA, 63 bp, Homo sapiens
  chr21:44847543-44847606
  hyper
cgcgcgtggggctggcggcgcggatgccctggggcgctgcagaccccgagaggccgcttgccc

SEQ ID NO: 13997 - DNA, 167 bp, Homo sapiens
  chr21:44847607-44847774
  hyper
cggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgc

SEQ ID NO: 13998 - DNA, 305 bp, Homo sapiens
  chr21:45148390-45148695
  hyper
ttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcg

SEQ ID NO: 13999 - DNA, 64 bp, Homo sapiens
  chr21:45148943-45149007
  hyper
caccccgcacccgcccgcccgcaatcctgccccctggctgcggcctccgcggctcttcccaccc

SEQ ID NO: 14000 - DNA, 51 bp, Homo sapiens
  chr21:45875681-45875732
  hyper
cgagcctctcccggccggctccgcgcgcggccccgccgtccacgcccagcg

SEQ ID NO: 14001 - DNA, 48 bp, Homo sapiens; identical to SEQ ID NO: 4885
  chr21:46126380-46126428
  hyper

SEQ ID NO: 14002 - DNA, 132 bp, Homo sapiens; identical to SEQ ID NO: 4886
  chr21:46126566-46126698
  hyper

SEQ ID NO: 14003 - DNA, 211 bp, Homo sapiens
  chr21:46127234-46127445
  hyper
gagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatag

SEQ ID NO: 14004 - DNA, 30 bp, Homo sapiens
  chr21:46128279-46128309
  hyper
cggacttggagacctcgccaaggaccagga

SEQ ID NO: 14005 - DNA, 107 bp, Homo sapiens; identical to SEQ ID NO: 4887
  chr21:46128961-46129068
  hyper

SEQ ID NO: 14006 - DNA, 37 bp, Homo sapiens
  chr21:46129376-46129413
  hyper
atgagtcctagaaagcgagagacgagaggggaatgag

SEQ ID NO: 14007 - DNA, 40 bp, Homo sapiens
  chr21:46352791-46352831
  hyper
gggttcggtgcgggacggcccaggccgccaggacccccaa

SEQ ID NO: 14008 - DNA, 85 bp, Homo sapiens
  chr21:46825637-46825722
  hyper
cggggaccgaacctccgcggccggcggggtcgtcggtgccgggagggctcggggcggggccgcggggtctcgggagacgcggcct

SEQ ID NO: 14009 - DNA, 73 bp, Homo sapiens; identical to SEQ ID NO: 1515
  chr21:47010408-47010481
  hyper

SEQ ID NO: 14010 - DNA, 73 bp, Homo sapiens; identical to SEQ ID NO: 4889
  chr21:47062752-47062825
  hyper

SEQ ID NO: 14011 - DNA, 839 bp, Homo sapiens; identical to SEQ ID NO: 4890
  chr21:47063538-47064377
  hyper

SEQ ID NO: 14012 - DNA, 250 bp, Homo sapiens
  chr21:47518063-47518313
  hyper
ggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcg

SEQ ID NO: 14013 - DNA, 38 bp, Homo sapiens
  chr21:47518776-47518814
  hyper
cccgccctgggactccgccggggcgctggtggaaccgc

SEQ ID NO: 14014 - DNA, 163 bp, Homo sapiens
  chr21:48087336-48087499
  hyper
cgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctg

SEQ ID NO: 14015 - DNA, 4 bp, Homo sapiens
  chr22:17081932-17081936
  hyper
tccc

SEQ ID NO: 14016 - DNA, 15 bp, Homo sapiens
  chr22:17082988-17083003
  hyper
cgcagccaccacccc

SEQ ID NO: 14017 - DNA, 30 bp, Homo sapiens
  chr22:17084014-17084044
  hyper
tgtaaattaagacaccgttttagtgccagc

SEQ ID NO: 14018 - DNA, 167 bp, Homo sapiens; identical to SEQ ID NO: 4891
  chr22:17600967-17601134
  hyper

SEQ ID NO: 14019 - DNA, 143 bp, Homo sapiens; identical to SEQ ID NO: 4892
  chr22:17601259-17601402
  hyper

SEQ ID NO: 14020 - DNA, 206 bp, Homo sapiens
  chr22:17849555-17849761
  hyper
tctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctcc

SEQ ID NO: 14021 - DNA, 303 bp, Homo sapiens; identical to SEQ ID NO: 4893
  chr22:17850318-17850621
  hyper

SEQ ID NO: 14022 - DNA, 53 bp, Homo sapiens; identical to SEQ ID NO: 4894
  chr22:17850978-17851031
  hyper

SEQ ID NO: 14023 - DNA, 190 bp, Homo sapiens
  chr22:19016914-19017104
  hyper
ttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcg

SEQ ID NO: 14024 - DNA, 260 bp, Homo sapiens
  chr22:19017319-19017579
  hyper
cgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcgga

SEQ ID NO: 14025 - DNA, 15 bp, Homo sapiens
  chr22:19510932-19510947
  hyper
ggagaaggtcagctg

SEQ ID NO: 14026 - DNA, 315 bp, Homo sapiens; identical to SEQ ID NO: 1517
  chr22:19511141-19511456
  hyper

SEQ ID NO: 14027 - DNA, 335 bp, Homo sapiens; identical to SEQ ID NO: 1518
  chr22:19511541-19511876
  hyper

SEQ ID NO: 14028 - DNA, 67 bp, Homo sapiens; identical to SEQ ID NO: 1519
  chr22:19512252-19512319
  hyper

SEQ ID NO: 14029 - DNA, 15 bp, Homo sapiens
  chr22:19512376-19512391
  hyper
cgtagaggccctcgt

SEQ ID NO: 14030 - DNA, 127 bp, Homo sapiens; identical to SEQ ID NO: 4900
  chr22:19706238-19706365
  hyper

SEQ ID NO: 14031 - DNA, 204 bp, Homo sapiens; identical to SEQ ID NO: 4901
  chr22:19706366-19706570
  hyper

SEQ ID NO: 14032 - DNA, 145 bp, Homo sapiens
  chr22:19742613-19742758
  hyper
ttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcc

SEQ ID NO: 14033 - DNA, 181 bp, Homo sapiens
  chr22:19742788-19742969
  hyper
cgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggcca

SEQ ID NO: 14034 - DNA, 156 bp, Homo sapiens
  chr22:19748644-19748800
  hyper
cgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccgg

SEQ ID NO: 14035 - DNA, 109 bp, Homo sapiens
  chr22:20791235-20791344
  hyper
tccccacctggttgtcgccagggttcccacatcctccggtcccctgtgcctgtcatagtccttccgcctcccgcttctggtccacttcgagcgccggctcctcgacgct

SEQ ID NO: 14036 - DNA, 30 bp, Homo sapiens
  chr22:20791681-20791711
  hyper
cctgggatgcactgtcgtggcccatggccg

SEQ ID NO: 14037 - DNA, 30 bp, Homo sapiens
  chr22:21319768-21319798
  hyper
gcgggggcaacgggacggagccggcgaggc

SEQ ID NO: 14038 - DNA, 166 bp, Homo sapiens; identical to SEQ ID NO: 4902
  chr22:22862697-22862863
  hyper

SEQ ID NO: 14039 - DNA, 88 bp, Homo sapiens; identical to SEQ ID NO: 4903
  chr22:22863219-22863307
  hyper

SEQ ID NO: 14040 - DNA, 30 bp, Homo sapiens
  chr22:23908209-23908239
  hyper
actcacttctcaggacgcctgtcctgctgt

SEQ ID NO: 14041 - DNA, 30 bp, Homo sapiens
  chr22:23908658-23908688
  hyper
ccgagcgtgcccggccgggtctgcagccgt

SEQ ID NO: 14042 - DNA, 454 bp, Homo sapiens
  chr22:24180540-24180994
  hyper
tcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 14043 - DNA, 390 bp, Homo sapiens
  chr22:24181054-24181444
  hyper
cgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtgg

SEQ ID NO: 14044 - DNA, 258 bp, Homo sapiens; identical to SEQ ID NO: 4904
  chr22:25678357-25678615
  hyper

SEQ ID NO: 14045 - DNA, 253 bp, Homo sapiens; identical to SEQ ID NO: 4905
  chr22:25678616-25678869
  hyper

SEQ ID NO: 14046 - DNA, 208 bp, Homo sapiens; identical to SEQ ID NO: 4906
  chr22:25679042-25679250
  hyper

SEQ ID NO: 14047 - DNA, 198 bp, Homo sapiens; identical to SEQ ID NO: 4907
  chr22:25679267-25679465
  hyper

SEQ ID NO: 14048 - DNA, 738 bp, Homo sapiens
  chr22:25816913-25817651
  hyper
gccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggcgcggcgggcggcggccgcgggcgcgcgtcccatccgggtcccgagtaaccgccaccgccgctgccaaagctcgccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtctctgaaatggggcatcggagggcgggtggggggcactccgggagagagcgctccaaagtgcctggcgccgcgccctgcgcgcagctagcaccccagcaaggggctggttatgacttggctggaccagttccatccctgtcgccccctcccccagccctgtcctctcctgtcccatccccgtggttctacctgt

SEQ ID NO: 14049 - DNA, 30 bp, Homo sapiens
  chr22:26564863-26564893
  hyper
ctcgtgttagatgcacgattttgtggctat

SEQ ID NO: 14050 - DNA, 177 bp, Homo sapiens
  chr22:26565184-26565361
  hyper
agcagggagagaaaacgctcggctcccaggacgcaaggggaattggcgttaaactttgcagggccgacgggccggcggccagaggaggcggctggcacccccggcgccgccgcggcccctccagctcactgcccgctcgcccgccccctccctccctgcactcgctcggcacagact

SEQ ID NO: 14051 - DNA, 131 bp, Homo sapiens
  chr22:26565502-26565633
  hyper
ggaagctgccccggcccgcggcctcctccctcgctcccgcttcccctttctcgctcaccgccgccctccttccccagctccctcgccgtccgcccgccccacagccagcggctccgcgccccctgcagcca

SEQ ID NO: 14052 - DNA, 36 bp, Homo sapiens
  chr22:26565935-26565971
  hyper
ggcgcttccctgcttcggctgcgggctccctttcgg

SEQ ID NO: 14053 - DNA, 129 bp, Homo sapiens
  chr22:27053864-27053993
  hyper
tttaggagtccagtgcgaatggggatcttgcaatcatgattatgagggggaacaaagaccctttccttccgacgacacaagacacaatttgggaggtggacccgcggaccttctcggtccaccaggtta

SEQ ID NO: 14054 - DNA, 33 bp, Homo sapiens
  chr22:28197337-28197370
  hyper
cttcgcggccacgtccgccgcctgccgcttctg

SEQ ID NO: 14055 - DNA, 91 bp, Homo sapiens
  chr22:28198065-28198156
  hyper
tggagcgagacccaccgggtgggcagggggcggggaggtgggcggtgagcggtacggggcgctcagacaatgaggtcgccaggcaaagacc

SEQ ID NO: 14056 - DNA, 30 bp, Homo sapiens
  chr22:28198371-28198401
  hyper
actgcctggggttcccggttctcaccggcc

SEQ ID NO: 14057 - DNA, 239 bp, Homo sapiens
  chr22:28838200-28838439
  hyper
acacacgctggtgcacgctgacacgcacagacacacgcccgtgcacaatggccagcgcaggcaatcgcacgggcccacgaggcctcaggagccccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggct

SEQ ID NO: 14058 - DNA, 40 bp, Homo sapiens
  chr22:29075517-29075557
  hyper
caggcgctcctctgccgctgaggcccggcccggctcccac

SEQ ID NO: 14059 - DNA, 53 bp, Homo sapiens
  chr22:29076122-29076175
  hyper
caagaggaacttccccgcaagaagtgtcgagttaaggacgctactaagggggc

SEQ ID NO: 14060 - DNA, 42 bp, Homo sapiens
  chr22:29426589-29426631
  hyper
cccggtggggaggggcgcggccggtggcgaggagggcacttt

SEQ ID NO: 14061 - DNA, 30 bp, Homo sapiens
  chr22:29876013-29876043
  hyper
cctctgacgcagcgtcgattccccttccct

SEQ ID NO: 14062 - DNA, 303 bp, Homo sapiens
  chr22:29876952-29877255
  hyper
ccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccggactgcgcgtggagtggcgcgctgctcaccttcc

SEQ ID NO: 14063 - DNA, 114 bp, Homo sapiens
  chr22:30116044-30116158
  hyper
cggtagcggccgcgccggcgagcggactagcgggcggcgagcagcgcggagcgcgcggggcaccgaggagcgggcgcggcgggcaccgcgcgaggcagccggagctctcggaaa

SEQ ID NO: 14064 - DNA, 36 bp, Homo sapiens
  chr22:30116411-30116447
  hyper
agatgccgttccacccggtgacggcggcgttgatgt

SEQ ID NO: 14065 - DNA, 78 bp, Homo sapiens
  chr22:30116757-30116835
  hyper
gctgcggaaacttgccgggccccgcagcggggtcacggggccgcgcagtcggcggtgacggtgcggcaacgcggcgga

SEQ ID NO: 14066 - DNA, 174 bp, Homo sapiens
  chr22:30938095-30938269
  hyper
ccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggag

SEQ ID NO: 14067 - DNA, 39 bp, Homo sapiens
  chr22:30938602-30938641
  hyper
ctgcctgctgctccccgcgtcctgcgcctggtcaggagt

SEQ ID NO: 14068 - DNA, 373 bp, Homo sapiens
  chr22:31218396-31218769
  hyper
cgctcaggctgggctcggctcccgcggcgcggacggggttaacgcgctcatgtaccgggtggcgggcggcagtggtgcattgtggtaacgcggcgccgggacccacgagtgtccgccgcctccgccgggcggcccaccgagctgtgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttg

SEQ ID NO: 14069 - DNA, 624 bp, Homo sapiens
  chr22:31480781-31481405
  hyper
gggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgcctcggtcccgagttcgagttcgacctccgccactcagctgggtgtcctggggaccttggtttcttccctttagatccggacactgaagcaggcggtagcgggtgtcttcctacctggctaccccttcggcgcctagcgcgaggcagggtgggcgaggcgagggcggcgccctgcgagggagggcggtcgcagaacctgcgggccttcagcgccccctggcgaggcttccctccaccgccggcgggacccccatgggcaaccgggggagctgggac

SEQ ID NO: 14070 - DNA, 30 bp, Homo sapiens
  chr22:32572248-32572278
  hyper
ggcatctgcagcctccgctctcctgttctg

SEQ ID NO: 14071 - DNA, 37 bp, Homo sapiens
  chr22:33197694-33197731
  hyper
cgggcagcaggcaggcggcgggcgctcagacggcttc

SEQ ID NO: 14072 - DNA, 198 bp, Homo sapiens; identical to SEQ ID NO: 1521
  chr22:33453877-33454075
  hyper

SEQ ID NO: 14073 - DNA, 66 bp, Homo sapiens; identical to SEQ ID NO: 1522
  chr22:33454193-33454259
  hyper

SEQ ID NO: 14074 - DNA, 90 bp, Homo sapiens; identical to SEQ ID NO: 1523
  chr22:33454345-33454435
  hyper

SEQ ID NO: 14075 - DNA, 30 bp, Homo sapiens
  chr22:35420285-35420315
  hyper
tggaaatgaatttagcgtcagcacagttat

SEQ ID NO: 14076 - DNA, 30 bp, Homo sapiens
  chr22:36553195-36553225
  hyper
atttctaaaaacacgcgagccagctaacct

SEQ ID NO: 14077 - DNA, 52 bp, Homo sapiens
  chr22:37730735-37730787
  hyper
catctggaaagggggcgcgggcggggatcggtaggaccgcctatgctcaggg

SEQ ID NO: 14078 - DNA, 69 bp, Homo sapiens
  chr22:37731155-37731224
  hyper
ggatagggtagtatacgatagggggcgtaaagaagggtcatgggctccggtggtcgcaggtcccaccgg

SEQ ID NO: 14079 - DNA, 324 bp, Homo sapiens; identical to SEQ ID NO: 4911
  chr22:38220648-38220972
  hyper

SEQ ID NO: 14080 - DNA, 60 bp, Homo sapiens
  chr22:38221288-38221348
  hyper
ccgtgcggccgccgacgccgccaccgtgcccgccgcgccttgcgtcgcgtccgccccgcg

SEQ ID NO: 14081 - DNA, 33 bp, Homo sapiens; identical to SEQ ID NO: 4912
  chr22:38477099-38477132
  hyper

SEQ ID NO: 14082 - DNA, 498 bp, Homo sapiens; identical to SEQ ID NO: 4913
  chr22:38477296-38477794
  hyper

SEQ ID NO: 14083 - DNA, 30 bp, Homo sapiens
  chr22:38478441-38478471
  hyper
ggggccctctgagctcgcagggcagccccc

SEQ ID NO: 14084 - DNA, 78 bp, Homo sapiens
  chr22:39853473-39853551
  hyper
acgccagcatctccccgccggggaccccgggggccgcggagccgccgccgccgctgctgccgccgttgctgagaccca

SEQ ID NO: 14085 - DNA, 30 bp, Homo sapiens
  chr22:39854232-39854262
  hyper
gtggggaggggagtgcgcctgggtgtgtgt

SEQ ID NO: 14086 - DNA, 30 bp, Homo sapiens
  chr22:39942115-39942145
  hyper
gggtgctgatgatgtcggaggagctccttg

SEQ ID NO: 14087 - DNA, 137 bp, Homo sapiens
  chr22:39954439-39954576
  hyper
gccagagctggtgcccgtgtccggcgggctgagctgggagcgctggcctgggagcgcggcagcgggggccactggatgggggaatcccgggcagggtttaactttcccggaggcgggggtggcggagaccccccctt

SEQ ID NO: 14088 - DNA, 109 bp, Homo sapiens
  chr22:40081839-40081948
  hyper
cagcctgaccctgagcgacagcccccggcgtgccctggggccgcccgcgcctgctccaggaccccgggccggcctgtcccccgccgctcgccgccgcctgagcctgcgc

SEQ ID NO: 14089 - DNA, 105 bp, Homo sapiens
  chr22:42307095-42307200
  hyper
cgcagaggccgcggctcatttccaccggggaagcctctatgccccagccgagggaccgcctctcggcctctcacgcccctccgcgtgctccgccgccgctcagcc

SEQ ID NO: 14090 - DNA, 409 bp, Homo sapiens; identical to SEQ ID NO: 4914
  chr22:42310042-42310451
  hyper

SEQ ID NO: 14091 - DNA, 123 bp, Homo sapiens
  chr22:42311386-42311509
  hyper
agcccggaattgccccgggacgggcagggccaccctctcacctccttcccgtcccctctgtccgttctgatcataacataaggagggccccttcccctctcggcgcctcgattttcccacctg

SEQ ID NO: 14092 - DNA, 369 bp, Homo sapiens; identical to SEQ ID NO: 4915
  chr22:42353611-42353980
  hyper

SEQ ID NO: 14093 - DNA, 75 bp, Homo sapiens
  chr22:42679405-42679480
  hyper
cggctggatctggaccggaggggacgggggcgggcactcggcccctgggactgtgacccggggccctgcccttca

SEQ ID NO: 14094 - DNA, 215 bp, Homo sapiens
  chr22:42679916-42680131
  hyper
cgaggcgggggaggaggggaaagggaaaaaaggagaaggaaaaggaaaggggggcagtttctcggctctcagcctcctcgcggctcctcctgcccaagccggcaagtgaagtcacagggccggggcggtgacatcagctgagcctctgacatcacggcccctgccgatctcacctctgcagggtggagatggaggagcagcggggaggagggatg

SEQ ID NO: 14095 - DNA, 68 bp, Homo sapiens
  chr22:42896621-42896689
  hyper
tgctacctaggcaggcgtgagggtgtgacggccgcgcattcgccagacgagagcgatggctgagaacg

SEQ ID NO: 14096 - DNA, 37 bp, Homo sapiens
  chr22:43739465-43739502
  hyper
ccggccaatgggcgccggcctccggccctccgaggaa

SEQ ID NO: 14097 - DNA, 50 bp, Homo sapiens
  chr22:43740084-43740134
  hyper
tcggccggcgaagttcgctgcccggaatgcgaggccgaggcctccccctg

SEQ ID NO: 14098 - DNA, 234 bp, Homo sapiens; identical to SEQ ID NO: 4916
  chr22:44258285-44258519
  hyper

SEQ ID NO: 14099 - DNA, 30 bp, Homo sapiens
  chr22:44263900-44263930
  hyper
gtccgcggtgctgaacgcacagcttcccct

SEQ ID NO: 14100 - DNA, 46 bp, Homo sapiens
  chr22:44287650-44287696
  hyper
cgcggggctcgctggcgcaggcattcggtggcgcccacgtggtggg

SEQ ID NO: 14101 - DNA, 139 bp, Homo sapiens
  chr22:44726839-44726978
  hyper
aggcccctctgggtccgcagcgtggccctcagtccccgtgcagcccgcacggggctcccagctcactgagctccccgactctgttcttggaagccagtcccccccttggacgcggattccggtcccggccgccgcgtcc

SEQ ID NO: 14102 - DNA, 93 bp, Homo sapiens
  chr22:44727446-44727539
  hyper
tgcgggggctgcccacgcccccgcgatgcccctgccgccgccgcaacagttgtccgggttctgggggctgcggggacgcggggactccgggct

SEQ ID NO: 14103 - DNA, 137 bp, Homo sapiens
  chr22:44727790-44727927
  hyper
atgctcgccgggccccgcgctcgccgccgccgccgccgccgccgccgctgcccacttcactctttggcgctcgctccgcgccgcgccctctgctgccccctcgcccgggctcgccgagctcccgccgccctgcccgc

SEQ ID NO: 14104 - DNA, 46 bp, Homo sapiens
  chr22:45016369-45016415
  hyper
tttccgacaaccacacggcgccggctgcacacgtcctgtttgcgtg

SEQ ID NO: 14105 - DNA, 60 bp, Homo sapiens
  chr22:45403086-45403146
  hyper
tcctttcagcaagcccggccccccccaaaacccgccactcgcgcacgccccctcccatca

SEQ ID NO: 14106 - DNA, 403 bp, Homo sapiens
  chr22:45404239-45404642
  hyper
ccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcg

SEQ ID NO: 14107 - DNA, 224 bp, Homo sapiens
  chr22:45405046-45405270
  hyper
cgcactcccctccccgggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagc

SEQ ID NO: 14108 - DNA, 31 bp, Homo sapiens
  chr22:45405596-45405627
  hyper
gggaagacaggcttccgggcgccgcggcgcc

SEQ ID NO: 14109 - DNA, 68 bp, Homo sapiens
  chr22:45405628-45405696
  hyper
agccctcggctgccccaactcctcaggctgcccggcaagttgcgccgggtccccgggctgccggcgcg

SEQ ID NO: 14110 - DNA, 289 bp, Homo sapiens
  chr22:45406039-45406328
  hyper
cggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatattttatttaaattcttccgtcccctcctgtccataccagcgccgcgacttgggggatta

SEQ ID NO: 14111 - DNA, 442 bp, Homo sapiens; identical to SEQ ID NO: 4917
  chr22:46262610-46263052
  hyper

SEQ ID NO: 14112 - DNA, 17 bp, Homo sapiens
  chr22:46263743-46263760
  hyper
cgcgcctgtcccctccc

SEQ ID NO: 14113 - DNA, 54 bp, Homo sapiens
  chr22:46658689-46658743
  hyper
aagccctgctggggccgcgggcctggcgcggcggagcgcggggagacgcgggcc

SEQ ID NO: 14114 - DNA, 309 bp, Homo sapiens; identical to SEQ ID NO: 4918
  chr22:48885529-48885838
  hyper

SEQ ID NO: 14115 - DNA, 733 bp, Homo sapiens
  chr22:48886204-48886937
  hyper
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtggg

SEQ ID NO: 14116 - DNA, 148 bp, Homo sapiens; identical to SEQ ID NO: 1524
  chr22:48971532-48971680
  hyper

SEQ ID NO: 14117 - DNA, 201 bp, Homo sapiens; identical to SEQ ID NO: 1525
  chr22:48971758-48971959
  hyper

SEQ ID NO: 14118 - DNA, 176 bp, Homo sapiens; identical to SEQ ID NO: 1526
  chr22:48971960-48972136
  hyper

SEQ ID NO: 14119 - DNA, 45 bp, Homo sapiens
  chr22:48972421-48972466
  hyper
ctgcccggctcgcggcggctccggcgcccgacccggcttccagca

SEQ ID NO: 14120 - DNA, 37 bp, Homo sapiens
  chr22:50421971-50422008
  hyper
cgccagggggctccacggaggccgcccctcatccaca

SEQ ID NO: 14121 - DNA, 48 bp, Homo sapiens
  chr22:50453483-50453531
  hyper
ccgcgcaggtttccacggagacgcgcgtggctccgggtcgtcgtcctg

SEQ ID NO: 14122 - DNA, 212 bp, Homo sapiens; identical to SEQ ID NO: 4922
  chr22:50496971-50497183
  hyper

SEQ ID NO: 14123 - DNA, 74 bp, Homo sapiens; identical to SEQ ID NO: 4923
  chr22:50497213-50497287
  hyper

SEQ ID NO: 14124 - DNA, 59 bp, Homo sapiens; identical to SEQ ID NO: 4924
  chr22:50623656-50623715
  hyper

SEQ ID NO: 14125 - DNA, 120 bp, Homo sapiens; identical to SEQ ID NO: 4925
  chr22:50623741-50623861
  hyper

SEQ ID NO: 14126 - DNA, 88 bp, Homo sapiens; identical to SEQ ID NO: 1527
  chr22:51042317-51042405
  hyper

SEQ ID NO: 14127 - DNA, 109 bp, Homo sapiens; identical to SEQ ID NO: 1528
  chr22:51042457-51042566
  hyper

SEQ ID NO: 14128 - DNA, 94 bp, Homo sapiens
  chr22:51112080-51112174
  hyper
ccctaggcccttccccgtaggtcgcgcccccatcccgccgtcgctaaggtgacggggagggggcgacaggcgttggatccggaccggccagggg

SEQ ID NO: 14129 - DNA, 96 bp, Homo sapiens
  chrX:3264807-3264903
  hyper
ccaagggaccctggccgcgccgctctgcgctcagccttcctctcgcgtcttcattgcgcctgggcccgggtgggcatgcctcgcccactccagctg

SEQ ID NO: 14130 - DNA, 29 bp, Homo sapiens
  chrX:3265150-3265179
  hyper
cgggctggccccgccggcatcccactagc

SEQ ID NO: 14131 - DNA, 20 bp, Homo sapiens
  chrX:6143666-6143686
  hyper
gcttcgtcaggataacgagg

SEQ ID NO: 14132 - DNA, 199 bp, Homo sapiens
  chrX:6143746-6143945
  hyper
ttttttttttttttttgcttttgccttcctcacatcaccggaagggctgattctgagatgggagctcacgcacaccaccccctttcaagaaaatataatgcaacgcgctccgatgtaaaccctacgggcaacggatgccttcaaaaagcataagataagagcaacaacaacaacaacaaaccaccgccccccccaaaaa

SEQ ID NO: 14133 - DNA, 30 bp, Homo sapiens
  chrX:6144913-6144943
  hyper
tccctacctcatccccgctcgcgcttccgc

SEQ ID NO: 14134 - DNA, 307 bp, Homo sapiens
  chrX:6145243-6145550
  hyper
gggaagagggggtggcggttgcgttttccagggctgtagaggtggtgcgcctattggaaccgactcctcagcctcctcccccgtccccacctcggggactggcggaccgtgcgccccgcaggcttaacactccccccgacaccctcgctccgagaaggggtgttctcagtgggcaccgactagggctccagatcccccgagacccagaccagggctccggtagtctgtcctcgcagcttccaacttttccgctccttcggaaaagcgggcagttcagagatggttcccagggcggcagctgcaagcc

SEQ ID NO: 14135 - DNA, 30 bp, Homo sapiens
  chrX:8698521-8698551
  hyper
gttcaagatcatccccgagggtaaggggaa

SEQ ID NO: 14136 - DNA, 216 bp, Homo sapiens
  chrX:8698842-8699058
  hyper
gaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 14137 - DNA, 71 bp, Homo sapiens
  chrX:8699110-8699181
  hyper
cggggtttgggggacggttcccccgggactcgttgaggagtatccgaatacggccccgccaaatcccctgt

SEQ ID NO: 14138 - DNA, 62 bp, Homo sapiens
  chrX:8699504-8699566
  hyper
ctttgcgggagtcgccgcccgcccggagtctcgcgcactccaattcccgggaaaccgccaca

SEQ ID NO: 14139 - DNA, 145 bp, Homo sapiens
  chrX:13956384-13956529
  hyper
cagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacc

SEQ ID NO: 14140 - DNA, 281 bp, Homo sapiens
  chrX:13956777-13957058
  hyper
ctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatcc

SEQ ID NO: 14141 - DNA, 30 bp, Homo sapiens
  chrX:16730016-16730046
  hyper
gaaaggccatgttaccggcgctgatcacca

SEQ ID NO: 14142 - DNA, 40 bp, Homo sapiens
  chrX:40017828-40017868
  hyper
acgacctctggttcccggactcccgcgatggtcaacgtgt

SEQ ID NO: 14143 - DNA, 38 bp, Homo sapiens
  chrX:40034521-40034559
  hyper
ggctggccccgcgcgcgtaagcgcggcactcagcagct

SEQ ID NO: 14144 - DNA, 172 bp, Homo sapiens
  chrX:91035629-91035801
  hyper
ttctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggc

SEQ ID NO: 14145 - DNA, 34 bp, Homo sapiens
  chrX:91037095-91037129
  hyper
cgagcagccctgccccgcgcgctccctgcgcgca

SEQ ID NO: 14146 - DNA, 27 bp, Homo sapiens
  AC211950.2_11234-25326:156-183
  hyper
gggttcgatccccgtgccggtcagaag

SEQ ID NO: 14147 - DNA, 43 bp, Homo sapiens
  AC211950.2_11234-25326:13516-13559
  hyper
ttatcaggagcctgccggtactttgggccgccaaatccctggc

SEQ ID NO: 14148 - DNA, 420 bp, Homo sapiens; identical to SEQ ID NO: 1529
  AC241851.2_88-34049:15130-15550
  hyper

SEQ ID NO: 14149 - DNA, 91 bp, Homo sapiens
  AEKP01168736.1_1-4752:1669-1760
  hyper
gtctaagctagggcccggggtccaaaggaaaggctttcagatctgagctccgcggctctggcggcggtggagctgggagcccgcggtggcc

SEQ ID NO: 14150 - DNA, 811 bp, Homo sapiens
  AEKP01168736.1_1-4752:1820-2631
  hyper
tggtcctgggctcggcgatgcgggtgcacctgggcgggctggccggcgcggctgcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccggggtaagggtgcaccccgtggctgggagctgtggctgcgaacgccccctgcgcggtgccctgctcccttgggacctgttgcttggcgcgcactcctcccccaagtccctaaaatacaatgtctagggactcggggggaaggtgagcagaaggccgggactgcgaaaacccttccgagaggcacccggctgcgatcccaactgctctagctctccccgcgccctccccgggtggggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtct

SEQ ID NO: 14151 - DNA, 82 bp, Homo sapiens
  JH159140.1:144237-144319
  hyper
tgcccctaggtctgtcgctcagccgccgtccacactcgctgcaggggggggggcacagaatttaccgcggcaagaacatccc

SEQ ID NO: 14152 - DNA, 36 bp, Homo sapiens; identical to SEQ ID NO: 4929
  JH636052.4:1362180-1362216
  hyper

SEQ ID NO: 14153 - DNA, 194 bp, Homo sapiens
  JH636052.4:5118735-5118929
  hyper
gggcgaaggccattccgctgcccttccagcttcggaatcacccaatgcacgggtttcaaccgtagccagcaagatgcgcctctcaggttttccgaggctttggagcctgcacaattgttctacaaaaggcagtagctccgccgaacgttggatcgtcccttggtctggtgataccagaacgagagttgactgtg

SEQ ID NO: 14154 - DNA, 172 bp, Homo sapiens
  JH636058.1:413215-413387
  hyper
ccaggcactcggcggcgaagtagtccaggcacgccacggcggccgacatgctgggaccgcccggccgccggcgagcgccgtccgaacgcggccggccgcgggcgacggagttcccgggagcgtccgtcccgcagcctcggagcgagaagcaggaggccgggtgctcgccgcc

SEQ ID NO: 14155 - DNA, 572 bp, Homo sapiens
  chr1:913532-914104
  hypo
tccaaccccaggaaccgcctgccccaccctaaccctgcacactcttggcctgggaactgcctgccccgcacacgcccgccccgggaaccgcctgccccagatacatccatcatgggacatgtctgtcctaagatacatttgtgctggacacgtctaccctggacacgtcttcccgaaacccctctgtcatggacacgtcttcctgagaactggttgccccgggaaccgcctgccccgggaaccgcccgccctggacgcgtctgtcggagtcacatcgcccccgtgcttcttctgcctgagatttgggtgacctggttgagttgggccagtttgggggaactgccagtggaggccccgtgttctggtctgtaaagcatctcccagaggacatcagtgtgagatgggcctcgtagagtgcctgaccctgaaggtagccaggcctgggcgggaaccctgccagaggctgggggagggacgccgccgtcacatgggcccgaacacagggcaacggcggcgcagagccaaccccctgaacaacccgggtgcttggactgggccgccccatctggact

SEQ ID NO: 14156 - DNA, 33 bp, Homo sapiens
  chr1:942352-942385
  hypo
ccgggcctcggaccccgacggggctcacccacc

SEQ ID NO: 14157 - DNA, 34 bp, Homo sapiens
  chr1:1050115-1050149
  hypo
actgaacatcccaggcggccgcccctaccctggg

SEQ ID NO: 14158 - DNA, 30 bp, Homo sapiens
  chr1:1080808-1080838
  hypo
ccgacctgacctgaccgcacggctgaccca

SEQ ID NO: 14159 - DNA, 155 bp, Homo sapiens
  chr1:1145553-1145708
  hypo
ctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggc

SEQ ID NO: 14160 - DNA, 137 bp, Homo sapiens
  chr1:1146693-1146830
  hypo
tgcagcccacagtgccggtcggagactcccgtctgccaaggtttttattgtggtcccgcggggcaggaggtatgcatggcatacgtaagcagagagccggaggcagccatcggcacctagaacggtgcagagttggc

SEQ ID NO: 14161 - DNA, 146 bp, Homo sapiens; identical to SEQ ID NO: 1530
  chr1:1235932-1236078
  hypo

SEQ ID NO: 14162 - DNA, 129 bp, Homo sapiens
  chr1:1238321-1238450
  hypo
cctgtaggctgtcagcgaacctctgcagacattcctggaggagcagatgggaacccgtgctgagatggcaaatccgggcccaggtcacccagccacgccctctgagcccctgggcggtgcagacaccgg

SEQ ID NO: 14163 - DNA, 30 bp, Homo sapiens
  chr1:1245257-1245287
  hypo
cctgccctcaagtcacgtgctgattttagc

SEQ ID NO: 14164 - DNA, 72 bp, Homo sapiens
  chr1:1267177-1267249
  hypo
gccaaggcaggcagccgcgacatcgccgcctactgcaactacacgcagtaccagccccgtgtgctggctgtc

SEQ ID NO: 14165 - DNA, 692 bp, Homo sapiens; identical to SEQ ID NO: 1531
  chr1:1267466-1268158
  hypo

SEQ ID NO: 14166 - DNA, 30 bp, Homo sapiens
  chr1:1563193-1563223
  hypo
tgacgtcaacctgcccgtgagtgctgctcc

SEQ ID NO: 14167 - DNA, 129 bp, Homo sapiens
  chr1:1856222-1856351
  hypo
agggcgcctgagtctcgctcaggcccagcttagctgaacccacgtccccacctgtgtcctccctgccctcaccccctctccttagagcaccctttctccatgcaacgcccgtctcgggctctgcctcca

SEQ ID NO: 14168 - DNA, 30 bp, Homo sapiens
  chr1:1874744-1874774
  hypo
agacacgccaacacacgcagctggctcccg

SEQ ID NO: 14169 - DNA, 30 bp, Homo sapiens
  chr1:1915087-1915117
  hypo
gctcttctgtaagttcggaattgtttcaaa

SEQ ID NO: 14170 - DNA, 38 bp, Homo sapiens
  chr1:2013465-2013503
  hypo
aaagcaggcttgatccgggctgccgtggttccgatcga

SEQ ID NO: 14171 - DNA, 64 bp, Homo sapiens
  chr1:2066615-2066679
  hypo
acgggagtggcctgtcgcagctgcaccctgcgtgggctcgtggctgccacgctgtttctttaca

SEQ ID NO: 14172 - DNA, 30 bp, Homo sapiens
  chr1:2141654-2141684
  hypo
acacctgaaatcaagcgggagggtaggaat

SEQ ID NO: 14173 - DNA, 213 bp, Homo sapiens
  chr1:2263131-2263344
  hypo
gggaacagtcaaagacgactttgcaggatcctgcctgagagttgtaacaaaggcgcgcgtttctcccgcatgcgccgtccttcttatgtaaccactgccgctcctctcccgcggctgcgcctctcccgccgctgcgcctctccctcgtgcggctctcccgcccctgcgcctctccctcgtgcgcctctcccgcccctgcgcctctccctcgtg

SEQ ID NO: 14174 - DNA, 224 bp, Homo sapiens; identical to SEQ ID NO: 4932
  chr1:2267466-2267690
  hypo

SEQ ID NO: 14175 - DNA, 102 bp, Homo sapiens
  chr1:2275689-2275791
  hypo
ggcacaaggggctggcgggcctgggagggatctgcagggcaggttgagacatggttctgaagccaggcagctgctccccagaagctccggtgagcacactcg

SEQ ID NO: 14176 - DNA, 49 bp, Homo sapiens
  chr1:2304340-2304389
  hypo
cccgtggaatgttcccgcacgtcttcccgctggtcgggatttaggccct

SEQ ID NO: 14177 - DNA, 49 bp, Homo sapiens
  chr1:2307845-2307894
  hypo
ccccttccacctgctcggcctctggaaggtgccccgggctttcaggagg

SEQ ID NO: 14178 - DNA, 161 bp, Homo sapiens
  chr1:2308245-2308406
  hypo
actgatccaatagcccggtcttgtctaattcacgttatcaatcacacctttgacaattcggctgtttctgtttcatgtaccccaagcaggaacgagcaagagcttattaaatagggtgcaggggaggctcctgatcctcctgctgacggcacagactggga

SEQ ID NO: 14179 - DNA, 52 bp, Homo sapiens
  chr1:2308606-2308658
  hypo
gtgcggtacgggacacgggaaggtggtggtggtcacacgacctttggggaag

SEQ ID NO: 14180 - DNA, 49 bp, Homo sapiens
  chr1:2338188-2338237
  hypo
cactccttcctggctcgctgccgctgcctgaaaccgtacagctgcagcc

SEQ ID NO: 14181 - DNA, 348 bp, Homo sapiens
  chr1:2359972-2360320
  hypo
gacctcatggtcctccgtggcctcgcctaggcttgcggcagccgacgtggcgttgttgcctaattaggttggactgtgccagccccagcggagcccacgcccggcccttgcgccggcagacgtgtcggggcacggctcctgcactcccactgccgcaggaactgctcaggaacctgccggtctccggctgggacggtggctggatcagctcaagcctccagggccctgaggctgaggggctgagtgctcattccagccgcctcggggaacccgggctgggagaccccatgcctgggggtgagcctggagccagggcagtgcggtgagaggctccggagagagggctgg

SEQ ID NO: 14182 - DNA, 180 bp, Homo sapiens
  chr1:2396998-2397178
  hypo
tcctcacctgctgcccgccgcctgccgcccgccacctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtga

SEQ ID NO: 14183 - DNA, 89 bp, Homo sapiens
  chr1:2428272-2428361
  hypo
ccagctggcaggtgtcgtccttcagcgagaccaaggcccaccagattctgcagcagaagccggcgcagtacctacgcttcaaccagcag

SEQ ID NO: 14184 - DNA, 30 bp, Homo sapiens
  chr1:2468639-2468669
  hypo
ctatgcatgcatctgcgtgcatgtgcccag

SEQ ID NO: 14185 - DNA, 30 bp, Homo sapiens
  chr1:2507045-2507075
  hypo
ctcacaggctcacagcgggtgtactttatt

SEQ ID NO: 14186 - DNA, 66 bp, Homo sapiens
  chr1:2537084-2537150
  hypo
cctgggcaaggggcccggggtccccgcagcctggctgaggcaggctgcagccgcctccccacagga

SEQ ID NO: 14187 - DNA, 79 bp, Homo sapiens
  chr1:2537758-2537837
  hypo
ctgtgagttcatcagcgccagctgccgctccagctcccactcgagtcctggggagacagtgccccgcactggagactgg

SEQ ID NO: 14188 - DNA, 113 bp, Homo sapiens
  chr1:2708372-2708485
  hypo
tctctcctctctttccgagattccagttacacacacgagactttgatattgtccccaggtcacccagcctctgttcatttttcttctgttcttcgtatcgagtaatttctatt

SEQ ID NO: 14189 - DNA, 136 bp, Homo sapiens
  chr1:2725529-2725665
  hypo
aggagctggggctgccggcctcgcaggtgtggttggggtgggtggggctgccgtgggcctggctccatggctctgtgcaggtggcagccggcgccgcgtgtcgccacccacacaggaaaggcgagattggtggcag

SEQ ID NO: 14190 - DNA, 54 bp, Homo sapiens
  chr1:3078787-3078841
  hypo
cccccaggaaaaccccgtgcccggtaaatagtgactctgcgtccctcctcccga

SEQ ID NO: 14191 - DNA, 87 bp, Homo sapiens
  chr1:3102677-3102764
  hypo
gtctcctttaggtgacggtgacgttgtaaataatatgtatgagcccaaccgggacctgctggccagccacagcgcggaggacgaggc

SEQ ID NO: 14192 - DNA, 56 bp, Homo sapiens
  chr1:3111327-3111383
  hypo
gtattctcagtcccacgttttatcatctaaacgccaaaactcgttcctggcctgcc

SEQ ID NO: 14193 - DNA, 39 bp, Homo sapiens
  chr1:3411209-3411248
  hypo
cacaggagcagctgccgttgctggcgtggcacaggcccc

SEQ ID NO: 14194 - DNA, 15 bp, Homo sapiens
  chr1:3659628-3659643
  hypo
tctctttagggaagc

SEQ ID NO: 14195 - DNA, 30 bp, Homo sapiens
  chr1:3680070-3680100
  hypo
ccactcagtggttcccggcccaggagctgg

SEQ ID NO: 14196 - DNA, 104 bp, Homo sapiens
  chr1:3683740-3683844
  hypo
catactcaggttgggcgaaatgaccccacctcttttttctccccggctgtccccagcaagtgtcggaactggagagaaagctcaccaagcgggactgtgtcatc

SEQ ID NO: 14197 - DNA, 180 bp, Homo sapiens
  chr1:4082823-4083003
  hypo
cccaaacgtcagtggcgctgagcagagcaaccctgatttagcgactccttgttggtcctggctcccagtgtgttggggacgtgatgcgggtgactctgctgtgggctcacaggctctgctggttccatggacagaaataaagtggaacttcatgctgctggaactcgggcggttgtgctg

SEQ ID NO: 14198 - DNA, 151 bp, Homo sapiens
  chr1:4111083-4111234
  hypo
ggcctcctctggaatcttcactgagcacctgccatggtggggactgttgccagcactgggtatgagacctcctgggagccctcagctgggcaggagcctgggggatcagaaaggatcgaggtttggaatggagcgccgcagctggtgcctg

SEQ ID NO: 14199 - DNA, 141 bp, Homo sapiens
  chr1:4402113-4402254
  hypo
actgctgtgtgtccccgcggattcaggcggctctgatcccacctgataggtagacaagaacgcacttggcaactagtagccactcacctggtacccgggccatgtggacctgccctagtgtggcctcgcttactgcccgcc

SEQ ID NO: 14200 - DNA, 30 bp, Homo sapiens
  chr1:4486536-4486566
  hypo
tgccaaagccatggccgcagacatacgatg

SEQ ID NO: 14201 - DNA, 53 bp, Homo sapiens
  chr1:4772565-4772618
  hypo
gaagacaactgtggccgccaccaccaccaccaccaccacggccacccccatga

SEQ ID NO: 14202 - DNA, 128 bp, Homo sapiens; identical to SEQ ID NO: 1532
  chr1:6166321-6166449
  hypo

SEQ ID NO: 14203 - DNA, 30 bp, Homo sapiens
  chr1:6280243-6280273
  hypo
agttttgattttccccgtgtttgcatggca

SEQ ID NO: 14204 - DNA, 30 bp, Homo sapiens
  chr1:6360980-6361010
  hypo
acacatggagagtcacgcttccaaagtcac

SEQ ID NO: 14205 - DNA, 56 bp, Homo sapiens
  chr1:6391449-6391505
  hypo
gcctcagccaagggacgcctggagccacccggcgctggagacgccaggagggatcc

SEQ ID NO: 14206 - DNA, 177 bp, Homo sapiens
  chr1:6446131-6446308
  hypo
tgagttccacctgggcggagttccacctgggcagagaggtcttggctcacaggcaccgggagagctggaaggctgcggggaagccgaggaaggccaacacaccgcacaacacggcaggtgcctggccctcctctgacagtggccctcaagctccaggagggccgaggaaaatgcaga

SEQ ID NO: 14207 - DNA, 98 bp, Homo sapiens
  chr1:11036301-11036399
  hypo
agccagacggccctgcgggagaggagggaagggggtggggacatgcaccgcccagctgctgcctcatctaccttcattcactcattatatttcttttt

SEQ ID NO: 14208 - DNA, 30 bp, Homo sapiens
  chr1:11131698-11131728
  hypo
cagagtaaaaggcagcgtcatcccgtgggc

SEQ ID NO: 14209 - DNA, 84 bp, Homo sapiens
  chr1:11936694-11936778
  hypo
gatgtgaagtagcttcgggcagaactccaaaccttagagagatcatttgaaaataccatttgggctgggcgcagtggctcatgc

SEQ ID NO: 14210 - DNA, 474 bp, Homo sapiens
  chr1:12251443-12251917
  hypo
aactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcagg

SEQ ID NO: 14211 - DNA, 60 bp, Homo sapiens
  chr1:14730412-14730472
  hypo
aagaagaggtctctgcgcagagaggtcccggagaaaatgggttgccgcttctgcagtgaa

SEQ ID NO: 14212 - DNA, 41 bp, Homo sapiens
  chr1:16534552-16534593
  hypo
tccgctcaggaccttcgaggctcactcgggtggacccagac

SEQ ID NO: 14213 - DNA, 30 bp, Homo sapiens
  chr1:19213653-19213683
  hypo
ggtgttggtccaaaccgcaccattttgtca

SEQ ID NO: 14214 - DNA, 64 bp, Homo sapiens
  chr1:21042770-21042834
  hypo
taagagcagcacctgcggggctctcacagggtgcatacagggcttctttcgtgcatgggcacag

SEQ ID NO: 14215 - DNA, 30 bp, Homo sapiens
  chr1:22777528-22777558
  hypo
cgcttcaacagggaacgcatagtgtgtgag

SEQ ID NO: 14216 - DNA, 80 bp, Homo sapiens
  chr1:22927402-22927482
  hypo
gtggaggaggggtaccgcctgcccgcacccatgggctgcccccacgccctgcaccagctcatgctcgactgttggcacaa

SEQ ID NO: 14217 - DNA, 42 bp, Homo sapiens
  chr1:24119192-24119234
  hypo
tgtgcccctgctcaccgatgctgccaccgtgtctggagctga

SEQ ID NO: 14218 - DNA, 103 bp, Homo sapiens; identical to SEQ ID NO: 4934
  chr1:27190175-27190278
  hypo

SEQ ID NO: 14219 - DNA, 30 bp, Homo sapiens
  chr1:27844537-27844567
  hypo
gagcagatctgagcacgctcctcaccagcc

SEQ ID NO: 14220 - DNA, 30 bp, Homo sapiens
  chr1:29074253-29074283
  hypo
atcctagttctcagccggtgagcaaaccac

SEQ ID NO: 14221 - DNA, 16 bp, Homo sapiens
  chr1:29516596-29516612
  hypo
atagtcaaggccgggc

SEQ ID NO: 14222 - DNA, 41 bp, Homo sapiens
  chr1:32705509-32705550
  hypo
tggtctctgtgcctccgccagtcacgcgggcttgtttcgcg

SEQ ID NO: 14223 - DNA, 143 bp, Homo sapiens
  chr1:33473115-33473258
  hypo
acaagagatgggaaccggctccttcccccaacataactcacccctccagcctttctggaatacgggtgattccaggagctatgcaaatccagcacattggaactttagtaccaacaataaggaaacaacggaggatggcaaaa

SEQ ID NO: 14224 - DNA, 20 bp, Homo sapiens
  chr1:35660562-35660582
  hypo
aggcgggaccgggtgcggtg

SEQ ID NO: 14225 - DNA, 22 bp, Homo sapiens
  chr1:35664724-35664746
  hypo
ccaccggcgctagctattctta

SEQ ID NO: 14226 - DNA, 115 bp, Homo sapiens
  chr1:36563456-36563571
  hypo
tggctgggttgtagccgctgtggccattgtagagagtccggtcaaatttcacgggcatgcccgaggcggggaagggcgaggtgagcaccgcagtgaaggccggtgtggcatgggc

SEQ ID NO: 14227 - DNA, 81 bp, Homo sapiens; identical to SEQ ID NO: 4936
  chr1:38398328-38398409
  hypo

SEQ ID NO: 14228 - DNA, 156 bp, Homo sapiens; identical to SEQ ID NO: 1533
  chr1:39416821-39416977
  hypo

SEQ ID NO: 14229 - DNA, 30 bp, Homo sapiens
  chr1:40905137-40905167
  hypo
agtgccttaaattaccgtgttgtgtaactg

SEQ ID NO: 14230 - DNA, 145 bp, Homo sapiens; identical to SEQ ID NO: 4938
  chr1:41991640-41991785
  hypo

SEQ ID NO: 14231 - DNA, 30 bp, Homo sapiens
  chr1:43826882-43826912
  hypo
ggcctgtctgagtgccgtggatgcccattc

SEQ ID NO: 14232 - DNA, 98 bp, Homo sapiens
  chr1:43834741-43834839
  hypo
aacagtagcacacaacgatctaacaactgcttgtatgattggatggtgtaagtgcggacagaattagggaatttgggctactctgggcacactgctta

SEQ ID NO: 14233 - DNA, 30 bp, Homo sapiens
  chr1:44068855-44068885
  hypo
gctgtctgccccaggcgtgcggctcctggg

SEQ ID NO: 14234 - DNA, 43 bp, Homo sapiens
  chr1:44351190-44351233
  hypo
ggcaagcaggtcaggcgtcccacacccccgctagtctgaccag

SEQ ID NO: 14235 - DNA, 144 bp, Homo sapiens
  chr1:44497527-44497671
  hypo
ggccttctgcgcctgcgtttcccctagagagaagtcagagcaaattccattccctttggagcagagccgctagagactgtgggcattgctgggtaaggcctaggtcctactccttggaactggagggctcggggtagccctttc

SEQ ID NO: 14236 - DNA, 313 bp, Homo sapiens
  chr1:44726955-44727268
  hypo
cagcgcggaggaaggcgcgagtcagtctggagtgctccccatttatcaagctcacgcaggccgccagccgagcgagtctttctatcattacacctctcaaaatccgattcataccactaatcctgccttcattctcccagattaataacatctctttcaaccttcacagtgtgataaatagacaaagagagaacaaaaggagagacagaagagagagaaagagctggagcaagtccccataatagagagagctgagaaagaggagagggaaaaaaggagagcgaacgagagcaggcagcggccagagactgca

SEQ ID NO: 14237 - DNA, 77 bp, Homo sapiens
  chr1:45280503-45280580
  hypo
gtgtgcgccaccatgcccggcctcagctccttctttcattccagacctgcccccctggagatcgctccctgaatgcc

SEQ ID NO: 14238 - DNA, 37 bp, Homo sapiens; identical to SEQ ID NO: 1534
  chr1:45645619-45645656
  hypo

SEQ ID NO: 14239 - DNA, 38 bp, Homo sapiens
  chr1:46079131-46079169
  hypo
ctgtagcttacctagtttaggcacgattattatttttt

SEQ ID NO: 14240 - DNA, 20 bp, Homo sapiens
  chr1:53129144-53129164
  hypo
acatgtggccgggcgcggtg

SEQ ID NO: 14241 - DNA, 30 bp, Homo sapiens
  chr1:53990562-53990592
  hypo
gtaacatggggggcacgggtggggtgagtg

SEQ ID NO: 14242 - DNA, 407 bp, Homo sapiens
  chr1:54586590-54586997
  hypo
gtggtggcagtggggcgagagagaaaggagtggactggagagatggtggtacgtgggcggacagagctggatgagagacctgggagagggagaaatccgaggccagcgcagaagtctgggtgtggagaggccgctcatccaaacgacaggagaggctcagggagcgccaatgattccgtgtgaggcacagggcgtggctgcgggtgggtgggagggcgactgcagcatgggaaatttcggtggagaaccagatcaggagtcaccaaataccatggagatggtaacaaagcctacagggaggcagggattgtgcggggagtctgcagcagcaaaacccctgctgggatgaggggccgggccctctctgaccccagaccaggcaaggctcccgtcgtccccactttgcc

SEQ ID NO: 14243 - DNA, 18 bp, Homo sapiens
  chr1:70599151-70599169
  hypo
cctcggcctcccaaagtg

SEQ ID NO: 14244 - DNA, 90 bp, Homo sapiens; identical to SEQ ID NO: 4940
  chr1:70672837-70672927
  hypo

SEQ ID NO: 14245 - DNA, 30 bp, Homo sapiens
  chr1:78244815-78244845
  hypo
acattcaatattcttcggttgcctaattca

SEQ ID NO: 14246 - DNA, 98 bp, Homo sapiens; identical to SEQ ID NO: 1535
  chr1:86860851-86860949
  hypo

SEQ ID NO: 14247 - DNA, 30 bp, Homo sapiens
  chr1:92494939-92494969
  hypo
cggcttccagcccttcgacgaactctcagg

SEQ ID NO: 14248 - DNA, 28 bp, Homo sapiens
  chr1:94343568-94343596
  hypo
aaatcaaaatttggccgggcgcggtggc

SEQ ID NO: 14249 - DNA, 98 bp, Homo sapiens
  chr1:99611990-99612088
  hypo
gagccctgccctcctcggaagggctgcagctgcccaaattgcagttgtggatccagcctctctgtgctcttgggggcctgggggaacctgtgctctcg

SEQ ID NO: 14250 - DNA, 38 bp, Homo sapiens
  chr1:99612148-99612186
  hypo
tcttagggcattgtcctgctgcgcgttgggggtgatga

SEQ ID NO: 14251 - DNA, 86 bp, Homo sapiens; identical to SEQ ID NO: 4943
  chr1:100437183-100437269
  hypo

SEQ ID NO: 14252 - DNA, 26 bp, Homo sapiens
  chr1:100814757-100814783
  hypo
aaaaaaaaaggcgttgttttcaaact

SEQ ID NO: 14253 - DNA, 20 bp, Homo sapiens
  chr1:109076917-109076937
  hypo
ttcaccgtgttagccaggat

SEQ ID NO: 14254 - DNA, 41 bp, Homo sapiens; identical to SEQ ID NO: 4944
  chr1:109585463-109585504
  hypo

SEQ ID NO: 14255 - DNA, 22 bp, Homo sapiens
  chr1:109593505-109593527
  hypo
tcaagggccaggcaccgcggct

SEQ ID NO: 14256 - DNA, 79 bp, Homo sapiens
  chr1:110726679-110726758
  hypo
aaagcacgctgtttccgacgatcagtgaggcaattatacaagcctgttttttctgtttttgttggttttttttgacgga

SEQ ID NO: 14257 - DNA, 30 bp, Homo sapiens
  chr1:110883605-110883635
  hypo
gccgacaccgaacatcgttaccagcagcag

SEQ ID NO: 14258 - DNA, 30 bp, Homo sapiens
  chr1:110884166-110884196
  hypo
ggtgacaagcgagaccgtaaaaactctgca

SEQ ID NO: 14259 - DNA, 180 bp, Homo sapiens
  chr1:112084890-112085070
  hypo
caggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagc

SEQ ID NO: 14260 - DNA, 30 bp, Homo sapiens
  chr1:113751257-113751287
  hypo
agatccactgaggggcgtggcctctcttcc

SEQ ID NO: 14261 - DNA, 30 bp, Homo sapiens
  chr1:116214288-116214318
  hypo
cccaggcaggggaggcgcagtgcaggttgg

SEQ ID NO: 14262 - DNA, 30 bp, Homo sapiens
  chr1:116574202-116574232
  hypo
gtaattatactaaggcgtgttctgttgctc

SEQ ID NO: 14263 - DNA, 30 bp, Homo sapiens
  chr1:150602992-150603022
  hypo
aacatttggtaaatacggttaatactagtt

SEQ ID NO: 14264 - DNA, 30 bp, Homo sapiens
  chr1:150850705-150850735
  hypo
taatcctcacaacaacgatgaggtaggttc

SEQ ID NO: 14265 - DNA, 79 bp, Homo sapiens; identical to SEQ ID NO: 1537
  chr1:151170062-151170141
  hypo

SEQ ID NO: 14266 - DNA, 102 bp, Homo sapiens; identical to SEQ ID NO: 1538
  chr1:151252684-151252786
  hypo

SEQ ID NO: 14267 - DNA, 30 bp, Homo sapiens
  chr1:151300888-151300918
  hypo
aaataaacaaaaacacgccatgcaaatggg

SEQ ID NO: 14268 - DNA, 109 bp, Homo sapiens
  chr1:153539476-153539585
  hypo
ccttggcacagccaccgagtgtcccttgctcccctcagtacttgaacccctcatgctacttgtcttcccatcgaggcctacttcaagtagaactcggaataaaaaccct

SEQ ID NO: 14269 - DNA, 195 bp, Homo sapiens
  chr1:153540047-153540242
  hypo
ctcggcctgctgctgcgtgtcccttaaacacaccggcacatgcaactagtgtggccaagaccctcggcttgcgctgacccctctgttcagaacgtgcccacacatgcccatgccctctatcctgctgaaatccaacccccccttcaaaggccactgcagggagccttcccagggcccaaccggattcagtgtcta

SEQ ID NO: 14270 - DNA, 45 bp, Homo sapiens; identical to SEQ ID NO: 1539
  chr1:153937124-153937169
  hypo

SEQ ID NO: 14271 - DNA, 98 bp, Homo sapiens
  chr1:155160925-155161023
  hypo
ccctggcagaggtgccgttgtgcaccagagtagaagctgagcctgatgcagagcctgaggccgaggtgacattgtggactggaggggcggtggagccc

SEQ ID NO: 14272 - DNA, 26 bp, Homo sapiens
  chr1:155578901-155578927
  hypo
actaccgcacccggcccttgccttgt

SEQ ID NO: 14273 - DNA, 44 bp, Homo sapiens
  chr1:155826292-155826336
  hypo
ctaggattagaggcgtgagccaccgcgcccgacctacagttagt

SEQ ID NO: 14274 - DNA, 40 bp, Homo sapiens; identical to SEQ ID NO: 1540
  chr1:156030121-156030161
  hypo

SEQ ID NO: 14275 - DNA, 23 bp, Homo sapiens
  chr1:156031582-156031605
  hypo
tttttttttctgagacggagtct

SEQ ID NO: 14276 - DNA, 47 bp, Homo sapiens
  chr1:156433495-156433542
  hypo
agaaaccaaaacccacgccgaagtatcagaaacgtgtattctttttc

SEQ ID NO: 14277 - DNA, 89 bp, Homo sapiens
  chr1:156843312-156843401
  hypo
cctgccctttgatttcgggttctactcgctttgcccgtggacttgtcgggtgtgtgccaggctccctccagctgcgccctgacctcctg

SEQ ID NO: 14278 - DNA, 116 bp, Homo sapiens
  chr1:157247347-157247463
  hypo
agtggcctttatgaccgcatttgaaacgggagtcaggtggaggtggattattaggaggcttccatgtagagccgcggcccagtggcctgcagggcctctgacggcagaggcaagca

SEQ ID NO: 14279 - DNA, 143 bp, Homo sapiens
  chr1:157458773-157458916
  hypo
gacttggcaaccagccggacactgattccattcctgcttctaccgctaagctctgtcatccagcagatcctcaatggcctcatctggaaaatgggataatacttcctctgcagggttgctgggaggactaaatagatagaaga

SEQ ID NO: 14280 - DNA, 28 bp, Homo sapiens
  chr1:157791984-157792012
  hypo
aacttgaacataaggcgggcggatcacg

SEQ ID NO: 14281 - DNA, 78 bp, Homo sapiens
  chr1:157895413-157895491
  hypo
ttagaccagcaggtgcgaggtgcgacgtgggaaagagtccagggccggcggggtgctatgaggcgaggacttcctgag

SEQ ID NO: 14282 - DNA, 141 bp, Homo sapiens
  chr1:158169208-158169349
  hypo
aactttctagtcttacgtattcttgtggtgcctgggaacagagttctgctcctactgattcaaaaggtaaaacgcaggtccaagacacactaggctccaggattgaacattgataagatcaaagacattaggctttggagg

SEQ ID NO: 14283 - DNA, 30 bp, Homo sapiens
  chr1:158237112-158237142
  hypo
cccggtggtgcagaacgtgtgtgccaggtg

SEQ ID NO: 14284 - DNA, 20 bp, Homo sapiens
  chr1:158366698-158366718
  hypo
tattttggccaggggcggtg

SEQ ID NO: 14285 - DNA, 16 bp, Homo sapiens
  chr1:158591676-158591692
  hypo
ggagtcttgctctgtc

SEQ ID NO: 14286 - DNA, 15 bp, Homo sapiens
  chr1:158591932-158591947
  hypo
cgtgagccactgcac

SEQ ID NO: 14287 - DNA, 30 bp, Homo sapiens
  chr1:158639324-158639354
  hypo
tcacgtagggcatcccgccgggctaacagc

SEQ ID NO: 14288 - DNA, 17 bp, Homo sapiens
  chr1:158730575-158730592
  hypo
ctgggtgcagtggctcg

SEQ ID NO: 14289 - DNA, 23 bp, Homo sapiens
  chr1:158748794-158748817
  hypo
cgagactgcgtctcaaaaaaaaa

SEQ ID NO: 14290 - DNA, 169 bp, Homo sapiens
  chr1:159883486-159883655
  hypo
acatattattctccacggaaccatgtacaaacacacagatgcctacacacgcaggacaaacacctctctgcacccattatccccaatccttggtaaacacatactcataggcagcctccacacacagtcacagattatctcctcccacctgcaccgcaccccaccccct

SEQ ID NO: 14291 - DNA, 30 bp, Homo sapiens
  chr1:159932029-159932059
  hypo
tattgccaatgatttcgttttaagagtgga

SEQ ID NO: 14292 - DNA, 26 bp, Homo sapiens
  chr1:160451209-160451235
  hypo
ctgttcctattcggccatcttggctg

SEQ ID NO: 14293 - DNA, 38 bp, Homo sapiens; identical to SEQ ID NO: 4953
  chr1:160693915-160693953
  hypo

SEQ ID NO: 14294 - DNA, 30 bp, Homo sapiens
  chr1:160853373-160853403
  hypo
ctatcactagtcccacgctcattccaccac

SEQ ID NO: 14295 - DNA, 35 bp, Homo sapiens
  chr1:160880659-160880694
  hypo
ttctactcttgagtgcgagttaaagaaacaactta

SEQ ID NO: 14296 - DNA, 36 bp, Homo sapiens
  chr1:160992336-160992372
  hypo
cttaatagtcttggccgggtgcgtggcacacgccta

SEQ ID NO: 14297 - DNA, 57 bp, Homo sapiens
  chr1:161007705-161007762
  hypo
gtgtatccaagactccgggccagctgcgtggcctggaggccccgcttgcccatctga

SEQ ID NO: 14298 - DNA, 28 bp, Homo sapiens
  chr1:161367768-161367796
  hypo
gcgtgaaacaccgcgcctggccaaaaaa

SEQ ID NO: 14299 - DNA, 52 bp, Homo sapiens
  chr1:161442419-161442471
  hypo
cggcgggcagtctctcgaccctgggcggcagagaaagcgcaagatgggacga

SEQ ID NO: 14300 - DNA, 36 bp, Homo sapiens
  chr1:161471743-161471779
  hypo
gcttgagccaccgcacctggccggttctcttgaatc

SEQ ID NO: 14301 - DNA, 30 bp, Homo sapiens
  chr1:161913509-161913539
  hypo
aatcaccttttcacacgcacacaaaaagcc

SEQ ID NO: 14302 - DNA, 19 bp, Homo sapiens
  chr1:167789093-167789112
  hypo
cgcccggcatgattttcta

SEQ ID NO: 14303 - DNA, 95 bp, Homo sapiens
  chr1:167823347-167823442
  hypo
atttaggcgtgagccaccgcgcccggccatagttagacaatctttagccgagtccagtgagtcccaggcaatgttaagttcgcttacaatctgga

SEQ ID NO: 14304 - DNA, 30 bp, Homo sapiens
  chr1:168150766-168150796
  hypo
tctgtgacaaattgccgattggtgcaaaag

SEQ ID NO: 14305 - DNA, 18 bp, Homo sapiens
  chr1:171625525-171625543
  hypo
acactgacccttggccgg

SEQ ID NO: 14306 - DNA, 30 bp, Homo sapiens
  chr1:173993077-173993107
  hypo
tttcaattaaaaatacgttaaaggacagat

SEQ ID NO: 14307 - DNA, 36 bp, Homo sapiens
  chr1:175365715-175365751
  hypo
tgttgctaatgacagcgtagacgctgatgttgtagg

SEQ ID NO: 14308 - DNA, 78 bp, Homo sapiens
  chr1:175372494-175372572
  hypo
cacagacacactccccgtccacgcagagcccccgggagctgcagtctgttgggcaccggagttcggaacagtcatccc

SEQ ID NO: 14309 - DNA, 30 bp, Homo sapiens
  chr1:179849955-179849985
  hypo
aacatagtacacagtcgggcagggtggctc

SEQ ID NO: 14310 - DNA, 30 bp, Homo sapiens
  chr1:180235694-180235724
  hypo
gtgcaaggaagactacgagacagccaagca

SEQ ID NO: 14311 - DNA, 150 bp, Homo sapiens
  chr1:183129382-183129532
  hypo
caaaggaagaaagagcgcctgaagcatgtgttcaccgggcaactatgaatggcttgactgggtggagccttcagtatctttttagttaagccttttagtctcaaaaatggaagaggcaaagctcaattcttaaagatcacttcttttttt

SEQ ID NO: 14312 - DNA, 199 bp, Homo sapiens; identical to SEQ ID NO: 1543
  chr1:195732322-195732521
  hypo

SEQ ID NO: 14313 - DNA, 30 bp, Homo sapiens
  chr1:200519350-200519380
  hypo
ataagccactgcacccgacttgagtttagt

SEQ ID NO: 14314 - DNA, 30 bp, Homo sapiens
  chr1:200864028-200864058
  hypo
gcagcctgggagggacggcaaggtaggcag

SEQ ID NO: 14315 - DNA, 30 bp, Homo sapiens
  chr1:201244396-201244426
  hypo
atggggtaatgcagacgggaggctctgcca

SEQ ID NO: 14316 - DNA, 30 bp, Homo sapiens
  chr1:201797425-201797455
  hypo
tgctaggattagaggcgtgagccactgcgc

SEQ ID NO: 14317 - DNA, 42 bp, Homo sapiens
  chr1:201982442-201982484
  hypo
cgtgggtcctccctgcgccgggctgagcggcttcctggggca

SEQ ID NO: 14318 - DNA, 45 bp, Homo sapiens
  chr1:201983186-201983231
  hypo
ggacatggggacaggcgctcacactcccaccgccctctttctggc

SEQ ID NO: 14319 - DNA, 36 bp, Homo sapiens; identical to SEQ ID NO: 4956
  chr1:202081768-202081804
  hypo

SEQ ID NO: 14320 - DNA, 132 bp, Homo sapiens
  chr1:202312002-202312134
  hypo
taaaccatcttccaacgctagatgcatggtactttctgaacaaggaagaacctgtttatagttaagccaaccttaacttctcagagctgcctctgccagaggccaatgcttcatgagcgctgaaagatggca

SEQ ID NO: 14321 - DNA, 30 bp, Homo sapiens
  chr1:202995301-202995331
  hypo
tgacaattacaaggccgagactaaggccaa

SEQ ID NO: 14322 - DNA, 62 bp, Homo sapiens
  chr1:204588321-204588383
  hypo
ctaggaacttgagcccgggcacctgttccagtgcccgcctgggcacccgggccagctggttg

SEQ ID NO: 14323 - DNA, 46 bp, Homo sapiens
  chr1:204721217-204721263
  hypo
tgtagccgcccaacccgcagctacagacccacgcctcctgctgtat

SEQ ID NO: 14324 - DNA, 104 bp, Homo sapiens
  chr1:205310685-205310789
  hypo
actacaagcctgggtcgacagcaccggctcagtgccttctgttaccctattccatcaccctaattgccacctgttactgaataatctttgtttctttttctttt

SEQ ID NO: 14325 - DNA, 30 bp, Homo sapiens
  chr1:207656486-207656516
  hypo
actctcaggtagctccgagtggggagatga

SEQ ID NO: 14326 - DNA, 77 bp, Homo sapiens
  chr1:207991495-207991572
  hypo
tgtccctctgccccacgctccagcagagggggtagagaagagaaaggggaggacggtttgtccgcattcagtggcag

SEQ ID NO: 14327 - DNA, 175 bp, Homo sapiens
  chr1:209601406-209601581
  hypo
agttgcgcatggaagcgggggtggggtaaaataatcaagtttatagaccgccctctttaaagttactaatgagcttgccttctctttccttaatttcccctcgcagtgtggtcttttccccacccccagacatgaaagggaagcaggtcacaaagcctttcggattataaaagaa

SEQ ID NO: 14328 - DNA, 154 bp, Homo sapiens
  chr1:209999773-209999927
  hypo
agaactgacaagaatcgcattctaatggttttattacaacttctatggtgtgacacagtatcagggaaaacccaaatttcccacagtagcactccaatagcagagctattattttgcttctcatttctctcattttggacgctcctgttttacc

SEQ ID NO: 14329 - DNA, 31 bp, Homo sapiens; identical to SEQ ID NO: 4957
  chr1:212963970-212964001
  hypo

SEQ ID NO: 14330 - DNA, 84 bp, Homo sapiens; identical to SEQ ID NO: 4958
  chr1:213189757-213189841
  hypo

SEQ ID NO: 14331 - DNA, 20 bp, Homo sapiens
  chr1:223907539-223907559
  hypo
gcgcgcgtataatgcagtat

SEQ ID NO: 14332 - DNA, 30 bp, Homo sapiens
  chr1:224267844-224267874
  hypo
aattagaaggcttcccggagaagagtagat

SEQ ID NO: 14333 - DNA, 121 bp, Homo sapiens
  chr1:226062878-226062999
  hypo
ggcagcaaggcaccacgagaacctgtgctcgggctggcttggcctccgtaagctgggacacctcagcaagcttgtgtccaatggcaacctcagggctggactaagccgcttagctctagac

SEQ ID NO: 14334 - DNA, 93 bp, Homo sapiens
  chr1:226163122-226163215
  hypo
acaaaaataaagacatggttgtatacacagacactgaaattcctctagcggaaaacaacagcaaatgattaaagataacgttgtttgttgagg

SEQ ID NO: 14335 - DNA, 42 bp, Homo sapiens
  chr1:227750829-227750871
  hypo
ggacagttccacaggcgcaccggaatgcgcctcccctttcca

SEQ ID NO: 14336 - DNA, 30 bp, Homo sapiens
  chr1:227921541-227921571
  hypo
ctgggcctcccagtccgttctgtcaccagg

SEQ ID NO: 14337 - DNA, 284 bp, Homo sapiens
  chr1:228528888-228529172
  hypo
atctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggaggg

SEQ ID NO: 14338 - DNA, 30 bp, Homo sapiens
  chr1:228536492-228536522
  hypo
atacaaatcataagtcggtgctggttgtga

SEQ ID NO: 14339 - DNA, 30 bp, Homo sapiens
  chr1:228552593-228552623
  hypo
cctgtggcaggcatccgtcccactcgtcca

SEQ ID NO: 14340 - DNA, 539 bp, Homo sapiens
  chr1:228558699-228559238
  hypo
ctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatgga

SEQ ID NO: 14341 - DNA, 30 bp, Homo sapiens
  chr1:228919370-228919400
  hypo
ccactgcacacagaccgggtgctgggtatt

SEQ ID NO: 14342 - DNA, 30 bp, Homo sapiens
  chr1:230404233-230404263
  hypo
gcctctgctggaaagcgacacaccttacgc

SEQ ID NO: 14343 - DNA, 53 bp, Homo sapiens
  chr1:230453632-230453685
  hypo
cacaatcaagtctcccgcaggagtctcctcattacgaccgtgtatacatgggt

SEQ ID NO: 14344 - DNA, 30 bp, Homo sapiens
  chr1:231163109-231163139
  hypo
aatacagcgcagccccgcacacacctatta

SEQ ID NO: 14345 - DNA, 23 bp, Homo sapiens
  chr1:231475814-231475837
  hypo
aaggcttctaggggccgggcacg

SEQ ID NO: 14346 - DNA, 30 bp, Homo sapiens
  chr1:234621166-234621196
  hypo
cttcagtctagctcacgtatcccttacacc

SEQ ID NO: 14347 - DNA, 30 bp, Homo sapiens
  chr1:234882549-234882579
  hypo
tgtgtttctcatggtcggtccctgactcat

SEQ ID NO: 14348 - DNA, 30 bp, Homo sapiens
  chr1:234959409-234959439
  hypo
tgagtcactgtgcagcgagggctggagggc

SEQ ID NO: 14349 - DNA, 30 bp, Homo sapiens
  chr1:235267149-235267179
  hypo
ttaagtgccccagtacgctgcacatttaga

SEQ ID NO: 14350 - DNA, 96 bp, Homo sapiens
  chr1:235325416-235325512
  hypo
agaaaagaaattagacgggcaccttcgcgctcggcgcctgtagtcccagcactttgagaggctcgggcaagaggatcccttgagccctggaaggtc

SEQ ID NO: 14351 - DNA, 169 bp, Homo sapiens
  chr1:240463082-240463251
  hypo
agataatgcatactgcgatgaacccaagatggacctaagattacagaactagtagtagtttattttttggtgcacaaagcggaacaagtttttccatgttttcagttgctaatagactgcatttttacgcaagactagtaggaataaggtggcgcgctgtatgaaggca

SEQ ID NO: 14352 - DNA, 177 bp, Homo sapiens
  chr1:242286750-242286927
  hypo
aggaggacatcccatcgcagagcacactcacacacacattcacactcgcttacactgggaccactcacacacacattcacactcgctcacactgggaccacacagatctgccagttcattccacttgcacagctctgagatgtgggaggaaacagcagtacccggcaaaagccaaca

SEQ ID NO: 14353 - DNA, 30 bp, Homo sapiens
  chr1:243057075-243057105
  hypo
ggtgcggttaccgctcgctcacacctgtaa

SEQ ID NO: 14354 - DNA, 30 bp, Homo sapiens
  chr1:244143029-244143059
  hypo
gacggaaggtacccacgagggtggcgggtg

SEQ ID NO: 14355 - DNA, 143 bp, Homo sapiens; identical to SEQ ID NO: 4959
  chr1:245135719-245135862
  hypo

SEQ ID NO: 14356 - DNA, 197 bp, Homo sapiens
  chr1:245772643-245772840
  hypo
cttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgctt

SEQ ID NO: 14357 - DNA, 30 bp, Homo sapiens
  chr1:245986707-245986737
  hypo
tgcaccttgggaaggcgatgaaatgaaaga

SEQ ID NO: 14358 - DNA, 30 bp, Homo sapiens
  chr1:246172269-246172299
  hypo
accgcttgctagcagcgtggccttgggcaa

SEQ ID NO: 14359 - DNA, 30 bp, Homo sapiens
  chr1:247589929-247589959
  hypo
gactgcccacagggccgcagtggtggtgaa

SEQ ID NO: 14360 - DNA, 172 bp, Homo sapiens
  chr1:247709336-247709508
  hypo
ggtagcataaatgtacgcatatgtccaaactcatcaaattatgtacattaattatattcacgttcttttatatcaatatatcaacaaagctaggaaagaaagaaataaatttttgtttgttcgttttgttttgttttgtctaatgatgggacggtttcgctctgttgctcag

SEQ ID NO: 14361 - DNA, 180 bp, Homo sapiens
  chr1:247752018-247752198
  hypo
gtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcat

SEQ ID NO: 14362 - DNA, 30 bp, Homo sapiens
  chr1:248028015-248028045
  hypo
gaaatgcagaggcagcgcttcagattggag

SEQ ID NO: 14363 - DNA, 47 bp, Homo sapiens
  chr1:248074880-248074927
  hypo
gcagagggtgtacaccgcctctgtaatatccacgggggaaaaggatg

SEQ ID NO: 14364 - DNA, 87 bp, Homo sapiens
  chr1:248099843-248099930
  hypo
tcactgacttctcatcgctcctgtgctcgctgtagacggtgtttaactcagaatccacatgcaggatgttctcggttttcaggtgtg

SEQ ID NO: 14365 - DNA, 151 bp, Homo sapiens
  chr1:248328690-248328841
  hypo
gctccgtctgagacccgtgctaggctcgctctgtccctgcgttccctcgcctctctctccagttgtttttcccattctcacaccagcactgcaccaaggtgagaggagccccgctggaaaggaaacattcggactccggtttcagcacctc

SEQ ID NO: 14366 - DNA, 100 bp, Homo sapiens
  chr2:314569-314669
  hypo
ctacgctcacagctgcggacgtgcacgcgctgccagcaactgcaccgagcactcagcgcacacctgctcccacgcgccacgcactcgtgcaggtgccggg

SEQ ID NO: 14367 - DNA, 30 bp, Homo sapiens
  chr2:484928-484958
  hypo
tgctgagactgcaggcgcttcatggcgcgt

SEQ ID NO: 14368 - DNA, 44 bp, Homo sapiens
  chr2:496214-496258
  hypo
gaagctacaggaggccgagcggctgttgacgcccaggaccgtgg

SEQ ID NO: 14369 - DNA, 61 bp, Homo sapiens
  chr2:720836-720897
  hypo
ctcagtgcttctgtgcgtgactcagtgactttggcaacgcggccgccgacaaactcacatt

SEQ ID NO: 14370 - DNA, 30 bp, Homo sapiens
  chr2:1893031-1893061
  hypo
tcctcgtctatcctccggggtttcattttg

SEQ ID NO: 14371 - DNA, 189 bp, Homo sapiens
  chr2:2522670-2522859
  hypo
ttcaagtcccagctccgccactgctgaggaactggctcttaggaaagtcattgaaacttcagcttcatgaagttcacatggaaaacagaaatagccgcatctattgctgtaaggctgctgtgaaagtttaagcctgtcgtgcatacagtggcccttggcatgcaccaaacctgccggtggaaacacagt

SEQ ID NO: 14372 - DNA, 64 bp, Homo sapiens
  chr2:2725048-2725112
  hypo
tgcatctccacaccccggccatgccatcggcacctgcacctccacaccccggccacgccaccag

SEQ ID NO: 14373 - DNA, 30 bp, Homo sapiens
  chr2:3331786-3331816
  hypo
gtaaaaaagagctcccgatgtgtagacaag

SEQ ID NO: 14374 - DNA, 61 bp, Homo sapiens
  chr2:3833825-3833886
  hypo
tgtcccgcctgtgcacggaacctctgatgtggatgtttcccgcccccgccctccacgtgca

SEQ ID NO: 14375 - DNA, 57 bp, Homo sapiens
  chr2:5704308-5704365
  hypo
cacctgtgtgacacccgggtactccaccacctgtgcgacacccgggcactccaccac

SEQ ID NO: 14376 - DNA, 30 bp, Homo sapiens
  chr2:7036178-7036208
  hypo
tgattttctgctgcacgtggcatctgatta

SEQ ID NO: 14377 - DNA, 272 bp, Homo sapiens
  chr2:7172487-7172759
  hypo
ccttgcagctctgctcgaatccgcgccccttgcagctctgctctggctgctgtgacaaagcgctgcagactgggtggctcagaacagcagaaatgtattggctcagtcctggagctcagaattctgaaatcgaggtgtcagcagggccctgcctgctctgaaacctgtaggagagtccctccggccttgtccagcttctgtggttcgccagccatctgcggcattcctggacagatcgatgcgtcactgcaatcctccgtcttcctccggct

SEQ ID NO: 14378 - DNA, 171 bp, Homo sapiens
  chr2:8833973-8834144
  hypo
ctctctctgagagctcggggggtttctgtctcctgacggggccctgactggtaccccaggctccatgagagcaccgtggacaacaggagcagccgaacacgcagaatctgcgggaaggggaatcgggcagtgggtgcggcccgtgcaaaggcccggcggcagcagccatcc

SEQ ID NO: 14379 - DNA, 30 bp, Homo sapiens
  chr2:8834800-8834830
  hypo
gcaacggaaattattcgtagtaattattaa

SEQ ID NO: 14380 - DNA, 24 bp, Homo sapiens
  chr2:8835577-8835601
  hypo
gattccaggcgtgaccccctgcgc

SEQ ID NO: 14381 - DNA, 92 bp, Homo sapiens
  chr2:8978147-8978239
  hypo
cttgctgccaacaagcgtcaatcttgatttttgaaaaggtccaaggatgattacgacgtgcgtaggttgcgaaccatcgaaaagcacccacc

SEQ ID NO: 14382 - DNA, 30 bp, Homo sapiens; identical to SEQ ID NO: 4960
  chr2:9134404-9134434
  hypo

SEQ ID NO: 14383 - DNA, 180 bp, Homo sapiens
  chr2:9352635-9352815
  hypo
aggtggtggccagctcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatga

SEQ ID NO: 14384 - DNA, 420 bp, Homo sapiens; identical to SEQ ID NO: 4961
  chr2:10153023-10153443
  hypo

SEQ ID NO: 14385 - DNA, 240 bp, Homo sapiens; identical to SEQ ID NO: 4962
  chr2:10153898-10154138
  hypo

SEQ ID NO: 14386 - DNA, 120 bp, Homo sapiens; identical to SEQ ID NO: 4963
  chr2:10154318-10154438
  hypo

SEQ ID NO: 14387 - DNA, 120 bp, Homo sapiens; identical to SEQ ID NO: 4964
  chr2:10154918-10155038
  hypo

SEQ ID NO: 14388 - DNA, 80 bp, Homo sapiens; identical to SEQ ID NO: 1544
  chr2:10156306-10156386
  hypo

SEQ ID NO: 14389 - DNA, 77 bp, Homo sapiens
  chr2:10344641-10344718
  hypo
cactggctgtgaccccgccagccctgctcagcgctgtgcccagccctgggtgcagggaggtgcggtttgctctcaga

SEQ ID NO: 14390 - DNA, 136 bp, Homo sapiens
  chr2:10924927-10925063
  hypo
ctcttaaaaggcccacgggtgcaccagggctgaggtctgatgggaaggacttgactccaggtgcagagatgcacaggctcaagagagtaaaccaggactgctgcccgcacagcttccctcccgggcactcacctcg

SEQ ID NO: 14391 - DNA, 30 bp, Homo sapiens
  chr2:11538637-11538667
  hypo
cagtcaatagttctccgttctggaaaccga

SEQ ID NO: 14392 - DNA, 30 bp, Homo sapiens
  chr2:18453289-18453319
  hypo
cgtgtagcaagaggccggggtctggtctgc

SEQ ID NO: 14393 - DNA, 23 bp, Homo sapiens
  chr2:20253274-20253297
  hypo
taagatcaggggagccgggcgcg

SEQ ID NO: 14394 - DNA, 42 bp, Homo sapiens
  chr2:20431336-20431378
  hypo
tacgtaaacagctagcgtcagaggggccgaatcagtgtgtaa

SEQ ID NO: 14395 - DNA, 142 bp, Homo sapiens
  chr2:20432683-20432825
  hypo
ggagattctaaagcccgcaggggagaatctgggctgggctctgaagagattcctgagctcaccgcagccaggatgtataagtcatagtgttatgtcagcgctcatacctgtgtgtagcacatgtgcacgcaccttcacgcac

SEQ ID NO: 14396 - DNA, 30 bp, Homo sapiens
  chr2:20456198-20456228
  hypo
tgtatgttgaaacaacgtagtgatgctgaa

SEQ ID NO: 14397 - DNA, 39 bp, Homo sapiens; identical to SEQ ID NO: 1545
  chr2:20642609-20642648
  hypo

SEQ ID NO: 14398 - DNA, 30 bp, Homo sapiens
  chr2:25241776-25241806
  hypo
gacttttcaactttacgatggtgcaaaagc

SEQ ID NO: 14399 - DNA, 42 bp, Homo sapiens
  chr2:27090590-27090632
  hypo
gggattacaggcgtgagccaccgcgcccggcccccaattgtt

SEQ ID NO: 14400 - DNA, 141 bp, Homo sapiens
  chr2:27887525-27887666
  hypo
gaatctcccactcagcgattacgaaagtgaaggaatcaagtctggcctatcatcttcagacggctgtacacattgctatatttctgaaagtcatgttcacaatcccgaactctaaaataacttgtttggccaggcgcggtg

SEQ ID NO: 14401 - DNA, 22 bp, Homo sapiens
  chr2:32263988-32264010
  hypo
tgataggcgtgggccatcgcgc

SEQ ID NO: 14402 - DNA, 40 bp, Homo sapiens
  chr2:32504305-32504345
  hypo
ctgggattaccggcgtgagccaccgcgccccggccatttt

SEQ ID NO: 14403 - DNA, 27 bp, Homo sapiens
  chr2:32551637-32551664
  hypo
tgtgagccaccgcgcccagcctaccct

SEQ ID NO: 14404 - DNA, 45 bp, Homo sapiens
  chr2:33313226-33313271
  hypo
atatggacagtgagccgggcgcggtggctcacgcctgtaatccca

SEQ ID NO: 14405 - DNA, 34 bp, Homo sapiens
  chr2:36824207-36824241
  hypo
ccccaccagaccatgcgatcgttaccatcagtaa

SEQ ID NO: 14406 - DNA, 189 bp, Homo sapiens; identical to SEQ ID NO: 4967
  chr2:43408168-43408357
  hypo

SEQ ID NO: 14407 - DNA, 39 bp, Homo sapiens
  chr2:43412683-43412722
  hypo
ttagaaaaaggtggccgggcgtggtgactcacgcctata

SEQ ID NO: 14408 - DNA, 40 bp, Homo sapiens
  chr2:43824353-43824393
  hypo
ctgggattacaggcgtgagccatggcgcccggaccgtaat

SEQ ID NO: 14409 - DNA, 34 bp, Homo sapiens
  chr2:44224213-44224247
  hypo
caaaacaaaaaaaccacgtcgctgccttcacagg

SEQ ID NO: 14410 - DNA, 240 bp, Homo sapiens; identical to SEQ ID NO: 1546
  chr2:47598278-47598518
  hypo

SEQ ID NO: 14411 - DNA, 42 bp, Homo sapiens; identical to SEQ ID NO: 1547
  chr2:47598578-47598620
  hypo

SEQ ID NO: 14412 - DNA, 36 bp, Homo sapiens
  chr2:55669245-55669281
  hypo
tggagccaagatggccgaataggaacagctccggtc

SEQ ID NO: 14413 - DNA, 30 bp, Homo sapiens
  chr2:60442223-60442253
  hypo
gtgggttttcttccccgaaatcattttccc

SEQ ID NO: 14414 - DNA, 110 bp, Homo sapiens
  chr2:60705907-60706017
  hypo
ggcctcctcccatgacggcaagtccttctttcagaaaacaggcctctgcccggggcatgctgcagctgcttctctgcagtgcctcagcaccttcccgcctcccaggcaca

SEQ ID NO: 14415 - DNA, 30 bp, Homo sapiens
  chr2:60887794-60887824
  hypo
agtctcgcctgtgcccgggagacaatgggc

SEQ ID NO: 14416 - DNA, 30 bp, Homo sapiens
  chr2:61406196-61406226
  hypo
ccgcggcgagatcaacgagttgaagcaggt

SEQ ID NO: 14417 - DNA, 86 bp, Homo sapiens; identical to SEQ ID NO: 4970
  chr2:62589799-62589885
  hypo

SEQ ID NO: 14418 - DNA, 76 bp, Homo sapiens
  chr2:64835557-64835633
  hypo
gctggggatagaacacgggtggctacgccgggcatggtggtgcgcacctgcagtcctggctgctggagaagctgag

SEQ ID NO: 14419 - DNA, 24 bp, Homo sapiens
  chr2:67625740-67625764
  hypo
tacagccaccgcgcccggccacct

SEQ ID NO: 14420 - DNA, 20 bp, Homo sapiens
  chr2:69720191-69720211
  hypo
gaggcaggagaatggcgtga

SEQ ID NO: 14421 - DNA, 48 bp, Homo sapiens
  chr2:70364215-70364263
  hypo
tgttttaattttctccgtagcacttgtcactatcgacatactagatag

SEQ ID NO: 14422 - DNA, 30 bp, Homo sapiens
  chr2:70367818-70367848
  hypo
agacaccgtgcccagcgacaagataatttt

SEQ ID NO: 14423 - DNA, 75 bp, Homo sapiens
  chr2:72778920-72778995
  hypo
ggccattaaaatcttaatagcttataaaaactagcatacacacagtgatgagatacaatgcggtcatactataat

SEQ ID NO: 14424 - DNA, 88 bp, Homo sapiens
  chr2:74010538-74010626
  hypo
gtcaacgaactttgccgttcaaccaagttacaaaagaaggctctttaatcccttctttggcccttaaaagcggcagcagggccgggcg

SEQ ID NO: 14425 - DNA, 160 bp, Homo sapiens; identical to SEQ ID NO: 1549
  chr2:74454159-74454319
  hypo

SEQ ID NO: 14426 - DNA, 25 bp, Homo sapiens
  chr2:74700453-74700478
  hypo
tttctttttttgagacgaagttttg

SEQ ID NO: 14427 - DNA, 28 bp, Homo sapiens
  chr2:85838295-85838323
  hypo
actccagcctgggcgacagagacctagt

SEQ ID NO: 14428 - DNA, 43 bp, Homo sapiens; identical to SEQ ID NO: 4973
  chr2:86423726-86423769
  hypo

SEQ ID NO: 14429 - DNA, 140 bp, Homo sapiens; identical to SEQ ID NO: 4974
  chr2:88990189-88990329
  hypo

SEQ ID NO: 14430 - DNA, 30 bp, Homo sapiens
  chr2:95742145-95742175
  hypo
acaatcggtcgggagcggtggctcacgcct

SEQ ID NO: 14431 - DNA, 70 bp, Homo sapiens
  chr2:95941782-95941852
  hypo
cggcgctgcgggggacgagtgaagacagagcacaaggcgctggcctgtgagcgcgcggccctcatggtct

SEQ ID NO: 14432 - DNA, 24 bp, Homo sapiens
  chr2:96872240-96872264
  hypo
cttaaaagtggaacacggccgggc

SEQ ID NO: 14433 - DNA, 92 bp, Homo sapiens; identical to SEQ ID NO: 1550
  chr2:97427763-97427855
  hypo

SEQ ID NO: 14434 - DNA, 30 bp, Homo sapiens
  chr2:97428063-97428093
  hypo
gcttctataaccacccggtgcactttgtct

SEQ ID NO: 14435 - DNA, 30 bp, Homo sapiens
  chr2:98025687-98025717
  hypo
gtgcttattgggccccgcttctggagaaac

SEQ ID NO: 14436 - DNA, 100 bp, Homo sapiens; identical to SEQ ID NO: 1551
  chr2:99798646-99798746
  hypo

SEQ ID NO: 14437 - DNA, 28 bp, Homo sapiens
  chr2:101835069-101835097
  hypo
gcatgagccaccgcgcccagcctagtca

SEQ ID NO: 14438 - DNA, 157 bp, Homo sapiens
  chr2:105972350-105972507
  hypo
gccagcaaaccaatgcgtaaatgaacatacatggctgtgtttgaataaaacttttttgttaagaaaacagaccaggtgtgatgactcatgctggtaatcccagcgttttggaatgccaagatggggggaatcgcttgagcccaggagtttgagacca

SEQ ID NO: 14439 - DNA, 191 bp, Homo sapiens
  chr2:106016141-106016332
  hypo
cccacattccaagcccgggccctctgcgtgacgctgacgctgggtagggacagatggcactgttcagcattgtcgcagggagagcacaggttgagcccatccctgggagagggtgcgtcgtgatggaaacatttgctcctgagcaggtaaccggtccacttgcagaaaccggtggacgatgagtaggtgga

SEQ ID NO: 14440 - DNA, 177 bp, Homo sapiens
  chr2:106060615-106060792
  hypo
ttttaggagggagtgcgtggaccgataccattttttgtaagctgaaaagagtgtagaccaaggaaagtgttgtttttctggactggaaagtcctcagatgcagaaccagtgtgtgttggggtgcagaggatgagtggtttgtgaaccgcgttgcctaccaagcgcctgtctgcagaa

SEQ ID NO: 14441 - DNA, 30 bp, Homo sapiens
  chr2:106672847-106672877
  hypo
gtctatccttagtgtcgactgttaagttgc

SEQ ID NO: 14442 - DNA, 169 bp, Homo sapiens
  chr2:106959338-106959507
  hypo
acactccctgcctctcgaggactctgcttgttcctcatcacagcacggttgctctcgcacccaaggcggtgtccccccagcgcctcaccacgatcgcggcagagatctcctgcagggcgtccgggccttgggaaggcatcgccatctcccgcagcgccctcccggacta

SEQ ID NO: 14443 - DNA, 127 bp, Homo sapiens
  chr2:106959916-106960043
  hypo
gggctctggatccagcggtcacggtttcactgagagggcgcctcccaggggctgctccggcccagggcagggcattgcaggggtgatgggacagccctgcttttgagaggcgcggcactctgccaag

SEQ ID NO: 14444 - DNA, 183 bp, Homo sapiens
  chr2:107460171-107460354
  hypo
aaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatga

SEQ ID NO: 14445 - DNA, 30 bp, Homo sapiens
  chr2:108160895-108160925
  hypo
cggtgcactgagaagcggatgtgaaactga

SEQ ID NO: 14446 - DNA, 33 bp, Homo sapiens
  chr2:109335133-109335166
  hypo
ctggaaccaatcccccgccgagatgactgttta

SEQ ID NO: 14447 - DNA, 30 bp, Homo sapiens
  chr2:113013287-113013317
  hypo
attccttagaaatagcgtttcacatgttag

SEQ ID NO: 14448 - DNA, 30 bp, Homo sapiens
  chr2:113103393-113103423
  hypo
gcatcccgggcagagcgcagctgcgcagca

SEQ ID NO: 14449 - DNA, 31 bp, Homo sapiens
  chr2:114515528-114515559
  hypo
aaaaaccaaccaggccggtcgcggtggctca

SEQ ID NO: 14450 - DNA, 396 bp, Homo sapiens
  chr2:120980096-120980492
  hypo
ctgcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgcgggcccaaacgcccgcgcccacggaggcgcctgcgacgactagaagcttccacagccatatgggggcaaagacggcccagtagctccattggatgatgccgtccaggcggaggggcagcagcaccgagaagagcagcag

SEQ ID NO: 14451 - DNA, 223 bp, Homo sapiens; identical to SEQ ID NO: 4978
  chr2:122495312-122495535
  hypo

SEQ ID NO: 14452 - DNA, 135 bp, Homo sapiens
  chr2:127422944-127423079
  hypo
tttatcatagttattcgcatataggaaaactatcatgtatgtaaggttcagtcgtatctctggtttcaggcatccgctgggggtcttggaaagcatcccccataggtaagggggaaccaccgattcatgggacag

SEQ ID NO: 14453 - DNA, 45 bp, Homo sapiens
  chr2:127423305-127423350
  hypo
cactctgccctgctccgcacctagtgaggacgtgtaacacacaca

SEQ ID NO: 14454 - DNA, 59 bp, Homo sapiens; identical to SEQ ID NO: 4979
  chr2:127428985-127429044
  hypo

SEQ ID NO: 14455 - DNA, 40 bp, Homo sapiens
  chr2:127435251-127435291
  hypo
gtatgtgttgcctgccgtaatccttcgctagggatgagca

SEQ ID NO: 14456 - DNA, 30 bp, Homo sapiens
  chr2:127438110-127438140
  hypo
aaagtctgtggccagcggccctgtgattcc

SEQ ID NO: 14457 - DNA, 30 bp, Homo sapiens
  chr2:127438702-127438732
  hypo
aaaccactcctaacccgtctacttcttaaa

SEQ ID NO: 14458 - DNA, 63 bp, Homo sapiens
  chr2:127801172-127801235
  hypo
aggagcaaacctgcccggctgcattccgccctcccgctgccctaggcccgctataggctggat

SEQ ID NO: 14459 - DNA, 21 bp, Homo sapiens
  chr2:128616617-128616638
  hypo
aaaaatgaattgtgccgggca

SEQ ID NO: 14460 - DNA, 39 bp, Homo sapiens; identical to SEQ ID NO: 1553
  chr2:128847684-128847723
  hypo

SEQ ID NO: 14461 - DNA, 22 bp, Homo sapiens
  chr2:131114462-131114484
  hypo
tataaagattctaaacgtgggc

SEQ ID NO: 14462 - DNA, 151 bp, Homo sapiens
  chr2:131477785-131477936
  hypo
caggcagaggggcagcgcgtgggtggactctgggctgggcatgggcggggtgtgctgagcagaggacagtgggtggggcagctgccgccctgcagggagggtagccacagggctttgcagaccaggacaccagctgcgatgactttaatta

SEQ ID NO: 14463 - DNA, 261 bp, Homo sapiens
  chr2:131967115-131967376
  hypo
gctcttaagtgtgggcgtttggtaaccggcatggctgctacctgtttctggctggagcctcggacactggctcactgcagttggtggtgtccacagagcggtaggagggcaactagtagcgggagcttctcctgccaggcaggaagacgagtagaagggagcagcaccgacgcatgctggaggctggagcctgagcccctggggctcgccttgctgtgtttggtggtgacgtgggacactgcagctcggccagagtggtag

SEQ ID NO: 14464 - DNA, 19 bp, Homo sapiens
  chr2:145167762-145167781
  hypo
accgcgcccagccataaaa

SEQ ID NO: 14465 - DNA, 98 bp, Homo sapiens
  chr2:148776775-148776873
  hypo
gcaatgatgcataaacggggtccactgcccaaacttacagaaagcaaaacgtggaaaattagtaactttaactgatagtgtacacctaaagaacctac

SEQ ID NO: 14466 - DNA, 34 bp, Homo sapiens
  chr2:152266037-152266071
  hypo
aggtgtgagtcaccgcgcccggccagctcttagt

SEQ ID NO: 14467 - DNA, 66 bp, Homo sapiens
  chr2:170282975-170283041
  hypo
tggcccagagccaggcgggagcgtcagtaccgcgcactgttaacagcggcccgacaaacccagcaa

SEQ ID NO: 14468 - DNA, 41 bp, Homo sapiens; identical to SEQ ID NO: 4982
  chr2:170551801-170551842
  hypo

SEQ ID NO: 14469 - DNA, 27 bp, Homo sapiens
  chr2:170681885-170681912
  hypo
agaggcagggcgcggcggctcacgcct

SEQ ID NO: 14470 - DNA, 27 bp, Homo sapiens
  chr2:170682152-170682179
  hypo
agagcgagactccgtctcaaaaaaaaa

SEQ ID NO: 14471 - DNA, 74 bp, Homo sapiens
  chr2:172367021-172367095
  hypo
tctcattagctcagacgcatgcagggaggcggggtctgggaaatgtaaagtccagtttacgtgacaccatacaa

SEQ ID NO: 14472 - DNA, 30 bp, Homo sapiens
  chr2:172411136-172411166
  hypo
agaccgcaatggaaacgtcctaaggagcca

SEQ ID NO: 14473 - DNA, 20 bp, Homo sapiens
  chr2:173036684-173036704
  hypo
caccgcgcccagcccaataa

SEQ ID NO: 14474 - DNA, 38 bp, Homo sapiens
  chr2:177498112-177498150
  hypo
gtgagtgtatggctccgggcttttcttttctttttttt

SEQ ID NO: 14475 - DNA, 38 bp, Homo sapiens; identical to SEQ ID NO: 4985
  chr2:179317019-179317057
  hypo

SEQ ID NO: 14476 - DNA, 32 bp, Homo sapiens
  chr2:180886813-180886845
  hypo
atatcacacccacatcgcggggggtgggaggg

SEQ ID NO: 14477 - DNA, 30 bp, Homo sapiens
  chr2:188236072-188236102
  hypo
aataaatggacgtaccgtgagttaagagag

SEQ ID NO: 14478 - DNA, 30 bp, Homo sapiens
  chr2:200524640-200524670
  hypo
tatgctgatgctcctcggagtcagtaataa

SEQ ID NO: 14479 - DNA, 30 bp, Homo sapiens
  chr2:203129332-203129362
  hypo
ttaacaaaataatatcgtgaagtttttccc

SEQ ID NO: 14480 - DNA, 23 bp, Homo sapiens
  chr2:203484340-203484363
  hypo
tgccatatcgggtgcaccagtta

SEQ ID NO: 14481 - DNA, 86 bp, Homo sapiens
  chr2:207557814-207557900
  hypo
agaaagattgctggccggttaccataacacccagggcccttggtggctgctctgtgggatcagccaatcctcgcagccactcacct

SEQ ID NO: 14482 - DNA, 30 bp, Homo sapiens
  chr2:220316287-220316317
  hypo
gagattctcagtgggcgcctgtgggccgtg

SEQ ID NO: 14483 - DNA, 30 bp, Homo sapiens
  chr2:223764711-223764741
  hypo
agccctcaccaaagacggagtcgctctggt

SEQ ID NO: 14484 - DNA, 30 bp, Homo sapiens
  chr2:230795535-230795565
  hypo
tgctggagccctcctcgaggtgtgctgtgg

SEQ ID NO: 14485 - DNA, 30 bp, Homo sapiens
  chr2:232485651-232485681
  hypo
cgttgttcctcatagcggcatctccgcagt

SEQ ID NO: 14486 - DNA, 30 bp, Homo sapiens
  chr2:233750505-233750535
  hypo
gtgacacatggggcccggcacagggccagg

SEQ ID NO: 14487 - DNA, 30 bp, Homo sapiens
  chr2:233960620-233960650
  hypo
taaataggataataccgtatacactgttct

SEQ ID NO: 14488 - DNA, 123 bp, Homo sapiens
  chr2:234109988-234110111
  hypo
cttggtgcataacaacgagcacacagcttggtgggagcatgctccccacagccccatggtgacagctgcagacaggctgccatccacgggcaaggggcccccagggtacgcttctaactcact

SEQ ID NO: 14489 - DNA, 165 bp, Homo sapiens
  chr2:234369732-234369897
  hypo
agccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggt

SEQ ID NO: 14490 - DNA, 67 bp, Homo sapiens
  chr2:239051088-239051155
  hypo
gcagtgactgcttaccggccgttcctaagacagccagcatttcccactgagccgggacaccctcgtg

SEQ ID NO: 14491 - DNA, 161 bp, Homo sapiens
  chr2:239957287-239957448
  hypo
tcctgcgggctcccccgtgggccaagtctcctaaactgggccagcctggagtcaggtgcgtgcagccctgccactctacctccttgcagcgaggcctggagggcgttccacgcgtgggcaccgcggccttcggaggcctccagagtcggcctcagtgggcg

SEQ ID NO: 14492 - DNA, 48 bp, Homo sapiens
  chr2:239997539-239997587
  hypo
ctccccttggtttcccgggaaacaaagctgggccgggatagcaggtgg

SEQ ID NO: 14493 - DNA, 30 bp, Homo sapiens
  chr2:240103944-240103974
  hypo
atctcctcgtcatggcgagcccctcccctc

SEQ ID NO: 14494 - DNA, 298 bp, Homo sapiens; identical to SEQ ID NO: 4986
  chr2:240168811-240169109
  hypo

SEQ ID NO: 14495 - DNA, 32 bp, Homo sapiens
  chr2:240658352-240658384
  hypo
ctgtgtttgggtcaacgcgcccctgtgtgctc

SEQ ID NO: 14496 - DNA, 30 bp, Homo sapiens
  chr2:240658886-240658916
  hypo
ggtcgcagcagggcacggggggcagggagt

SEQ ID NO: 14497 - DNA, 126 bp, Homo sapiens
  chr2:240809527-240809653
  hypo
ggacacctgtcactccgacggagaatcctggacaggcagcctcacccgggacacctgtcattccgaaggagaatcctggacatgcagcctcacctgggacacctgtcactccgatggagaatcctg

SEQ ID NO: 14498 - DNA, 148 bp, Homo sapiens
  chr2:241095637-241095785
  hypo
ccttacacaaaaagccgtcgccgtctgcctcttgttctgattctttgttcccaccttacaaaacctgctgttctgccattgcctggtgggagttctcattgtgttttgtagaaacagaatcggagctctgccccgattcatgaagagt

SEQ ID NO: 14499 - DNA, 30 bp, Homo sapiens
  chr2:241544980-241545010
  hypo
ttctggggtgagtgtcgagatcctgtgtcc

SEQ ID NO: 14500 - DNA, 58 bp, Homo sapiens
  chr2:241722184-241722242
  hypo
cagggccgcccttcccgggcccaggcctgggctgcctgctgcacggggccaactgtgg

SEQ ID NO: 14501 - DNA, 247 bp, Homo sapiens
  chr2:241864987-241865234
  hypo
gtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatatgaagaaggccaatgacgcgctgggccgggagctggccggg

SEQ ID NO: 14502 - DNA, 46 bp, Homo sapiens
  chr2:242004922-242004968
  hypo
ggcctacaacatctccgtcttctcagtgaagcgaaacagtaacaac

SEQ ID NO: 14503 - DNA, 43 bp, Homo sapiens
  chr2:242009609-242009652
  hypo
atcacctgtgagtgccgtgggccctgcgcgtgggcggggccag

SEQ ID NO: 14504 - DNA, 30 bp, Homo sapiens
  chr2:242436356-242436386
  hypo
tgagcctcctgtcaccgggtgtcacccacc

SEQ ID NO: 14505 - DNA, 53 bp, Homo sapiens; identical to SEQ ID NO: 4987
  chr2:242524008-242524061
  hypo

SEQ ID NO: 14506 - DNA, 120 bp, Homo sapiens; identical to SEQ ID NO: 4988
  chr2:242636861-242636981
  hypo

SEQ ID NO: 14507 - DNA, 91 bp, Homo sapiens; identical to SEQ ID NO: 4989
  chr2:242637041-242637132
  hypo

SEQ ID NO: 14508 - DNA, 33 bp, Homo sapiens
  chr2:242672951-242672984
  hypo
aggacaaatccagctcgccggttttctgtgtga

SEQ ID NO: 14509 - DNA, 430 bp, Homo sapiens
  chr2:242756110-242756540
  hypo
ggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctccc

SEQ ID NO: 14510 - DNA, 52 bp, Homo sapiens
  chr2:242757509-242757561
  hypo
cttcgccttctacagcgatgaccacggccgcacctggcgctgtggaggcctc

SEQ ID NO: 14511 - DNA, 36 bp, Homo sapiens
  chr2:242794906-242794942
  hypo
ggcagttgtgtgacacggaagcggcagtcctggccg

SEQ ID NO: 14512 - DNA, 207 bp, Homo sapiens
  chr2:242832984-242833191
  hypo
caccaacagtccctgcggggacctttcccggacacccggccttctcggcggtgaggcaggtggcggcaccgacaggcccgggggggacctttcccggacacccagcctcctcggtggcgaggcaggtggcggcaccgacaggcccggcggggacctttcccggacacctggcctccttggcaaggcaggtggcggcaccaacaggcc

SEQ ID NO: 14513 - DNA, 63 bp, Homo sapiens
  chr2:242833525-242833588
  hypo
caggagctcagaccccggcatcagaccggcctccgcagggaggagctgcggtgcccaggccag

SEQ ID NO: 14514 - DNA, 32 bp, Homo sapiens
  chr2:242833797-242833829
  hypo
ctgcccaggtcttcacgcgcctaactgagcgt

SEQ ID NO: 14515 - DNA, 39 bp, Homo sapiens
  chr2:242836486-242836525
  hypo
gagcctggggcagggcgataatttcggcattgtgagtca

SEQ ID NO: 14516 - DNA, 145 bp, Homo sapiens; identical to SEQ ID NO: 4990
  chr2:242925496-242925641
  hypo

SEQ ID NO: 14517 - DNA, 47 bp, Homo sapiens
  chr2:242985116-242985163
  hypo
aggactgagcaggtgcggctgttacctgaggacggagcaggtgcggc

SEQ ID NO: 14518 - DNA, 30 bp, Homo sapiens
  chr3:3167687-3167717
  hypo
gaggcctggggaacacgaggtcaggagttc

SEQ ID NO: 14519 - DNA, 49 bp, Homo sapiens
  chr3:10182868-10182917
  hypo
ttcccgtgtgagatgcgccaccctcgaaccttgttacgacgtcggcaca

SEQ ID NO: 14520 - DNA, 30 bp, Homo sapiens
  chr3:12586227-12586257
  hypo
ttttgtttatgctagcgctctcagcaagag

SEQ ID NO: 14521 - DNA, 72 bp, Homo sapiens
  chr3:13679132-13679204
  hypo
agctcaacttccagacgggcctcctggtgcctgcgcatatcttccgcattggccccgcgccagccttcacgg

SEQ ID NO: 14522 - DNA, 30 bp, Homo sapiens
  chr3:13680779-13680809
  hypo
cttgccggaagcctgcggtgggggccctct

SEQ ID NO: 14523 - DNA, 30 bp, Homo sapiens
  chr3:17001303-17001333
  hypo
tgtaagaaggtccaccgggtgctgtggctc

SEQ ID NO: 14524 - DNA, 66 bp, Homo sapiens
  chr3:17499802-17499868
  hypo
tggtaattgttgcagcgcttctgacaaaatatagctttgttccagagtccacgtggagattattcc

SEQ ID NO: 14525 - DNA, 95 bp, Homo sapiens
  chr3:32151324-32151419
  hypo
catggaagataagaccgaaggaattgccaagtggaatggagtaactgctctgttacactttaaatcgtgtttctttttttgtttgtttgtttttg

SEQ ID NO: 14526 - DNA, 163 bp, Homo sapiens
  chr3:33841159-33841322
  hypo
taagaacattttttacgattttatagttaaacatttcttttgcataccttgttaatctcgttttctccgtatagtatattctacttgtttcacaggagaatcacaattgtattccaatccaagtagcagaaacccaggctaaactagcttgagctaagaaaag

SEQ ID NO: 14527 - DNA, 37 bp, Homo sapiens
  chr3:40501058-40501095
  hypo
tatgttggccgggcgcggtggctcacgcctataatcc

SEQ ID NO: 14528 - DNA, 45 bp, Homo sapiens; identical to SEQ ID NO: 4991
  chr3:42640855-42640900
  hypo

SEQ ID NO: 14529 - DNA, 21 bp, Homo sapiens
  chr3:43664372-43664393
  hypo
tttgagatagagcctcgcaat

SEQ ID NO: 14530 - DNA, 30 bp, Homo sapiens
  chr3:45885052-45885082
  hypo
agggaatgaaaggagcgtgtgtataatgca

SEQ ID NO: 14531 - DNA, 22 bp, Homo sapiens
  chr3:47555871-47555893
  hypo
gccgacacggaattatatcttg

SEQ ID NO: 14532 - DNA, 33 bp, Homo sapiens; identical to SEQ ID NO: 4992
  chr3:48236539-48236572
  hypo

SEQ ID NO: 14533 - DNA, 170 bp, Homo sapiens
  chr3:48636676-48636846
  hypo
cacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggt

SEQ ID NO: 14534 - DNA, 30 bp, Homo sapiens
  chr3:48948476-48948506
  hypo
tcactggggaaggagcgtagatggaagaga

SEQ ID NO: 14535 - DNA, 19 bp, Homo sapiens
  chr3:49056918-49056937
  hypo
tttttttttttgagacgga

SEQ ID NO: 14536 - DNA, 378 bp, Homo sapiens
  chr3:49939931-49940309
  hypo
tggggaaggcacagacgacagagttggggcccacgccaggaccaccatccttgccagtcacaaagaccccaaatagtacttcctggccctcggcgatgctcagctcagtggcaagttgggcacccactggagcggagtgggccacccgcagcacagggtagggctgtccgccttctggggccccccggcgcctgcgttttggagcaaatctgcagtcgaggaccagctcccgatagtcacccaactctggctcagtggcgctaagccgtgccaggcgtgtgtgcagggcactaggatcatctgtcacgctggccggctgtacagtcaggaagtatacgaaggctcccgtgtggaagctgtgcacgtattcaatactgt

SEQ ID NO: 14537 - DNA, 44 bp, Homo sapiens
  chr3:49940550-49940594
  hypo
gaagaggcaggctggcgctgccagatgcacggctgtcccttggg

SEQ ID NO: 14538 - DNA, 30 bp, Homo sapiens
  chr3:50395506-50395536
  hypo
ctgattttgtctttccggatgtgccccaat

SEQ ID NO: 14539 - DNA, 30 bp, Homo sapiens
  chr3:50425383-50425413
  hypo
gacggagaacagagccgagtttgggcagga

SEQ ID NO: 14540 - DNA, 173 bp, Homo sapiens
  chr3:50433950-50434123
  hypo
acaaatgcctgcccacgccgaccccaaacccagggatggatgaggcccccaattcataagcctgcagtgaccttgtgtagagggcattactgtgtgacttgtacggttcgcaatgcttgtcaccagtgttaggcgagcacctgcagtacagcaggtgccgagctcagtaactt

SEQ ID NO: 14541 - DNA, 28 bp, Homo sapiens
  chr3:50575602-50575630
  hypo
ggggctcaagcaatacgactccagccag

SEQ ID NO: 14542 - DNA, 84 bp, Homo sapiens
  chr3:52552577-52552661
  hypo
gcctttcaccatcttcgtgccgcacgcagatctaatgagcaacctgtcgcaggtatgcagcccccagagcgaggctgggcaggg

SEQ ID NO: 14543 - DNA, 240 bp, Homo sapiens
  chr3:52553207-52553447
  hypo
ctccacctcaggccccgatagcttccgagcaccccacctatctgcttcatcagccccgtgccccgcccccagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgagggtatgacaagcacgggcctgggagctg

SEQ ID NO: 14544 - DNA, 30 bp, Homo sapiens
  chr3:52900819-52900849
  hypo
gtcaaaaaacacaggcgttggaagggatat

SEQ ID NO: 14545 - DNA, 567 bp, Homo sapiens
  chr3:53032798-53033365
  hypo
gggagctggtgctgccgatcgacctgactggcccacaacgtcttcagctaccactgcaagggcctgcggggtgacggctgtgcagcgctgctcgcctagctgttgatcgcctggctgttgatgggctggcacccgcagagctgccctgccggccaccgaccaccatggagggagcattcagctggtgcgcgagctgggtactaaactggctctactgtgagccgccctcggcccctccatctcctcttaccccttgtcatccatgcgtaagccggggacgcccgaggacatgctcttcacccaaggcctgcgccggcgtctgctgatcaagggcccagtacaaaggccgtcatggagatccaggccttcgccaacagcggcctgttctggtgcaagggccagccgggcagcccaaggacctcacgactggctgctgggtcaaggcgttcccggggtgaaggtggataagcagaccaccaagggctcctggaaccctacgtgaaggaggccaagcacagccgtggacaccggcctgaaggctgggaaaggagccgacgccccacctcc

SEQ ID NO: 14546 - DNA, 30 bp, Homo sapiens
  chr3:53033605-53033635
  hypo
cagaagacaggagttcgtgtccttgcccct

SEQ ID NO: 14547 - DNA, 83 bp, Homo sapiens
  chr3:69740999-69741082
  hypo
tttctgggcttgatcttgttataatgtcaccatttctcagatgagaattcagaggctcagaagcacatcgcgagagaatgtgg

SEQ ID NO: 14548 - DNA, 21 bp, Homo sapiens
  chr3:70083716-70083737
  hypo
aggcgtggtggctcacgctta

SEQ ID NO: 14549 - DNA, 91 bp, Homo sapiens; identical to SEQ ID NO: 4993
  chr3:73045514-73045605
  hypo

SEQ ID NO: 14550 - DNA, 17 bp, Homo sapiens
  chr3:86960228-86960245
  hypo
tgaaagttgacacttcg

SEQ ID NO: 14551 - DNA, 163 bp, Homo sapiens
  chr3:87782694-87782857
  hypo
aataaaattaataatcgctagacatgaggaacatttcctgtcccaatgcaaaaccaaacaccactgagggccatttagcatcactaggattcttggctttggttcctaataaatatgttaaatatactggagcaggaagagccgcagacaaaacccctcagta

SEQ ID NO: 14552 - DNA, 143 bp, Homo sapiens; identical to SEQ ID NO: 1556
  chr3:101230961-101231104
  hypo

SEQ ID NO: 14553 - DNA, 37 bp, Homo sapiens
  chr3:101354369-101354406
  hypo
ggagtctttttagaacgcctccaggaggcctatcgaa

SEQ ID NO: 14554 - DNA, 105 bp, Homo sapiens; identical to SEQ ID NO: 4995
  chr3:101397240-101397345
  hypo

SEQ ID NO: 14555 - DNA, 30 bp, Homo sapiens
  chr3:107833994-107834024
  hypo
aaaaaatcttcataacggcaaggtcgcaat

SEQ ID NO: 14556 - DNA, 22 bp, Homo sapiens
  chr3:113557437-113557459
  hypo
aagtttccgagcaattcacctt

SEQ ID NO: 14557 - DNA, 49 bp, Homo sapiens
  chr3:115752446-115752495
  hypo
ctccgtaacatgctgcggggccagagcactctagcgaatgatttctgtg

SEQ ID NO: 14558 - DNA, 37 bp, Homo sapiens
  chr3:118976384-118976421
  hypo
tgtagcaggacaagccgcagacaaaacctctcagaca

SEQ ID NO: 14559 - DNA, 120 bp, Homo sapiens
  chr3:119815773-119815893
  hypo
accgggccggttgaaatttatctttaaaatagtgcacctttaatcctttttttatttctgtgtgtatcttataatgtgcatatcatgttagctcaagatcaagagtttatggacaagcca

SEQ ID NO: 14560 - DNA, 18 bp, Homo sapiens
  chr3:119817451-119817469
  hypo
aaacgctaggattactgg

SEQ ID NO: 14561 - DNA, 25 bp, Homo sapiens
  chr3:121265940-121265965
  hypo
aaataaaagagatctcgccggccgt

SEQ ID NO: 14562 - DNA, 19 bp, Homo sapiens
  chr3:122234242-122234261
  hypo
aaaataattaagggccggg

SEQ ID NO: 14563 - DNA, 79 bp, Homo sapiens; identical to SEQ ID NO: 4998
  chr3:122234561-122234640
  hypo

SEQ ID NO: 14564 - DNA, 29 bp, Homo sapiens
  chr3:122573648-122573677
  hypo
gactcaaaggctgggcgcggtggctcacg

SEQ ID NO: 14565 - DNA, 30 bp, Homo sapiens
  chr3:122702282-122702312
  hypo
aaatcatccgcggggcggggacggggcggg

SEQ ID NO: 14566 - DNA, 102 bp, Homo sapiens
  chr3:125456444-125456546
  hypo
tgtgaaattagtagtgaactcccgctgggatattacgaattttttgacagggtctccacgccctgacacattagtagtcacgttttccgagaatatgacgaa

SEQ ID NO: 14567 - DNA, 39 bp, Homo sapiens
  chr3:125785793-125785832
  hypo
tatgaatttcgccggcgtatggggcgatgctgcagactc

SEQ ID NO: 14568 - DNA, 130 bp, Homo sapiens
  chr3:126195886-126196016
  hypo
cccccacccctcccccgcaccccacctctttttcccagttcatccagcaagccaagctggttccagcctcagagacttggcgcagctgatctctgattcctctgggaggactctgcgccccttctgatcc

SEQ ID NO: 14569 - DNA, 28 bp, Homo sapiens
  chr3:130519901-130519929
  hypo
tgtaaattggccaggcgtcgtggctcat

SEQ ID NO: 14570 - DNA, 30 bp, Homo sapiens
  chr3:134320427-134320457
  hypo
tagctgttatgcctccggggcctttgtgca

SEQ ID NO: 14571 - DNA, 120 bp, Homo sapiens
  chr3:136582942-136583062
  hypo
aaaaaaataaataaaatgtgtatttatttttctaggcattatcctttgtccaggtttctgcagtgctttcaggtccatctaaataaaatttgaaacctacgtgtaatgttggccgggctc

SEQ ID NO: 14572 - DNA, 32 bp, Homo sapiens
  chr3:137561189-137561221
  hypo
agtctagctattggccgggcaccgtggctcac

SEQ ID NO: 14573 - DNA, 57 bp, Homo sapiens
  chr3:137717830-137717887
  hypo
acagctgttttcaactaccaggggctgtggcgctcctgtgtccgagagagctctggc

SEQ ID NO: 14574 - DNA, 133 bp, Homo sapiens; identical to SEQ ID NO: 5000
  chr3:141174349-141174482
  hypo

SEQ ID NO: 14575 - DNA, 99 bp, Homo sapiens
  chr3:141482007-141482106
  hypo
ggatgaaaaatatgggcttggattcttcccatacctcatgcttcaaatagccgttgatgaccctgaagccatagtgctgtgtttcggtcaaacaacagc

SEQ ID NO: 14576 - DNA, 28 bp, Homo sapiens
  chr3:142791151-142791179
  hypo
atattaagactgtcacgcgcgttcgtgt

SEQ ID NO: 14577 - DNA, 35 bp, Homo sapiens; identical to SEQ ID NO: 5001
  chr3:142913215-142913250
  hypo

SEQ ID NO: 14578 - DNA, 21 bp, Homo sapiens
  chr3:142977041-142977062
  hypo
acagagcgatactccatctca

SEQ ID NO: 14579 - DNA, 45 bp, Homo sapiens
  chr3:143092973-143093018
  hypo
atggaggccagaggccgggtgtggtggctcacacctctaatccca

SEQ ID NO: 14580 - DNA, 22 bp, Homo sapiens
  chr3:143210840-143210862
  hypo
cacctaccacttggccgggtgt

SEQ ID NO: 14581 - DNA, 32 bp, Homo sapiens
  chr3:146187946-146187978
  hypo
tttaatttttcaggacgcgcctttgatttttc

SEQ ID NO: 14582 - DNA, 27 bp, Homo sapiens
  chr3:148802983-148803010
  hypo
actacaattatgggccggatgcggtgg

SEQ ID NO: 14583 - DNA, 26 bp, Homo sapiens
  chr3:148803250-148803276
  hypo
ggacgacagagcgagactccatgtca

SEQ ID NO: 14584 - DNA, 161 bp, Homo sapiens
  chr3:150135175-150135336
  hypo
ctttgcttggcataccgtctacctagtctttgaagacaaaacaaaggagggaggagctgttttgatcaaataaaaccaatagcgtgtttaattatgtgttaacatatgtgaatgaccattacagagacagtagagtcagacatacccgggctaaaatctaa

SEQ ID NO: 14585 - DNA, 76 bp, Homo sapiens
  chr3:150237920-150237996
  hypo
ccgcctcggcatcccaaagtgcactccaggttttaattacctctcgggtgattgtggtgcacgctcaagtttgaga

SEQ ID NO: 14586 - DNA, 19 bp, Homo sapiens
  chr3:152744869-152744888
  hypo
actccgtctcaaataaata

SEQ ID NO: 14587 - DNA, 27 bp, Homo sapiens
  chr3:152829598-152829625
  hypo
ggcgtgagcgaccgcacccagctgata

SEQ ID NO: 14588 - DNA, 126 bp, Homo sapiens; identical to SEQ ID NO: 5002
  chr3:169540047-169540173
  hypo

SEQ ID NO: 14589 - DNA, 235 bp, Homo sapiens; identical to SEQ ID NO: 1557
  chr3:169540374-169540609
  hypo

SEQ ID NO: 14590 - DNA, 58 bp, Homo sapiens
  chr3:172384961-172385019
  hypo
attttagtctcaatgcgtcccatcagcagggaaaacggccattcggttcctatgtatt

SEQ ID NO: 14591 - DNA, 31 bp, Homo sapiens
  chr3:172425686-172425717
  hypo
taaacactgctaagaacgttcatctcccaga

SEQ ID NO: 14592 - DNA, 37 bp, Homo sapiens
  chr3:172470190-172470227
  hypo
tacaagtgtgagccaccgcgtccggcctttcaaatgg

SEQ ID NO: 14593 - DNA, 23 bp, Homo sapiens
  chr3:179171196-179171219
  hypo
accgatcccggccccatattctt

SEQ ID NO: 14594 - DNA, 23 bp, Homo sapiens
  chr3:179367897-179367920
  hypo
acccgcctcggcctcccaaagtg

SEQ ID NO: 14595 - DNA, 25 bp, Homo sapiens
  chr3:182812783-182812808
  hypo
tgccctggccaggcacggtggctca

SEQ ID NO: 14596 - DNA, 18 bp, Homo sapiens
  chr3:182816009-182816027
  hypo
ccccgccaacttccaaca

SEQ ID NO: 14597 - DNA, 38 bp, Homo sapiens
  chr3:182987877-182987915
  hypo
cctgaaaactatgatcgacgttccggaattagaaggac

SEQ ID NO: 14598 - DNA, 22 bp, Homo sapiens
  chr3:183183665-183183687
  hypo
ttacaggcgtgagccactgccc

SEQ ID NO: 14599 - DNA, 48 bp, Homo sapiens
  chr3:183622035-183622083
  hypo
cacccatggccatgacgctgctgaggcgctgcacgtcatggaggacag

SEQ ID NO: 14600 - DNA, 30 bp, Homo sapiens
  chr3:183648152-183648182
  hypo
cgcttggaacatgctcgcttctcactaccc

SEQ ID NO: 14601 - DNA, 171 bp, Homo sapiens
  chr3:183684023-183684194
  hypo
aacaccctcacacagcgtgtacacacacaggtgtacctacgtacaccacaaactggtagcattctgatgtgcacttcaaagggttcagaagtccccagggggtctactgtggaaagccggcacttctggctgctgcacaaacaccgcacattgcagcgctatcaacagatg

SEQ ID NO: 14602 - DNA, 30 bp, Homo sapiens; identical to SEQ ID NO: 5005
  chr3:183965921-183965951
  hypo

SEQ ID NO: 14603 - DNA, 30 bp, Homo sapiens
  chr3:184018038-184018068
  hypo
ttgtctgagccctgtcgtctcttgatcagg

SEQ ID NO: 14604 - DNA, 42 bp, Homo sapiens
  chr3:184200659-184200701
  hypo
taaagtgagtgcctccgtgggtctccccgaggcatgaaggtg

SEQ ID NO: 14605 - DNA, 59 bp, Homo sapiens
  chr3:184785167-184785226
  hypo
aacacaaaagggagccgtacacagccctgccctcaggcacctgccggctggggaaggac

SEQ ID NO: 14606 - DNA, 21 bp, Homo sapiens
  chr3:185001914-185001935
  hypo
tacgcgcggccactttccttt

SEQ ID NO: 14607 - DNA, 23 bp, Homo sapiens
  chr3:185270882-185270905
  hypo
aaaagaaaaacaggccggcacgg

SEQ ID NO: 14608 - DNA, 90 bp, Homo sapiens; identical to SEQ ID NO: 1558
  chr3:185271296-185271386
  hypo

SEQ ID NO: 14609 - DNA, 30 bp, Homo sapiens
  chr3:185278325-185278355
  hypo
ctcatgcttttaattcggcaggaatgtcct

SEQ ID NO: 14610 - DNA, 89 bp, Homo sapiens
  chr3:185363216-185363305
  hypo
tctttggtttgctcccgatctggctggctgcgtttggtctcattctgtcaggtgttggaagggctacattcatccgttgttttgctggt

SEQ ID NO: 14611 - DNA, 25 bp, Homo sapiens
  chr3:185551925-185551950
  hypo
atcccaggctgggtgcggtggctca

SEQ ID NO: 14612 - DNA, 36 bp, Homo sapiens
  chr3:185643324-185643360
  hypo
ctgtaagacctgctacgtgatcgtctatgggagcgg

SEQ ID NO: 14613 - DNA, 80 bp, Homo sapiens; identical to SEQ ID NO: 5008
  chr3:193312128-193312208
  hypo

SEQ ID NO: 14614 - DNA, 174 bp, Homo sapiens; identical to SEQ ID NO: 5009
  chr3:193548530-193548704
  hypo

SEQ ID NO: 14615 - DNA, 30 bp, Homo sapiens
  chr3:193588129-193588159
  hypo
aaatggaggccgagacgtgggaatgcttta

SEQ ID NO: 14616 - DNA, 36 bp, Homo sapiens
  chr3:193922775-193922811
  hypo
ggctattattttcctcgattacgttgacattgcctg

SEQ ID NO: 14617 - DNA, 30 bp, Homo sapiens
  chr3:194048863-194048893
  hypo
cgcgcatccgcagagcgcacctgtcccagc

SEQ ID NO: 14618 - DNA, 30 bp, Homo sapiens
  chr3:195536686-195536716
  hypo
gtcaggaggtccaaccgttcaccactgctt

SEQ ID NO: 14619 - DNA, 38 bp, Homo sapiens
  chr3:195587080-195587118
  hypo
aagccggctcgtgcccgccgcctcggctgcagggccct

SEQ ID NO: 14620 - DNA, 59 bp, Homo sapiens
  chr3:195597490-195597549
  hypo
catggccaggaggtgcgggagaggctgggccacctgtcctgctccggatccaccctccg

SEQ ID NO: 14621 - DNA, 68 bp, Homo sapiens
  chr3:195599772-195599840
  hypo
cttgatttcactcctcggctgggttccaggagttctgagaggtgcgggggtgccgggggacacctagg

SEQ ID NO: 14622 - DNA, 77 bp, Homo sapiens
  chr3:195600494-195600571
  hypo
gtcccagggccaaagcgtgaagaagggctcctctgaaacccagccaggccggggagagaggacggaggaggtggcga

SEQ ID NO: 14623 - DNA, 110 bp, Homo sapiens
  chr3:195600916-195601026
  hypo
gcacacagcctcccacggcggcccgtagaggaggaaccccggcaccggctgggctgcggctctcccgctacacccacgggctccccggtggctgccgcgggccagacgcc

SEQ ID NO: 14624 - DNA, 36 bp, Homo sapiens
  chr3:195637307-195637343
  hypo
ggcagccctgggcagcgggcgcgtggagcccaaggg

SEQ ID NO: 14625 - DNA, 30 bp, Homo sapiens
  chr3:195648737-195648767
  hypo
cgtcacccaggaacacggctctgatcaagg

SEQ ID NO: 14626 - DNA, 136 bp, Homo sapiens; identical to SEQ ID NO: 5010
  chr3:196069836-196069972
  hypo

SEQ ID NO: 14627 - DNA, 30 bp, Homo sapiens
  chr3:196256292-196256322
  hypo
tggagcttctgaggccgggcacggtggctc

SEQ ID NO: 14628 - DNA, 30 bp, Homo sapiens
  chr3:196294577-196294607
  hypo
ggccacctaggaaatcgtagtataatcaaa

SEQ ID NO: 14629 - DNA, 495 bp, Homo sapiens
  chr3:196387158-196387653
  hypo
caacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccga

SEQ ID NO: 14630 - DNA, 60 bp, Homo sapiens; identical to SEQ ID NO: 5011
  chr3:196388383-196388443
  hypo

SEQ ID NO: 14631 - DNA, 30 bp, Homo sapiens
  chr3:196731283-196731313
  hypo
ggtgggattcctgagcgttctgctaggcct

SEQ ID NO: 14632 - DNA, 30 bp, Homo sapiens
  chr3:196754516-196754546
  hypo
ccgggcctggcagggcgaggtcggctcctt

SEQ ID NO: 14633 - DNA, 34 bp, Homo sapiens
  chr3:197313900-197313934
  hypo
tataagaacccaacacggcgaaaccccgtctcta

SEQ ID NO: 14634 - DNA, 38 bp, Homo sapiens; identical to SEQ ID NO: 5012
  chr3:197327004-197327042
  hypo

SEQ ID NO: 14635 - DNA, 34 bp, Homo sapiens
  chr3:197327804-197327838
  hypo
ccagctggttacacacgagcgcgcgacatgtcca

SEQ ID NO: 14636 - DNA, 32 bp, Homo sapiens
  chr3:197402171-197402203
  hypo
cccctggggaggccccgcgaggtgctgagtgg

SEQ ID NO: 14637 - DNA, 61 bp, Homo sapiens
  chr4:619541-619602
  hypo
gactgcgacagcctccgggacctctgccaggtggaggagagcacggcgctgctggagctgg

SEQ ID NO: 14638 - DNA, 30 bp, Homo sapiens
  chr4:628444-628474
  hypo
ctctttcctctcttgcggcagtgccctcac

SEQ ID NO: 14639 - DNA, 402 bp, Homo sapiens
  chr4:650912-651314
  hypo
gtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctggtgcggcggggcaggacgtccaggggtcacc

SEQ ID NO: 14640 - DNA, 137 bp, Homo sapiens
  chr4:660921-661058
  hypo
atggagggggagactcgatggggcaggggtctgaccgtggggccctgtgtgatgcccataagagccagctgcctccggccacactccctggtgatggaatccacgccccaaggaggatgccacgggttccacatgaa

SEQ ID NO: 14641 - DNA, 59 bp, Homo sapiens
  chr4:718181-718240
  hypo
caccctggtggacagcggtgctgtgggggccatggaccagaaggcggagcccatgctgt

SEQ ID NO: 14642 - DNA, 102 bp, Homo sapiens
  chr4:738388-738490
  hypo
tgaaaccaaagcagacgacagttcaaacaaagaggccgcggaggagaagccggaggaggacaacgactaccaccgcagcgacgagcaggtgggcggggcccg

SEQ ID NO: 14643 - DNA, 82 bp, Homo sapiens
  chr4:828978-829060
  hypo
gcacccactgcagctcgcctgcggtaggacagtcggggtctgctgccacctggggcttctggggggacgtggagtcctcagc

SEQ ID NO: 14644 - DNA, 52 bp, Homo sapiens
  chr4:829611-829663
  hypo
cagacacccggactgcgtcctcaggagtggagctccccgaggaaagagtgcc

SEQ ID NO: 14645 - DNA, 33 bp, Homo sapiens
  chr4:955421-955454
  hypo
gcctgcccatggccccgccgggcagagcctctg

SEQ ID NO: 14646 - DNA, 450 bp, Homo sapiens
  chr4:955885-956335
  hypo
tcatctcccaggacccggccgccctcaccaggccccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagca

SEQ ID NO: 14647 - DNA, 179 bp, Homo sapiens
  chr4:956578-956757
  hypo
ggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatc

SEQ ID NO: 14648 - DNA, 42 bp, Homo sapiens
  chr4:1016960-1017002
  hypo
ggacattccacagcacgccctgcccctcggcattgtgtggaa

SEQ ID NO: 14649 - DNA, 36 bp, Homo sapiens
  chr4:1024375-1024411
  hypo
cccaggggccgcactcgccaccgttggcctcctctg

SEQ ID NO: 14650 - DNA, 262 bp, Homo sapiens
  chr4:1025875-1026137
  hypo
cctgggcacgcaggccgacatggattctgtggctgaggccgtcagcgtgtgaaagccacagacacaggcgggcccggagtgcctgtccaccccgaggcgcctgccctggcccggcctctccttcctgggtgtcggaagaccttcatctatgcccctgccctgtacccgctcagtgggctgagcacgggcagggtgtggttctgaggggcaaccccaccagcctgcttgggccccagcgtcttctcagcgtctgcctcctgtg

SEQ ID NO: 14651 - DNA, 117 bp, Homo sapiens
  chr4:1036393-1036510
  hypo
atccaccccccacaccgacacacacctacagtgacacccgcacactgacacacacccactcctgcacactgacacccactcctgcacactgacacacacccccgcacagacacacac

SEQ ID NO: 14652 - DNA, 108 bp, Homo sapiens
  chr4:1299074-1299182
  hypo
tgcactaggtgagcccggccctggtgagggtgccttgtgagtggagcctgcttgtgctgctgtgccccgctgcttccaggcggcgcggccctccgtctgattgctgga

SEQ ID NO: 14653 - DNA, 30 bp, Homo sapiens; identical to SEQ ID NO: 5013
  chr4:1299450-1299480
  hypo

SEQ ID NO: 14654 - DNA, 88 bp, Homo sapiens
  chr4:1332572-1332660
  hypo
cagggctgtgtggggcgggcagggcagcggggccaggctggcacacgtcgccattgggacagggctgtcctctcgccccaccctgcct

SEQ ID NO: 14655 - DNA, 178 bp, Homo sapiens
  chr4:1332886-1333064
  hypo
ataaagtcgtgtgcccgagaaccaaagaagtcttccacttctcacaagccgagaaggtgtacatcatgtaggccccacgtcgtgaagcgcacgcctcggggacgggctgcagtgggcggggaggccacgccttcctcctgtcccacgctccagcctgccgcggcgtttctgtttcttg

SEQ ID NO: 14656 - DNA, 91 bp, Homo sapiens
  chr4:1338688-1338779
  hypo
ctggcagaagcttcccggcagagggatccgctccccagaggccgtgtggcagcaagagcaggctggagaagtcaaccggtgggatgcaggg

SEQ ID NO: 14657 - DNA, 138 bp, Homo sapiens
  chr4:1504936-1505074
  hypo
gagctggcctgcccacggggcatcgctgcacgtggtagggggtgacctgggccgaaggaggataccgggcctctgctagggcagggaggccaagggagtttgggccggaggggacaccctgagcgccccacctgcctc

SEQ ID NO: 14658 - DNA, 54 bp, Homo sapiens
  chr4:1512344-1512398
  hypo
tgcggttttaacctgcgttttcctgataattagcaatgtcgagcatcttttcat

SEQ ID NO: 14659 - DNA, 81 bp, Homo sapiens
  chr4:1556398-1556479
  hypo
tgtccacccccagaccgccttctgcctgtgcagccacggcccccaccagcctcgacctgcccgtcccgtcatccatttatt

SEQ ID NO: 14660 - DNA, 30 bp, Homo sapiens
  chr4:1562145-1562175
  hypo
atccactgcaaaatgcgtcatttcttgttg

SEQ ID NO: 14661 - DNA, 30 bp, Homo sapiens
  chr4:1576463-1576493
  hypo
aggtgggcctggagccggtgggtggggctg

SEQ ID NO: 14662 - DNA, 276 bp, Homo sapiens
  chr4:1616600-1616876
  hypo
ggggtgccccatggccgtcctatgctgacggacaccagatggcatttcagcaccgggcacaggggccgctttaaacagcaaaatcaccaaagggacacgagagcaaaaacatggcacacgcaaaccacaaaaaaggacatttacagatgagcagagacagaaggcaggatgcggccacgcccaccccacctgggcacacagaaggcaggacacgaccacgcccacctcacctggggacacaagggaggcaggatgcagccacgcccaccccacctg

SEQ ID NO: 14663 - DNA, 235 bp, Homo sapiens
  chr4:1687244-1687479
  hypo
tgctgggggaggcatcggggctcccaggggtcaggctggggcctcccaacaggttctgggcctggtaaggctagtccggtgcaggctgcgaagccaggccagctgacaccaggactggctggagtcagcctcacctgtctggaagagtgggagtcccagcggggctggggaggggagaagggctggagcaggcgtccaggccattctcttcgctggggtccggtaatcccccacc

SEQ ID NO: 14664 - DNA, 82 bp, Homo sapiens
  chr4:1803282-1803364
  hypo
tctgggcctggcaggcgcggtggttgctgcctccgctcactcacccgcccgcgtcccggtgcagctgcggcatcagcagtgg

SEQ ID NO: 14665 - DNA, 147 bp, Homo sapiens
  chr4:1807505-1807652
  hypo
gccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtac

SEQ ID NO: 14666 - DNA, 61 bp, Homo sapiens
  chr4:1977033-1977094
  hypo
ttttaactacaacctcgattgtctgggcaatgaaaaaacggtctgccggtgtggagcctcc

SEQ ID NO: 14667 - DNA, 298 bp, Homo sapiens
  chr4:1993830-1994128
  hypo
gagcaggcaggtgcccggcacagcagagcgcaggagcagggtggagtcacctgccgcgggggtgtgtgcctgggcagcagggggtggggcctgggacctggggcagcacccgtgacagctgagctggtgcctagtcaccatctaggcagggacggctgcctctgggtctggacggcgctgggagttggcgctcgtggagcctggaggtggccccgggatctggagtgaggccagggccttggggaggccatgggcgacgtgcgtggaggaagcaggcgcaccccgtgctccctcaata

SEQ ID NO: 14668 - DNA, 74 bp, Homo sapiens
  chr4:1994756-1994830
  hypo
gaagcgctgcgcacacgctgcctctggcagccgcacagcccggctgtttccagccagtgcggcctctccacagc

SEQ ID NO: 14669 - DNA, 33 bp, Homo sapiens
  chr4:2065634-2065667
  hypo
gaaggtgctggagttcgccgtggtgcacaacta

SEQ ID NO: 14670 - DNA, 151 bp, Homo sapiens; identical to SEQ ID NO: 5014
  chr4:2066114-2066265
  hypo

SEQ ID NO: 14671 - DNA, 236 bp, Homo sapiens; identical to SEQ ID NO: 5015
  chr4:2305682-2305918
  hypo

SEQ ID NO: 14672 - DNA, 35 bp, Homo sapiens
  chr4:2527902-2527937
  hypo
aaacttcattgtaaaatgaacgggaaagaaaactt

SEQ ID NO: 14673 - DNA, 36 bp, Homo sapiens
  chr4:2932947-2932983
  hypo
gctcaccatagccagcgaccacggaggacaggcagg

SEQ ID NO: 14674 - DNA, 30 bp, Homo sapiens
  chr4:3310521-3310551
  hypo
ttcagggctgggagccgctctgtcaggatt

SEQ ID NO: 14675 - DNA, 47 bp, Homo sapiens
  chr4:3445894-3445941
  hypo
tgggcctcggaggtccgcaggggtccaggggccggagcaagtccccg

SEQ ID NO: 14676 - DNA, 304 bp, Homo sapiens
  chr4:3446463-3446767
  hypo
agtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggat

SEQ ID NO: 14677 - DNA, 158 bp, Homo sapiens; identical to SEQ ID NO: 5016
  chr4:3447821-3447979
  hypo

SEQ ID NO: 14678 - DNA, 82 bp, Homo sapiens
  chr4:4256159-4256241
  hypo
ggtttctcacagaagcgaagtcaacgtgagcacaacagctgtctgctgcactggcagaaaagggccgcgagtgagcctctaa

SEQ ID NO: 14679 - DNA, 47 bp, Homo sapiens
  chr4:6670153-6670200
  hypo
acgtgcaagacaccacgttttactgccccgcccggctagcagtggac

SEQ ID NO: 14680 - DNA, 37 bp, Homo sapiens
  chr4:6719869-6719906
  hypo
gcatggtatatttctttcctctcgaaatggatagtta

SEQ ID NO: 14681 - DNA, 153 bp, Homo sapiens
  chr4:6748421-6748574
  hypo
ctctgtgtgcccctgcggggagaatcgcccctgccgaagccccggctggtccaaaaccacgccagccgctttaggggtgtctgtggacccaggaccacacagcctcaagagccaagagtcccgagtgtgtgcacctgtcggcctgggtctgga

SEQ ID NO: 14682 - DNA, 30 bp, Homo sapiens
  chr4:6957585-6957615
  hypo
tcggacacgtaagtccgagtcgcagctctg

SEQ ID NO: 14683 - DNA, 110 bp, Homo sapiens
  chr4:7047093-7047203
  hypo
gggagcctccttgttcgttattccccctccaccccattcccctattccacacaccataaccggagcgagctttggaagcacaaagcgcctcacaccggcctcagtggctt

SEQ ID NO: 14684 - DNA, 214 bp, Homo sapiens
  chr4:7647740-7647954
  hypo
tgccctagagtcaaacgtgttcattcggtcagcaaatgggccttgcgcacccggcagccacggattccgggctaccgctggtgccgcaggtgagcgaggcaggtgtgtgcccccgggctgtgagcggcttagccgaggagcaggagataaactcccaggacgcaaggaagtcagcaaacagctgtgcaggcgtgagctccgcacagcgcacacg

SEQ ID NO: 14685 - DNA, 179 bp, Homo sapiens
  chr4:7741325-7741504
  hypo
caggtgaaggatgggcgaggactcaggcaaggactcaggtgtgtctgggctgtgccgcgggtgctcccagccgtgtctcccggtgcccttgaggcggggcagctctgggtcctgggtcctcgacctgtctccttgactcctaaccagcccccacccgggacacccggctcaccccttgg

SEQ ID NO: 14686 - DNA, 38 bp, Homo sapiens
  chr4:8607740-8607778
  hypo
caacattcatggcaacgaggtggcgggccgggagatgc

SEQ ID NO: 14687 - DNA, 33 bp, Homo sapiens
  chr4:8608618-8608651
  hypo
gggtaaggtaggagccgccgctgcccatgctgg

SEQ ID NO: 14688 - DNA, 30 bp, Homo sapiens
  chr4:8615890-8615920
  hypo
gaggggcgtctgtggcgagtacctgctgca

SEQ ID NO: 14689 - DNA, 55 bp, Homo sapiens
  chr4:39448324-39448379
  hypo
ggtggctgaacccatcgacggccgaggccttccaggcctacgctgggctgtgctt

SEQ ID NO: 14690 - DNA, 98 bp, Homo sapiens; identical to SEQ ID NO: 5017
  chr4:39816677-39816775
  hypo

SEQ ID NO: 14691 - DNA, 38 bp, Homo sapiens; identical to SEQ ID NO: 5018
  chr4:39817075-39817113
  hypo

SEQ ID NO: 14692 - DNA, 30 bp, Homo sapiens
  chr4:40910280-40910310
  hypo
actgtgagaaaagaacgtttctgtagttga

SEQ ID NO: 14693 - DNA, 28 bp, Homo sapiens
  chr4:74468515-74468543
  hypo
caagtttcggccaggcgcggtggctcat

SEQ ID NO: 14694 - DNA, 150 bp, Homo sapiens; identical to SEQ ID NO: 5019
  chr4:75241329-75241479
  hypo

SEQ ID NO: 14695 - DNA, 30 bp, Homo sapiens
  chr4:76912406-76912436
  hypo
aaaattagaaactgacgcctgtaatcccag

SEQ ID NO: 14696 - DNA, 41 bp, Homo sapiens
  chr4:84169961-84170002
  hypo
tggcaggctcaccaccggttctatgccgcagggctgttgta

SEQ ID NO: 14697 - DNA, 37 bp, Homo sapiens
  chr4:87899606-87899643
  hypo
tataggtgtgagccaccatgcccggcctacattcact

SEQ ID NO: 14698 - DNA, 86 bp, Homo sapiens; identical to SEQ ID NO: 1559
  chr4:95127609-95127695
  hypo

SEQ ID NO: 14699 - DNA, 18 bp, Homo sapiens
  chr4:95762911-95762929
  hypo
attcggccatcttggctc

SEQ ID NO: 14700 - DNA, 24 bp, Homo sapiens
  chr4:110735814-110735838
  hypo
accacgccccgcctacaaaggtat

SEQ ID NO: 14701 - DNA, 30 bp, Homo sapiens
  chr4:113154853-113154883
  hypo
ttttcatggggtctccgtagagtacggcat

SEQ ID NO: 14702 - DNA, 35 bp, Homo sapiens
  chr4:113559151-113559186
  hypo
tattaaaacattttgcgaggctgggcacggtggct

SEQ ID NO: 14703 - DNA, 34 bp, Homo sapiens
  chr4:113559426-113559460
  hypo
gggccactgagagaggctgcgtctccaaacaaac

SEQ ID NO: 14704 - DNA, 89 bp, Homo sapiens
  chr4:123866964-123867053
  hypo
tttactgtctagtggcagaaagtaaatatgtgaaaataatataaaggtttggcactaagtcacttatatactaacgtgttagtaatttt

SEQ ID NO: 14705 - DNA, 27 bp, Homo sapiens
  chr4:128984288-128984315
  hypo
aaagtaaaaatgggccggcgcggtggc

SEQ ID NO: 14706 - DNA, 135 bp, Homo sapiens
  chr4:154216763-154216898
  hypo
gcggcagaccatcatcgggcagcccatgtccgtcaccatcaccaccaaggacaaagacggtgagctgtgcaaaaccggcaacgcctacctcaccgccgaactgagcacccccgacgggagcgtggcagacgggga

SEQ ID NO: 14707 - DNA, 65 bp, Homo sapiens
  chr4:154540165-154540230
  hypo
tctttgtcatactcacggagaactctttgatgcttctggtcaccgagtcccgcctctcagtagtc

SEQ ID NO: 14708 - DNA, 67 bp, Homo sapiens
  chr4:170484641-170484708
  hypo
aatgctgcttcaccacgattttctaggtaggtaatcatatcaaatgtaaatacgatatgtctatgtt

SEQ ID NO: 14709 - DNA, 30 bp, Homo sapiens
  chr4:184375696-184375726
  hypo
gccaccacgcccggccgatcctgcttcttt

SEQ ID NO: 14710 - DNA, 164 bp, Homo sapiens
  chr5:480880-481044
  hypo
caagcaaacacagatcgctcagaaaatgggaacccagggcaaattgtatgtgctccttactgggtttattataagtgtcacatgttttttataataaaacataggtgatttcaccttaatggacaaactcttttttttattttgggacgaagtctcgctctgtc

SEQ ID NO: 14711 - DNA, 30 bp, Homo sapiens
  chr5:488962-488992
  hypo
ggacgggcccggagccgggacacacagcac

SEQ ID NO: 14712 - DNA, 420 bp, Homo sapiens; identical to SEQ ID NO: 5022
  chr5:491335-491755
  hypo

SEQ ID NO: 14713 - DNA, 32 bp, Homo sapiens
  chr5:492064-492096
  hypo
cgtcagtgtgaaggacgcgatgtggtcggccg

SEQ ID NO: 14714 - DNA, 265 bp, Homo sapiens
  chr5:538686-538951
  hypo
cctgtgcctgcctgacgatgccgcctcagccgcccagggctccctcagggaaaacgtcgccaagcaccgacggctcaagggagtaaccgcgcctctgggagatggcgtccctgacttggctgtggcaccaggctggccaggggactgttggaacatttgcggaggagcacagttgccatttccttcatgccacacctgccccagcttgtgtctgtgtgtgatggcacggtttgggctggcaggaggggcacgggtgcttgggtgt

SEQ ID NO: 14715 - DNA, 617 bp, Homo sapiens; identical to SEQ ID NO: 5023
  chr5:554299-554916
  hypo

SEQ ID NO: 14716 - DNA, 17 bp, Homo sapiens
  chr5:555156-555173
  hypo
aacgggggggtgggtca

SEQ ID NO: 14717 - DNA, 94 bp, Homo sapiens
  chr5:556211-556305
  hypo
ccttggctccacctgcgcttctggtctcggctgccctgacagccactgggctccaggcaggcctgggtggtgaggacggcgctgggctgcggcc

SEQ ID NO: 14718 - DNA, 140 bp, Homo sapiens; identical to SEQ ID NO: 5025
  chr5:677883-678023
  hypo

SEQ ID NO: 14719 - DNA, 30 bp, Homo sapiens
  chr5:1003129-1003159
  hypo
cgcccgggtgtgcttcgaactgagaagcca

SEQ ID NO: 14720 - DNA, 38 bp, Homo sapiens
  chr5:1021444-1021482
  hypo
cccctttgctcctcccgctgacccggccccccgcccct

SEQ ID NO: 14721 - DNA, 260 bp, Homo sapiens
  chr5:1034370-1034630
  hypo
gtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttcacgtgtgtttctgggccgagcctgcgccgcc

SEQ ID NO: 14722 - DNA, 82 bp, Homo sapiens
  chr5:1073600-1073682
  hypo
tgagctcaaagccaccgccacggctaaaacacagcagcgccacgcacagcaccgtgttgacacgctgcgatgaggacatgcc

SEQ ID NO: 14723 - DNA, 136 bp, Homo sapiens
  chr5:1073918-1074054
  hypo
gcagccagggtggggcggctgttaccacggcaacgcttaccagggcacggcccatcaacaggcagggcagatgggacgggcggggcacacgacacaggtgggacgggagatacatgacaggcgggacaggggacaa

SEQ ID NO: 14724 - DNA, 125 bp, Homo sapiens; identical to SEQ ID NO: 5026
  chr5:1174263-1174388
  hypo

SEQ ID NO: 14725 - DNA, 32 bp, Homo sapiens
  chr5:1189595-1189627
  hypo
ctgtgctggacacaacgcggcaagacaagaaa

SEQ ID NO: 14726 - DNA, 71 bp, Homo sapiens
  chr5:1193902-1193973
  hypo
ctggagcaggcacagcgagccagggtgcgaggcccggacagctctgagcggaacagcgagccacctgcagc

SEQ ID NO: 14727 - DNA, 30 bp, Homo sapiens
  chr5:1221181-1221211
  hypo
gttcgggtagcagaacgtacagaaagctta

SEQ ID NO: 14728 - DNA, 30 bp, Homo sapiens
  chr5:1223271-1223301
  hypo
tctctgcgttctggccgcttcccggcttaa

SEQ ID NO: 14729 - DNA, 30 bp, Homo sapiens
  chr5:1233049-1233079
  hypo
aggcatgtgctgcagcgtgtccagcatcag

SEQ ID NO: 14730 - DNA, 836 bp, Homo sapiens; identical to SEQ ID NO: 409
  chr5:1294607-1295443
  hypo

SEQ ID NO: 14731 - DNA, 47 bp, Homo sapiens
  chr5:1746593-1746640
  hypo
cctgcctgggctgcccggggaccctcctgctgcgtcagcacagagcc

SEQ ID NO: 14732 - DNA, 151 bp, Homo sapiens
  chr5:1747003-1747154
  hypo
tgggtgctgggtccccggcgtcagggcgcaatgccgcctgctgggcgtcaccctttcccagggctgctgggacacgtggccgcagctgcttggctcaccacagcggaagtcggtctctctcatcctggagtccgcgcggctgagggcgagg

SEQ ID NO: 14733 - DNA, 30 bp, Homo sapiens
  chr5:1795233-1795263
  hypo
acagccatgcccactcgcagggaggcaggg

SEQ ID NO: 14734 - DNA, 30 bp, Homo sapiens
  chr5:1865547-1865577
  hypo
gaaaaacgaagccaccgcgattatgattat

SEQ ID NO: 14735 - DNA, 30 bp, Homo sapiens
  chr5:1949574-1949604
  hypo
tgggatgggggtgcccgcccagggcagtgc

SEQ ID NO: 14736 - DNA, 394 bp, Homo sapiens
  chr5:1950777-1951171
  hypo
ccctcggcagcttcacgacctcaccaagtgcccgccgctctcacgagagaggtggttatggttgcgcattgaatatgcttgggagaggcaaagatggatggcgtagtctctaccctcacacccagtgctgagcgcgagtcgtccgctgtgtgtgcatcatctgctgtgcgtgtgtcatctgctgtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgct

SEQ ID NO: 14737 - DNA, 150 bp, Homo sapiens
  chr5:2136920-2137070
  hypo
gggcccgtgtgtgtgcgtgggcagaagtgactgggcgtgcgtgtgtggacagaagtgaccgggcgcgcctgtgtgggcgggcagaggtgactgggccagcatgcgtgggtgggcagaggtgaccgggcatgcgtgcgtgggcgggcagag

SEQ ID NO: 14738 - DNA, 30 bp, Homo sapiens
  chr5:2180638-2180668
  hypo
gctcgcgtcctctcacgagatacggggctg

SEQ ID NO: 14739 - DNA, 68 bp, Homo sapiens
  chr5:2369614-2369682
  hypo
atgcaaacacatgcacgggcacgcatgcacacacagacacagggcattcctcccgcctcaggcaccct

SEQ ID NO: 14740 - DNA, 149 bp, Homo sapiens
  chr5:2541481-2541630
  hypo
gtgtgcctgtgtgcacgcatgcgtgtgcaggctctgctgtgtgtgtgtggtgtgtgcctgtgtgcacgcatgcatgtgcgggctctgctgtgcatgtctgtgtatcgtgtgactgcgtgcatgcttgcatgtgccgactctgatgtgcg

SEQ ID NO: 14741 - DNA, 30 bp, Homo sapiens
  chr5:3221107-3221137
  hypo
tgctccaggcaaatgcgtggcatcattcat

SEQ ID NO: 14742 - DNA, 275 bp, Homo sapiens; identical to SEQ ID NO: 5028
  chr5:3324844-3325119
  hypo

SEQ ID NO: 14743 - DNA, 176 bp, Homo sapiens
  chr5:3674048-3674224
  hypo
ctctgccagtcactccgctccggctgctccttatgttttcctcagcacccccggcagctgggtctgggcgtgtttgtgctggtggttccttctgcacagatgctgctcccggccttcctgcagggctcatccctcagctccttcctggatgccaccttctccggtaagcatgccct

SEQ ID NO: 14744 - DNA, 30 bp, Homo sapiens
  chr5:3740976-3741006
  hypo
tcgccttctctcctgcgcgcagctggcggc

SEQ ID NO: 14745 - DNA, 165 bp, Homo sapiens
  chr5:3806428-3806593
  hypo
acattcaggtacccccgaatcctgcaacgatgggtgcttaggatgagttgttccatttctcaagcaaggttcactgtcgtgttcgcacatggcattttatcaaaggtttccacctaccaacgcagaaattcaaatcatgcttttgcgcaacgagagctcagttct

SEQ ID NO: 14746 - DNA, 30 bp, Homo sapiens
  chr5:4144357-4144387
  hypo
atgtgttctgtgtgccgtgctcttgcgtgc

SEQ ID NO: 14747 - DNA, 32 bp, Homo sapiens
  chr5:4629575-4629607
  hypo
catcctttaaccctccgcgccgtacaccaccc

SEQ ID NO: 14748 - DNA, 20 bp, Homo sapiens
  chr5:10248726-10248746
  hypo
tatagcgcactgtaaactga

SEQ ID NO: 14749 - DNA, 167 bp, Homo sapiens
  chr5:10267279-10267446
  hypo
ccaaaggcaaatggccgagaaagtgttgaagggcaggaaaagtggggaaaacacgacaaggtagtaaaaatataaatgtgtgtgccctatcactgctctaaatggtttatgtacattaaaactggttttcaaagtctgctccatggatccctcggggtcctgggtct

SEQ ID NO: 14750 - DNA, 30 bp, Homo sapiens
  chr5:10675402-10675432
  hypo
gaacataagcctttacggtgacactgcctg

SEQ ID NO: 14751 - DNA, 30 bp, Homo sapiens
  chr5:14732034-14732064
  hypo
gcccagggagctgcgcgagtgtcacgtgaa

SEQ ID NO: 14752 - DNA, 28 bp, Homo sapiens
  chr5:14774569-14774597
  hypo
acagtcgcgctctgtcgcccagtctgga

SEQ ID NO: 14753 - DNA, 30 bp, Homo sapiens
  chr5:16032780-16032810
  hypo
tagcatctttattaccgcactctaaaccac

SEQ ID NO: 14754 - DNA, 78 bp, Homo sapiens
  chr5:16436327-16436405
  hypo
gcttgcaggccagcacgagttccgggtgggtgtggactcggcacgcccggcactcggagcctccggccatccctgccg

SEQ ID NO: 14755 - DNA, 104 bp, Homo sapiens; identical to SEQ ID NO: 5029
  chr5:17203073-17203177
  hypo

SEQ ID NO: 14756 - DNA, 57 bp, Homo sapiens
  chr5:17502391-17502448
  hypo
gtgcccttttgctggcggctttagtggccagggtcttcgtggcgcctgccaggcggt

SEQ ID NO: 14757 - DNA, 16 bp, Homo sapiens
  chr5:32526565-32526581
  hypo
cttctccacgccgggc

SEQ ID NO: 14758 - DNA, 30 bp, Homo sapiens
  chr5:33162572-33162602
  hypo
ggtgaagaattgcatcgtgctcatcgacag

SEQ ID NO: 14759 - DNA, 25 bp, Homo sapiens
  chr5:33234426-33234451
  hypo
tgagctgacacgcctggctgaattt

SEQ ID NO: 14760 - DNA, 27 bp, Homo sapiens
  chr5:33298124-33298151
  hypo
gcaccctgctggcgcaccctgctggcg

SEQ ID NO: 14761 - DNA, 35 bp, Homo sapiens
  chr5:37255512-37255547
  hypo
accaaaacaaacattcttggcggtgggtgcaggac

SEQ ID NO: 14762 - DNA, 32 bp, Homo sapiens
  chr5:39343165-39343197
  hypo
tgaacaggaacagctcgtttacagctcccagc

SEQ ID NO: 14763 - DNA, 33 bp, Homo sapiens; identical to SEQ ID NO: 1561
  chr5:43402630-43402663
  hypo

SEQ ID NO: 14764 - DNA, 30 bp, Homo sapiens
  chr5:64860574-64860604
  hypo
cattctaaaatcactcgagaatcggtcttg

SEQ ID NO: 14765 - DNA, 30 bp, Homo sapiens
  chr5:67840329-67840359
  hypo
cttgctacagcttaacgtttcagcacattt

SEQ ID NO: 14766 - DNA, 22 bp, Homo sapiens
  chr5:68391002-68391024
  hypo
gtaatagcattataacgtaact

SEQ ID NO: 14767 - DNA, 21 bp, Homo sapiens
  chr5:74536034-74536055
  hypo
aatttttttttgagacggagt

SEQ ID NO: 14768 - DNA, 17 bp, Homo sapiens
  chr5:77047294-77047311
  hypo
gccggccagcctgacca

SEQ ID NO: 14769 - DNA, 30 bp, Homo sapiens
  chr5:78985161-78985191
  hypo
gctgctggagctcttcggagtctcagtttc

SEQ ID NO: 14770 - DNA, 31 bp, Homo sapiens; identical to SEQ ID NO: 5032
  chr5:79783240-79783271
  hypo

SEQ ID NO: 14771 - DNA, 90 bp, Homo sapiens; identical to SEQ ID NO: 5033
  chr5:79947584-79947674
  hypo

SEQ ID NO: 14772 - DNA, 30 bp, Homo sapiens; identical to SEQ ID NO: 5034
  chr5:79947734-79947764
  hypo

SEQ ID NO: 14773 - DNA, 86 bp, Homo sapiens; identical to SEQ ID NO: 5035
  chr5:94982139-94982225
  hypo

SEQ ID NO: 14774 - DNA, 30 bp, Homo sapiens
  chr5:98201074-98201104
  hypo
ggcacagaaatataacggtgtgactttatt

SEQ ID NO: 14775 - DNA, 45 bp, Homo sapiens
  chr5:111987773-111987818
  hypo
gctgggattacaggcgtgagccaccgcgcccggcctccaggtcac

SEQ ID NO: 14776 - DNA, 172 bp, Homo sapiens
  chr5:112198328-112198500
  hypo
atcctggtcgggccacgtaatcttgttagagccgcagggggttctcttcactgcatttatttagggcttgagaacacagccaagaattggggtgcgttcctcagtgttggtgaaaccagaaaggcattaattcatagctgaagggatatttttttaacgtctcttaatgagc

SEQ ID NO: 14777 - DNA, 30 bp, Homo sapiens
  chr5:126200056-126200086
  hypo
aatgagatacaataacgtagttgttttgga

SEQ ID NO: 14778 - DNA, 30 bp, Homo sapiens
  chr5:131610019-131610049
  hypo
tgcccaccctgcctccgctgacttggtccc

SEQ ID NO: 14779 - DNA, 30 bp, Homo sapiens
  chr5:132083934-132083964
  hypo
cactgccccaccccccgcaccttaagcagg

SEQ ID NO: 14780 - DNA, 31 bp, Homo sapiens
  chr5:137548023-137548054
  hypo
tttgagacagtgtcccgctctgccctcgggc

SEQ ID NO: 14781 - DNA, 30 bp, Homo sapiens
  chr5:137769708-137769738
  hypo
gtgagtcaccgtgcccgtccaacattggtg

SEQ ID NO: 14782 - DNA, 19 bp, Homo sapiens
  chr5:139556366-139556385
  hypo
agacctggcctggtgcggt

SEQ ID NO: 14783 - DNA, 21 bp, Homo sapiens
  chr5:139779846-139779867
  hypo
ccacggcgcccgctatagaat

SEQ ID NO: 14784 - DNA, 30 bp, Homo sapiens
  chr5:151383730-151383760
  hypo
agacgcgcaagtcctcgggaggagacgcat

SEQ ID NO: 14785 - DNA, 25 bp, Homo sapiens
  chr5:154030048-154030073
  hypo
tttttatttttgagacgaaatttca

SEQ ID NO: 14786 - DNA, 30 bp, Homo sapiens; identical to SEQ ID NO: 1562
  chr5:154209957-154209987
  hypo

SEQ ID NO: 14787 - DNA, 19 bp, Homo sapiens
  chr5:154318148-154318167
  hypo
atatgcacaagaggccggg

SEQ ID NO: 14788 - DNA, 30 bp, Homo sapiens
  chr5:157078407-157078437
  hypo
cgagcctgcagtcctcgaggagtctctcgg

SEQ ID NO: 14789 - DNA, 39 bp, Homo sapiens
  chr5:158612937-158612976
  hypo
tatgaaaagggcctccggccatggtagctcaagcctgta

SEQ ID NO: 14790 - DNA, 22 bp, Homo sapiens
  chr5:159672080-159672102
  hypo
ggtaggggctgggtgcggtggc

SEQ ID NO: 14791 - DNA, 28 bp, Homo sapiens
  chr5:166865441-166865469
  hypo
gctggagtgcagtggcgccatctcggct

SEQ ID NO: 14792 - DNA, 141 bp, Homo sapiens
  chr5:168192180-168192321
  hypo
gtggctggggacagccgcctattaaatgcattttcattttaatcaaggtgagagcagcctgtagttagcaggaatcgctctcagtagtatagttagattataactggtggacctctgcaatggagccgctgacccatttta

SEQ ID NO: 14793 - DNA, 30 bp, Homo sapiens
  chr5:168268106-168268136
  hypo
cctgcagcccacagccgccatgcttcaggg

SEQ ID NO: 14794 - DNA, 17 bp, Homo sapiens
  chr5:168337470-168337487
  hypo
gggcgtggtggctcacg

SEQ ID NO: 14795 - DNA, 30 bp, Homo sapiens
  chr5:169157436-169157466
  hypo
gatgaatttggacagcgagtcagaggctac

SEQ ID NO: 14796 - DNA, 71 bp, Homo sapiens; identical to SEQ ID NO: 5038
  chr5:169532927-169532998
  hypo

SEQ ID NO: 14797 - DNA, 30 bp, Homo sapiens
  chr5:172235667-172235697
  hypo
ctgcctcagccaccacgcccagcccctaaa

SEQ ID NO: 14798 - DNA, 30 bp, Homo sapiens
  chr5:175610717-175610747
  hypo
ggccatcagggctggcgcttaagtgactga

SEQ ID NO: 14799 - DNA, 17 bp, Homo sapiens
  chr5:175876289-175876306
  hypo
cccccaggccaggagcg

SEQ ID NO: 14800 - DNA, 17 bp, Homo sapiens
  chr5:175876606-175876623
  hypo
ttcgggagatcaaatgg

SEQ ID NO: 14801 - DNA, 30 bp, Homo sapiens
  chr5:175924856-175924886
  hypo
aatgcagaatcaggccgagcatgttggctc

SEQ ID NO: 14802 - DNA, 20 bp, Homo sapiens
  chr5:175971447-175971467
  hypo
ctttcctttttttgacggag

SEQ ID NO: 14803 - DNA, 30 bp, Homo sapiens
  chr5:175975036-175975066
  hypo
cagtctctataccaccgcctgtgctcctgg

SEQ ID NO: 14804 - DNA, 23 bp, Homo sapiens
  chr5:175978997-175979020
  hypo
accgcgcccggttaatagttccc

SEQ ID NO: 14805 - DNA, 30 bp, Homo sapiens
  chr5:176225880-176225910
  hypo
tctccttctaattaccggtttaattaacct

SEQ ID NO: 14806 - DNA, 92 bp, Homo sapiens
  chr5:176315380-176315472
  hypo
agtgtttgttgctcccggctgtgctggaggcaggagagaacagcggccagggcggcagcacagagctgggcagcccgcgtgcacacggccgc

SEQ ID NO: 14807 - DNA, 20 bp, Homo sapiens
  chr5:177019993-177020013
  hypo
ccttctgtcacttttcgtta

SEQ ID NO: 14808 - DNA, 43 bp, Homo sapiens
  chr5:177031179-177031222
  hypo
gtccgggttgctctccggcggcctccctcggaagtgttccgtc

SEQ ID NO: 14809 - DNA, 43 bp, Homo sapiens
  chr5:177713462-177713505
  hypo
ccccacactcagcttcgtctttaattcccgacagtcctgtcat

SEQ ID NO: 14810 - DNA, 30 bp, Homo sapiens
  chr5:177982679-177982709
  hypo
cttggctccaggacacgtggagtgggacca

SEQ ID NO: 14811 - DNA, 30 bp, Homo sapiens
  chr5:178481870-178481900
  hypo
tgtggtcttttgctccgcatcaccttgctt

SEQ ID NO: 14812 - DNA, 34 bp, Homo sapiens
  chr5:178565449-178565483
  hypo
aaagcagacgcatcacggccgctgggttttctcc

SEQ ID NO: 14813 - DNA, 143 bp, Homo sapiens
  chr5:178576356-178576499
  hypo
cagcctccaggactgcgaagaacaaggctctgttgtgtaagccacccagtctgcggtatttctgttagagcagccgaagctgaggaagatggagtgtgagctgtcctggcaccgtggaaggctgcggccggggcagactctaa

SEQ ID NO: 14814 - DNA, 155 bp, Homo sapiens
  chr5:178655753-178655908
  hypo
gtggggctccagacccggggcggtgccttcaccacggcctcctcatccagcatccacaactctggagctaggaagcccggtgctccttcccagaggagggagccgaagctctgccagtctgcactgaagtctgtggtgtgcggtcacctgagaac

SEQ ID NO: 14815 - DNA, 49 bp, Homo sapiens
  chr5:178665413-178665462
  hypo
gtgctctgagtatgccggagggcagtgagtgctgcgggaaggggctgga

SEQ ID NO: 14816 - DNA, 30 bp, Homo sapiens
  chr5:178878685-178878715
  hypo
ggctctcagtggagccgagcccagagagaa

SEQ ID NO: 14817 - DNA, 27 bp, Homo sapiens
  chr5:178969579-178969606
  hypo
agaatgggccaggtgcggtggctcacg

SEQ ID NO: 14818 - DNA, 193 bp, Homo sapiens
  chr5:179214072-179214265
  hypo
aggggtggggcccagcgggatcccagcatcgtggctctggctcacccagacaaacccggatctgccacccaagtgcccaagtctccagcctgccagtgacagagaccagcgttggtctcctcaagggactgagtgaggagaccagtcaccacccggtgcaaactgagtcccttccacgcgggaaagggccacg

SEQ ID NO: 14819 - DNA, 30 bp, Homo sapiens
  chr5:180041104-180041134
  hypo
ccacacgtcactctgcgtggtgtacacctt

SEQ ID NO: 14820 - DNA, 53 bp, Homo sapiens
  chr5:180057500-180057553
  hypo
tgggccccagctgcccgggaccctgctccagcctggcccgcctccaagtctca

SEQ ID NO: 14821 - DNA, 33 bp, Homo sapiens
  chr5:180709002-180709035
  hypo
tgtggttggtggtggcgacggagactgcatctc

SEQ ID NO: 14822 - DNA, 35 bp, Homo sapiens
  chr6:348724-348759
  hypo
tgcacatgtgtgtgacgtttcgggtttgtttccat

SEQ ID NO: 14823 - DNA, 39 bp, Homo sapiens
  chr6:448927-448966
  hypo
tgtgttgctgaagcccggagtgcacgcccagcgcgtggt

SEQ ID NO: 14824 - DNA, 52 bp, Homo sapiens
  chr6:3053334-3053386
  hypo
gctccaggctcttcacgagttctttgaaagccgctggcgttgactccattac

SEQ ID NO: 14825 - DNA, 332 bp, Homo sapiens; identical to SEQ ID NO: 5040
  chr6:3285157-3285489
  hypo

SEQ ID NO: 14826 - DNA, 30 bp, Homo sapiens; identical to SEQ ID NO: 1564
  chr6:4951289-4951319
  hypo

SEQ ID NO: 14827 - DNA, 30 bp, Homo sapiens
  chr6:6045657-6045687
  hypo
tataaaatcacaactcggaagcactatgaa

SEQ ID NO: 14828 - DNA, 37 bp, Homo sapiens
  chr6:6367079-6367116
  hypo
agcagtggctgtaatcggcctgcggggctctctcctg

SEQ ID NO: 14829 - DNA, 61 bp, Homo sapiens
  chr6:6534792-6534853
  hypo
caggcgtccaggcaccgcgcccaggagagccagctctgagcatccccggggggccactcct

SEQ ID NO: 14830 - DNA, 66 bp, Homo sapiens
  chr6:6891420-6891486
  hypo
tgggggaggaggcagcggcacaacaggttcccacatcacctggagagcaggcgcattacttcctcc

SEQ ID NO: 14831 - DNA, 21 bp, Homo sapiens
  chr6:7237775-7237796
  hypo
cgctcgcgttggggcttgcag

SEQ ID NO: 14832 - DNA, 16 bp, Homo sapiens
  chr6:10595805-10595821
  hypo
ccggttggttgggttg

SEQ ID NO: 14833 - DNA, 186 bp, Homo sapiens; identical to SEQ ID NO: 1565
  chr6:12288517-12288703
  hypo

SEQ ID NO: 14834 - DNA, 30 bp, Homo sapiens
  chr6:13293172-13293202
  hypo
tgtcccctacagcatcgcaggtttgagggt

SEQ ID NO: 14835 - DNA, 38 bp, Homo sapiens
  chr6:15456030-15456068
  hypo
ttacaggcatgagtcaccatgcccggcgaagccaggtt

SEQ ID NO: 14836 - DNA, 30 bp, Homo sapiens
  chr6:16197009-16197039
  hypo
agtagaaaacaaaagcgggctgaaccaagc

SEQ ID NO: 14837 - DNA, 25 bp, Homo sapiens
  chr6:16218445-16218470
  hypo
gcctgcacaccggggctgtaaatgg

SEQ ID NO: 14838 - DNA, 30 bp, Homo sapiens
  chr6:16293453-16293483
  hypo
ggaatttgtaaaaggcgacaccaccactta

SEQ ID NO: 14839 - DNA, 30 bp, Homo sapiens
  chr6:18035850-18035880
  hypo
gtcctcaccactctccgtggagaacactgg

SEQ ID NO: 14840 - DNA, 92 bp, Homo sapiens
  chr6:20239485-20239577
  hypo
ccgcggggcagggctcgggatctggagcccgcctgcgcctcccccgccactccgtgggctcctgcgcggccagagcctccccgaggagcgct

SEQ ID NO: 14841 - DNA, 36 bp, Homo sapiens
  chr6:24647342-24647378
  hypo
aaaaccagctgggtgcggtggctcacgcctgtaatc

SEQ ID NO: 14842 - DNA, 33 bp, Homo sapiens
  chr6:26214615-26214648
  hypo
ggcgtgagccaccgcgcccggccaagagaaaaa

SEQ ID NO: 14843 - DNA, 30 bp, Homo sapiens
  chr6:33955505-33955535
  hypo
cactctggaggcaggcgcttttgtcatcaa

SEQ ID NO: 14844 - DNA, 120 bp, Homo sapiens; identical to SEQ ID NO: 5043
  chr6:34170868-34170988
  hypo

SEQ ID NO: 14845 - DNA, 31 bp, Homo sapiens; identical to SEQ ID NO: 5044
  chr6:34171048-34171079
  hypo

SEQ ID NO: 14846 - DNA, 30 bp, Homo sapiens
  chr6:34514348-34514378
  hypo
gatagcatagcttgacgaatggagcctagg

SEQ ID NO: 14847 - DNA, 23 bp, Homo sapiens
  chr6:34854786-34854809
  hypo
tgggtccctgatcaccgggtgcg

SEQ ID NO: 14848 - DNA, 30 bp, Homo sapiens
  chr6:35149810-35149840
  hypo
caaatgtttcttgagcgctggcaacgtgcc

SEQ ID NO: 14849 - DNA, 66 bp, Homo sapiens; identical to SEQ ID NO: 5045
  chr6:35150041-35150107
  hypo

SEQ ID NO: 14850 - DNA, 37 bp, Homo sapiens
  chr6:35309524-35309561
  hypo
ggcctaaggagcttgcggcctacggaaggtgtggccg

SEQ ID NO: 14851 - DNA, 30 bp, Homo sapiens
  chr6:36165619-36165649
  hypo
gggtgggacaaaacacgtctgtgtagagtc

SEQ ID NO: 14852 - DNA, 30 bp, Homo sapiens
  chr6:36831576-36831606
  hypo
tacttgatccacactcgatgtcacccttct

SEQ ID NO: 14853 - DNA, 251 bp, Homo sapiens; identical to SEQ ID NO: 5046
  chr6:37024382-37024633
  hypo

SEQ ID NO: 14854 - DNA, 30 bp, Homo sapiens
  chr6:37053276-37053306
  hypo
tgataaaacccctaccgatggctgatgact

SEQ ID NO: 14855 - DNA, 30 bp, Homo sapiens
  chr6:37391410-37391440
  hypo
tacctgggtggggttcgtcatctcacgctg

SEQ ID NO: 14856 - DNA, 36 bp, Homo sapiens; identical to SEQ ID NO: 5047
  chr6:42062066-42062102
  hypo

SEQ ID NO: 14857 - DNA, 23 bp, Homo sapiens
  chr6:42813507-42813530
  hypo
ttatagattcctggccgggcgcg

SEQ ID NO: 14858 - DNA, 38 bp, Homo sapiens
  chr6:42846392-42846430
  hypo
tttttgagactgtctcgctctgtcgcccaggctggagt

SEQ ID NO: 14859 - DNA, 37 bp, Homo sapiens
  chr6:42846610-42846647
  hypo
ttacaggtgaaagccaccggcccgacctactgttttt

SEQ ID NO: 14860 - DNA, 90 bp, Homo sapiens
  chr6:43424517-43424607
  hypo
ggcagaggtcaggaacgctagcgcccatctctagtccttcagattgagatttcaccatctttaaattcaaaacatcggaaggagcagtcg

SEQ ID NO: 14861 - DNA, 30 bp, Homo sapiens
  chr6:43425479-43425509
  hypo
agattatcactctgtcgcccaggctggagt

SEQ ID NO: 14862 - DNA, 30 bp, Homo sapiens
  chr6:43486338-43486368
  hypo
gagatgggtggaagtcgatcatcagagaag

SEQ ID NO: 14863 - DNA, 48 bp, Homo sapiens
  chr6:43748487-43748535
  hypo
ggaaaggggcaaaaacgaaagcgcaagaaatcccggtataagtcctgg

SEQ ID NO: 14864 - DNA, 30 bp, Homo sapiens
  chr6:44241078-44241108
  hypo
catgagctgcagcaccgtgttgatgtgagc

SEQ ID NO: 14865 - DNA, 41 bp, Homo sapiens
  chr6:44437145-44437186
  hypo
aaattcagctgggcacggtggctgacgcctgtaatcccagc

SEQ ID NO: 14866 - DNA, 25 bp, Homo sapiens
  chr6:52156895-52156920
  hypo
gtttcaaaactttggcgccgggcgc

SEQ ID NO: 14867 - DNA, 30 bp, Homo sapiens
  chr6:52268217-52268247
  hypo
ctttcagaaacacaacgaggtggtcaacgt

SEQ ID NO: 14868 - DNA, 180 bp, Homo sapiens; identical to SEQ ID NO: 5048
  chr6:52928863-52929043
  hypo

SEQ ID NO: 14869 - DNA, 30 bp, Homo sapiens
  chr6:57694608-57694638
  hypo
ctaaggacaaagaaccgccagtaacaacat

SEQ ID NO: 14870 - DNA, 23 bp, Homo sapiens
  chr6:74234189-74234212
  hypo
gaaaagatgatggcccggtgcgg

SEQ ID NO: 14871 - DNA, 102 bp, Homo sapiens
  chr6:84513455-84513557
  hypo
gctgttcctattcggccatcttggctcctcctcctaagctgtaactctattcatttcttatatacgtggctggttctgggtcccttgcggtaaaatgatgta

SEQ ID NO: 14872 - DNA, 97 bp, Homo sapiens; identical to SEQ ID NO: 1566
  chr6:86302345-86302442
  hypo

SEQ ID NO: 14873 - DNA, 81 bp, Homo sapiens
  chr6:89857646-89857727
  hypo
tgagcactgtagaaccgccaaaaaaaagctaaactttgagaaatgtacactcttttttttttttttttttttttgagacag

SEQ ID NO: 14874 - DNA, 30 bp, Homo sapiens
  chr6:90367322-90367352
  hypo
ttctgaaaaacaacacgaacctgattctcc

SEQ ID NO: 14875 - DNA, 29 bp, Homo sapiens
  chr6:99396702-99396731
  hypo
gctgggattacagccgtgagccaccgcgc

SEQ ID NO: 14876 - DNA, 30 bp, Homo sapiens
  chr6:105750542-105750572
  hypo
gaattgtggatgacacggatcttagagagc

SEQ ID NO: 14877 - DNA, 42 bp, Homo sapiens
  chr6:108280341-108280383
  hypo
ctccactgggcgacagatttgaatctacgctgtgcccatctt

SEQ ID NO: 14878 - DNA, 17 bp, Homo sapiens
  chr6:109057736-109057753
  hypo
tgttaggaatattctcg

SEQ ID NO: 14879 - DNA, 82 bp, Homo sapiens
  chr6:109059835-109059917
  hypo
gaaagagagggcttccgagaggaaaaagaaccagagaagagccagttggccatggatgtgccggatttcatagtcaggcttg

SEQ ID NO: 14880 - DNA, 30 bp, Homo sapiens
  chr6:116574057-116574087
  hypo
tctctgcaattctgtcgaattctagaaggc

SEQ ID NO: 14881 - DNA, 24 bp, Homo sapiens
  chr6:134067447-134067471
  hypo
gagccaccgcgcccagcctgcctg

SEQ ID NO: 14882 - DNA, 104 bp, Homo sapiens; identical to SEQ ID NO: 1568
  chr6:134589500-134589604
  hypo

SEQ ID NO: 14883 - DNA, 99 bp, Homo sapiens; identical to SEQ ID NO: 5053
  chr6:137144497-137144596
  hypo

SEQ ID NO: 14884 - DNA, 92 bp, Homo sapiens
  chr6:138790478-138790570
  hypo
aacataaggcttatgcgtttaatttccacaccaatttcaggatctttgtcactgacagcagcactaagacttgttaactttatatagttaag

SEQ ID NO: 14885 - DNA, 151 bp, Homo sapiens
  chr6:149177419-149177570
  hypo
gggattacaggagtgagccactgtggccagccgaaaaatatgttttgattaatattatgtaaggtaaataggggaaacgttcacaaagatgattcatgctaaacaaataaaaccagagccacatccatcagcataacgtagtgcaataaaa

SEQ ID NO: 14886 - DNA, 20 bp, Homo sapiens
  chr6:154970558-154970578
  hypo
gaaaaatggcattaccggcc

SEQ ID NO: 14887 - DNA, 30 bp, Homo sapiens
  chr6:155988231-155988261
  hypo
aaatagctctcccaccgctgatgccactta

SEQ ID NO: 14888 - DNA, 39 bp, Homo sapiens
  chr6:157478299-157478338
  hypo
tcggagatggctcaccgtgactcgcgcaccactgtctat

SEQ ID NO: 14889 - DNA, 30 bp, Homo sapiens
  chr6:157637384-157637414
  hypo
cagcttcctgtagctcgtcccaaggtccat

SEQ ID NO: 14890 - DNA, 30 bp, Homo sapiens
  chr6:157638386-157638416
  hypo
ccgcagtgctcctcccgagcctgcttcatt

SEQ ID NO: 14891 - DNA, 30 bp, Homo sapiens
  chr6:158119028-158119058
  hypo
cctggaagcaggtgtcgataaaaagagtca

SEQ ID NO: 14892 - DNA, 82 bp, Homo sapiens
  chr6:159049801-159049883
  hypo
tctggagcgtgcccacgccacgctgctttccacccagaggggcaggtgctgtgaggtaaatgaggtgcggttgcctctccac

SEQ ID NO: 14893 - DNA, 30 bp, Homo sapiens
  chr6:159569380-159569410
  hypo
gacttcagccgagaacgtgccagttgggtg

SEQ ID NO: 14894 - DNA, 55 bp, Homo sapiens
  chr6:160511899-160511954
  hypo
aaggagcaggtgctccgtgccctggtgctgagctcatcgccgagaaggagcaggt

SEQ ID NO: 14895 - DNA, 39 bp, Homo sapiens
  chr6:161672733-161672772
  hypo
gccaagcccacttcccgggccttacgtttcccattcaaa

SEQ ID NO: 14896 - DNA, 32 bp, Homo sapiens
  chr6:161690517-161690549
  hypo
taccgccagggcaggcgcggtggctcacgcct

SEQ ID NO: 14897 - DNA, 81 bp, Homo sapiens
  chr6:161780138-161780219
  hypo
tataggtgcatgccaatcccttcattttctaggagcactgctgcatgcaatggagtaataaggacacgctgggtaaattat

SEQ ID NO: 14898 - DNA, 41 bp, Homo sapiens
  chr6:162257990-162258031
  hypo
gggttttatgcctctcgttttcgctccgctcccacactcct

SEQ ID NO: 14899 - DNA, 18 bp, Homo sapiens
  chr6:164114295-164114313
  hypo
ttatttttttgagaccga

SEQ ID NO: 14900 - DNA, 44 bp, Homo sapiens
  chr6:164183729-164183773
  hypo
gctcaatgtttttaatgcaacagaccctgcggaaggtcagtaac

SEQ ID NO: 14901 - DNA, 22 bp, Homo sapiens
  chr6:164196996-164197018
  hypo
ctaaaagcgtcttctgacaaac

SEQ ID NO: 14902 - DNA, 18 bp, Homo sapiens
  chr6:164215474-164215492
  hypo
gggcctggtggctcacgc

SEQ ID NO: 14903 - DNA, 98 bp, Homo sapiens
  chr6:164228329-164228427
  hypo
ggcagtgggagtggccgtgcgggcctgctttgggaacagagggaccctccctgctgttctgttcacacggaagcgtgtctcagcgtctgggggcttgg

SEQ ID NO: 14904 - DNA, 34 bp, Homo sapiens
  chr6:164246109-164246143
  hypo
gtgagccaccgcaccgggccgatatggaatttct

SEQ ID NO: 14905 - DNA, 30 bp, Homo sapiens
  chr6:164283234-164283264
  hypo
gaagcatgtccccagcgtggcacagaaacc

SEQ ID NO: 14906 - DNA, 30 bp, Homo sapiens
  chr6:164288079-164288109
  hypo
aacttatgaacaagccggggcagctgctgt

SEQ ID NO: 14907 - DNA, 36 bp, Homo sapiens
  chr6:164322607-164322643
  hypo
ctgggttcccatgctcggcggcggctcctccacagg

SEQ ID NO: 14908 - DNA, 30 bp, Homo sapiens
  chr6:164323901-164323931
  hypo
ataaattcctaaaagcggaatttctgggtc

SEQ ID NO: 14909 - DNA, 30 bp, Homo sapiens
  chr6:166891687-166891717
  hypo
gcctgccacctgaggcggcacgtcccttgc

SEQ ID NO: 14910 - DNA, 145 bp, Homo sapiens
  chr6:166944367-166944512
  hypo
aggccgtcggcctgccggtatcgaggctggtttgtcaggccccatccagcccaacagcctgctcgcagcctgctgctctgctttcccaatgccgctccacggcagaacatatgtgggagaatggtatttacgcaatacagctctt

SEQ ID NO: 14911 - DNA, 32 bp, Homo sapiens
  chr6:167835094-167835126
  hypo
gctgttttccccccacgcggatcctcacctcc

SEQ ID NO: 14912 - DNA, 30 bp, Homo sapiens
  chr6:168453452-168453482
  hypo
gaaccaggcatgggccggcggcgagccggg

SEQ ID NO: 14913 - DNA, 174 bp, Homo sapiens
  chr6:168858122-168858296
  hypo
ctgcagtgacttcatcgccttgtgtttcccgtcgggtgcccagtaatcacaaagtggcctggagtcactgtttgtaaatacacaggagcctgcacccatcatatgtatgcggcagagtaatcctcccagaacatgagccccgcgtcacgtccttccagccgtgcttgtgatcac

SEQ ID NO: 14914 - DNA, 30 bp, Homo sapiens
  chr6:169562411-169562441
  hypo
tcgccaccccaaatgcgggcaccgcggcgc

SEQ ID NO: 14915 - DNA, 456 bp, Homo sapiens
  chr6:170475028-170475484
  hypo
ttcttgggtgacaatcgaggggtcctgacccagcacccgtgggcacacccttatttggaaattgggcctagcccggagtgatcatgaggccacgtgacatgggcgtgccagtctcaccaacgtgtgttttcacgggcaccacagagtctgttttctatgggtggggcagcggtgaacatatccctcttaatagcggtacgggtacggccagggaggcggcagaacgtagacagaacccgggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacg

SEQ ID NO: 14916 - DNA, 19 bp, Homo sapiens
  chr6:170894820-170894839
  hypo
tttgagatggagtctcgct

SEQ ID NO: 14917 - DNA, 24 bp, Homo sapiens
  chr7:328544-328568
  hypo
gattacaggcgtgagtcaccgtgc

SEQ ID NO: 14918 - DNA, 30 bp, Homo sapiens
  chr7:409617-409647
  hypo
cggtgccaccaaggccgctctcaggctgcc

SEQ ID NO: 14919 - DNA, 271 bp, Homo sapiens
  chr7:431429-431700
  hypo
tgaagccaccaggcacggggctgtgtgtgcagaagcagccaggcagggcggcccagcagacgcagggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcag

SEQ ID NO: 14920 - DNA, 36 bp, Homo sapiens
  chr7:497782-497818
  hypo
ctggcctcaggtccacggctgcggccacagagccca

SEQ ID NO: 14921 - DNA, 30 bp, Homo sapiens
  chr7:502957-502987
  hypo
ctgggacccagcctccggggagccgtgaag

SEQ ID NO: 14922 - DNA, 63 bp, Homo sapiens
  chr7:503811-503874
  hypo
gaggctgggtcccagcgctggggaaggacaccgggccctgagggccaacgccaaacccagacg

SEQ ID NO: 14923 - DNA, 30 bp, Homo sapiens
  chr7:551654-551684
  hypo
cctggggacaggccccgacaagacagggcg

SEQ ID NO: 14924 - DNA, 30 bp, Homo sapiens
  chr7:819668-819698
  hypo
tgtcaagggtgccaacgcaaaatcctacta

SEQ ID NO: 14925 - DNA, 404 bp, Homo sapiens
  chr7:834330-834734
  hypo
cagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccg

SEQ ID NO: 14926 - DNA, 83 bp, Homo sapiens
  chr7:1027233-1027316
  hypo
actgggacggctgagcgtctggtgggtgcctgatggcccagcgctccccgaccggaggcaataaagggcgtccagccaggagc

SEQ ID NO: 14927 - DNA, 47 bp, Homo sapiens; identical to SEQ ID NO: 5055
  chr7:1030172-1030219
  hypo

SEQ ID NO: 14928 - DNA, 172 bp, Homo sapiens
  chr7:1054524-1054696
  hypo
gccccttcctgcctgcgggccctccctgccctgcagggacggtgcagtgagcacaggtgtgcaggctgtgcggtgagagccccagggctgggaggagcaggcagccttggtccagcaggtcctgtgtgggggccgcgttgccgggcagggcctgacacggctgctgtgggct

SEQ ID NO: 14929 - DNA, 53 bp, Homo sapiens
  chr7:1086266-1086319
  hypo
tcagtttcttaggagcgtgctgtctacccaggagcctccgtgtgcaaacaaaa

SEQ ID NO: 14930 - DNA, 167 bp, Homo sapiens
  chr7:1308368-1308535
  hypo
gctgccggctggggacgcgggcgtggtgcggcaggcctgccttgattgtgtcgatgggagatgattttcaaggtgaaatttctagttcactagagtcactttcgttcaaggcgacgcacaaaatgtcatcccggcctgttccgcgtgcaacgcgctgttctcccatc

SEQ ID NO: 14931 - DNA, 178 bp, Homo sapiens
  chr7:1325704-1325882
  hypo
ccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtgg

SEQ ID NO: 14932 - DNA, 32 bp, Homo sapiens
  chr7:1351574-1351606
  hypo
tcagctctctctgtccgcggggctgtctccct

SEQ ID NO: 14933 - DNA, 43 bp, Homo sapiens
  chr7:1384833-1384876
  hypo
tggatgggcaggctgcgccgggctgatccgctgtgaacagcgg

SEQ ID NO: 14934 - DNA, 57 bp, Homo sapiens
  chr7:1395730-1395787
  hypo
ctccttgctgcctcccgccttgtcctcaacagccctgaagtccgtcctccactcagc

SEQ ID NO: 14935 - DNA, 61 bp, Homo sapiens
  chr7:1459019-1459080
  hypo
ccacttccacctgcccgggcctttgcacctgcaggttcgtaccctacggggtgtgccctgc

SEQ ID NO: 14936 - DNA, 30 bp, Homo sapiens
  chr7:1460840-1460870
  hypo
ggcagggtgcagaggcgtgcagcgctcacc

SEQ ID NO: 14937 - DNA, 30 bp, Homo sapiens
  chr7:1503566-1503596
  hypo
cgggaatgcagagggcgtgagagagaacca

SEQ ID NO: 14938 - DNA, 30 bp, Homo sapiens
  chr7:1598982-1599012
  hypo
tgcctggttccaggccggctgccctgctag

SEQ ID NO: 14939 - DNA, 30 bp, Homo sapiens
  chr7:1607971-1608001
  hypo
cccggaaaatgctatcgctgtaggggtatt

SEQ ID NO: 14940 - DNA, 89 bp, Homo sapiens; identical to SEQ ID NO: 1569
  chr7:1641847-1641936
  hypo

SEQ ID NO: 14941 - DNA, 145 bp, Homo sapiens
  chr7:1688977-1689122
  hypo
gcaaacagggatagtcgtgatccctcccttagggccggtgcttggaaagaatgaacgaacatgggtaaggtgtgcctggtgagcgctgtctgggctgaaggaggagtttgagaaggcggctttatgaagggaggtggccgggcgc

SEQ ID NO: 14942 - DNA, 30 bp, Homo sapiens
  chr7:1694042-1694072
  hypo
acccgggttccaaagcgcctacagtgaaca

SEQ ID NO: 14943 - DNA, 164 bp, Homo sapiens; identical to SEQ ID NO: 1570
  chr7:1733214-1733378
  hypo

SEQ ID NO: 14944 - DNA, 30 bp, Homo sapiens
  chr7:1734737-1734767
  hypo
ggcagcagacgtggccgacaggcacatggt

SEQ ID NO: 14945 - DNA, 59 bp, Homo sapiens
  chr7:1783243-1783302
  hypo
gagacctggcagacacgagtccccggacaggccagaatacctcccggtgcctccctccc

SEQ ID NO: 14946 - DNA, 41 bp, Homo sapiens
  chr7:1786828-1786869
  hypo
ggggccctgcagaggcgaggggggagcgagtggggacagac

SEQ ID NO: 14947 - DNA, 47 bp, Homo sapiens
  chr7:2110154-2110201
  hypo
gaagagaggccacaccggggagggtgcgagtccgcggagggagggcc

SEQ ID NO: 14948 - DNA, 59 bp, Homo sapiens
  chr7:2163332-2163391
  hypo
tttcagagtgcacttcgcaggcggcgctgaatcgatagatcctccggcggcgtggtgct

SEQ ID NO: 14949 - DNA, 52 bp, Homo sapiens
  chr7:2232930-2232982
  hypo
ctccgacagccaccacgtcctggagagaaagcgtccccgcccagaggacggt

SEQ ID NO: 14950 - DNA, 44 bp, Homo sapiens
  chr7:2233370-2233414
  hypo
gagcaggtgctgagccgcgatccgggagacgccagtctcaccct

SEQ ID NO: 14951 - DNA, 160 bp, Homo sapiens
  chr7:2564711-2564871
  hypo
gggtgggggaggctacggccgccgggcccagcttgaactagggggcttttctcgagcccctgggccctgtggcgtcccccaggccaggcccctctctgggagccggctcagacctactcacagccgctcccctgtccacaggcaacgtggtcatcacaaa

SEQ ID NO: 14952 - DNA, 30 bp, Homo sapiens
  chr7:2566628-2566658
  hypo
cagggtctctctaagcggcatgactctaca

SEQ ID NO: 14953 - DNA, 210 bp, Homo sapiens
  chr7:2686448-2686658
  hypo
ggtccacccctccagcgccgcttcctgcctgccctcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcaggt

SEQ ID NO: 14954 - DNA, 28 bp, Homo sapiens
  chr7:2731870-2731898
  hypo
gggttgaaagaggaccgagcttggccgg

SEQ ID NO: 14955 - DNA, 35 bp, Homo sapiens
  chr7:2798456-2798491
  hypo
tgagagggttatcaccgcatgtatcaacatgatgg

SEQ ID NO: 14956 - DNA, 30 bp, Homo sapiens
  chr7:3033477-3033507
  hypo
gtctcccttctagctcgccaaatgctcagg

SEQ ID NO: 14957 - DNA, 190 bp, Homo sapiens; identical to SEQ ID NO: 5058
  chr7:3283704-3283894
  hypo

SEQ ID NO: 14958 - DNA, 61 bp, Homo sapiens
  chr7:4214953-4215014
  hypo
acagtagaagggccccgggatgcggctgggcttacgcacctggtcgcgcagctctccctga

SEQ ID NO: 14959 - DNA, 30 bp, Homo sapiens
  chr7:4751426-4751456
  hypo
accgtagagaagcaacgcaaggtcagagag

SEQ ID NO: 14960 - DNA, 82 bp, Homo sapiens
  chr7:4781972-4782054
  hypo
cactctgctgaaccccggccgcaccttggcttgcttttttctttttttcctcttgcagctgtaggagaagaaagggcttttg

SEQ ID NO: 14961 - DNA, 87 bp, Homo sapiens
  chr7:4813783-4813870
  hypo
ccagtcttcaacctgcggctccaggggcacccgccgcactccaccgactcccatccaccgctcaccatccaccgattcccatctctt

SEQ ID NO: 14962 - DNA, 161 bp, Homo sapiens
  chr7:4840190-4840351
  hypo
tcgcccctctgggggcggctgttttccagctccagggacccacgcggttctgtgccacctcctcagcaatctctgctcctcctcctcctccctccacacccagatgtggccatgtgcaccctgagggttcccaccgctgaccagaccggggccccaggccc

SEQ ID NO: 14963 - DNA, 50 bp, Homo sapiens
  chr7:4841057-4841107
  hypo
agtatctgcccaagacgtgtcagcgactgagcgaccgtgtggcccagctg

SEQ ID NO: 14964 - DNA, 177 bp, Homo sapiens
  chr7:4856871-4857048
  hypo
tggagacatagtagacgcactgctggaaggcgtacagcaccacctcctccagcaccgccatggcctcctcgctggccgtcagcgtgcaggagaacagcgattccttcgagcctgccgggagacagccacgccaatggtcacaacgggcacagcgctcaggaacgcagcaactcagcc

SEQ ID NO: 14965 - DNA, 30 bp, Homo sapiens
  chr7:5316401-5316431
  hypo
tctccactgcgtgtacggattgacgggaaa

SEQ ID NO: 14966 - DNA, 23 bp, Homo sapiens
  chr7:5589502-5589525
  hypo
agtaagtgaagaggccgggcgcg

SEQ ID NO: 14967 - DNA, 35 bp, Homo sapiens
  chr7:5647869-5647904
  hypo
gtcccaggtgagatgcgggtcgagggagccaggcc

SEQ ID NO: 14968 - DNA, 56 bp, Homo sapiens
  chr7:5648363-5648419
  hypo
ttctcccaggtgggtcgggggccactagggaccccataccccgagggtggctcctc

SEQ ID NO: 14969 - DNA, 85 bp, Homo sapiens; identical to SEQ ID NO: 1571
  chr7:6124629-6124714
  hypo

SEQ ID NO: 14970 - DNA, 37 bp, Homo sapiens
  chr7:6143252-6143289
  hypo
cttgggcggtggctccggagtgtaatcccagcgcttt

SEQ ID NO: 14971 - DNA, 113 bp, Homo sapiens
  chr7:6443323-6443436
  hypo
tctttacctcgcccacgcggacacacgcctcctgtagtcgctttgcctattgatgttcctttgggtctgtgaggttctgtaaactgtgctagtgctgacgatgttctgtacaa

SEQ ID NO: 14972 - DNA, 86 bp, Homo sapiens
  chr7:6499253-6499339
  hypo
gatggctgggtggtacgaggacagaggcacacagaaaacacccacgcagatccaatcaagctagcctcagatgggtggctgctttt

SEQ ID NO: 14973 - DNA, 180 bp, Homo sapiens; identical to SEQ ID NO: 5060
  chr7:6524907-6525087
  hypo

SEQ ID NO: 14974 - DNA, 189 bp, Homo sapiens
  chr7:6560212-6560401
  hypo
gctggaagaagctctcgagggcccggcagaccccatagcgctcaggaggtgtgagtaggtgctccagctgctggctgaaggtcctcccttggacccggatgctggacggcaggatctccgccacccactgcagggaggtgagcgccgacgacgggttgggtgagtccagagaatcggagtctgctggga

SEQ ID NO: 14975 - DNA, 30 bp, Homo sapiens
  chr7:7102938-7102968
  hypo
attgttttttttttccggcaatgaagaaat

SEQ ID NO: 14976 - DNA, 273 bp, Homo sapiens; identical to SEQ ID NO: 1572
  chr7:7605157-7605430
  hypo

SEQ ID NO: 14977 - DNA, 152 bp, Homo sapiens; identical to SEQ ID NO: 1573
  chr7:7605670-7605822
  hypo

SEQ ID NO: 14978 - DNA, 24 bp, Homo sapiens
  chr7:20710238-20710262
  hypo
aagaagcaagctggccgggtgcgg

SEQ ID NO: 14979 - DNA, 24 bp, Homo sapiens
  chr7:25132702-25132726
  hypo
gcgatactccgtctcaaaaaaaaa

SEQ ID NO: 14980 - DNA, 186 bp, Homo sapiens
  chr7:25495487-25495673
  hypo
cgaactagtcagtcccgtggtgacgtcaggattatctttctctcacttcagtgcctctgggacttaataggtgcacgaagaatatttataggtgcctgagaaatgcttgccgagaaatgactggctgttccaaggcatttccagggcaaggcagtccagtctgtgccgggccgggcggttgtagag

SEQ ID NO: 14981 - DNA, 29 bp, Homo sapiens
  chr7:25530898-25530927
  hypo
aatttgtattaaaggcggggcgcagtgac

SEQ ID NO: 14982 - DNA, 30 bp, Homo sapiens
  chr7:31116621-31116651
  hypo
ttcgggggtgtggggcggtgtaaaaacagg

SEQ ID NO: 14983 - DNA, 84 bp, Homo sapiens; identical to SEQ ID NO: 5064
  chr7:36428640-36428724
  hypo

SEQ ID NO: 14984 - DNA, 30 bp, Homo sapiens
  chr7:37264509-37264539
  hypo
gatggtgatctcctgcgccactttctggta

SEQ ID NO: 14985 - DNA, 181 bp, Homo sapiens
  chr7:37279183-37279364
  hypo
aacagagattgagtacgagtttgggcaatgcctgtggaagataaagcaggcagaaagcaggattgagtatggaaagccttgggaccatgaaacagatctgatgcctgcgaagggaaggggaagaagcaaatgcagatctgaaaatgtctcagccaactcagtggaacgctgcagaataaac

SEQ ID NO: 14986 - DNA, 39 bp, Homo sapiens
  chr7:37770953-37770992
  hypo
caagcaagtcatgcacgtggagaacgaggtgtctctctg

SEQ ID NO: 14987 - DNA, 30 bp, Homo sapiens
  chr7:38740329-38740359
  hypo
cttgttttctgagctcgctgggggattgat

SEQ ID NO: 14988 - DNA, 17 bp, Homo sapiens
  chr7:43767864-43767881
  hypo
tacgttttaaatggtga

SEQ ID NO: 14989 - DNA, 33 bp, Homo sapiens
  chr7:43865061-43865094
  hypo
gtaaagatggaaaagcggctgtctagtagagac

SEQ ID NO: 14990 - DNA, 93 bp, Homo sapiens
  chr7:43865154-43865247
  hypo
tatttattaaagaacttttacaaccttaaactcactctggactttccagccttatgttgggggttacaagtggcgccccgaacagcaacagga

SEQ ID NO: 14991 - DNA, 28 bp, Homo sapiens
  chr7:44083432-44083460
  hypo
gagccaccgtgcccggcaggatttatat

SEQ ID NO: 14992 - DNA, 30 bp, Homo sapiens
  chr7:44151353-44151383
  hypo
tgtcccccagaccctcgggtatgaggtggg

SEQ ID NO: 14993 - DNA, 41 bp, Homo sapiens; identical to SEQ ID NO: 5065
  chr7:44151615-44151656
  hypo

SEQ ID NO: 14994 - DNA, 30 bp, Homo sapiens
  chr7:44152191-44152221
  hypo
ggagaagaaccccttcgtgctgggagcaaa

SEQ ID NO: 14995 - DNA, 264 bp, Homo sapiens; identical to SEQ ID NO: 1574
  chr7:44835120-44835384
  hypo

SEQ ID NO: 14996 - DNA, 20 bp, Homo sapiens
  chr7:45027140-45027160
  hypo
cagagcgagactctgtctca

SEQ ID NO: 14997 - DNA, 30 bp, Homo sapiens
  chr7:50294451-50294481
  hypo
atttttatcatgaatcggtattcaattgta

SEQ ID NO: 14998 - DNA, 158 bp, Homo sapiens
  chr7:50438618-50438776
  hypo
aagcagttccagctccgagtaacagaggaaggagtgagcgatttaggaactcacagaagggcacggccaggcaactcgggccctggcaaatgttccatagagacagcatccatggggttgaaccaagcacaatgcctgcaaatcgggcaggcgggttc

SEQ ID NO: 14999 - DNA, 49 bp, Homo sapiens
  chr7:50560588-50560637
  hypo
ggggcatcagctctgcggcaggcactccacgtcccgaaaggctcaactc

SEQ ID NO: 15000 - DNA, 30 bp, Homo sapiens
  chr7:54794762-54794792
  hypo
gtcctgcacacagtacgccactacccgggg

SEQ ID NO: 15001 - DNA, 37 bp, Homo sapiens
  chr7:55145943-55145980
  hypo
acaccccaagccccgcgtcccgcgtcctcactgtcct

SEQ ID NO: 15002 - DNA, 78 bp, Homo sapiens; identical to SEQ ID NO: 5068
  chr7:56018123-56018201
  hypo

SEQ ID NO: 15003 - DNA, 91 bp, Homo sapiens
  chr7:65880043-65880134
  hypo
ttcagtttactgcttcgatatcttttcctaattgattgttaattaagttctgcctagcaagtataaaaacctctgcctcctgggttcaatc

SEQ ID NO: 15004 - DNA, 42 bp, Homo sapiens
  chr7:69036110-69036152
  hypo
gtcttcttactgggccgggcatggtggctcacgcctgtaatc

SEQ ID NO: 15005 - DNA, 179 bp, Homo sapiens
  chr7:69313694-69313873
  hypo
acaagtcccatttcccgctttctcctttttttcttaagactgtctagggaaggagctttagataaactatacatccagcacaacattcaattgtctgcacaattgagttagcctactttatttgacttttatgtttacatttgaagtggactccccccgccccccgccaccaccttttc

SEQ ID NO: 15006 - DNA, 30 bp, Homo sapiens
  chr7:97600117-97600147
  hypo
gtcgacctcttgtgtcgcacatgctaatga

SEQ ID NO: 15007 - DNA, 41 bp, Homo sapiens
  chr7:97797757-97797798
  hypo
tttcattagcagaagcgggggtgttgcgctgtctatatcat

SEQ ID NO: 15008 - DNA, 30 bp, Homo sapiens
  chr7:97869614-97869644
  hypo
gcatttgggtaccagcgtgtgggtggaaga

SEQ ID NO: 15009 - DNA, 198 bp, Homo sapiens
  chr7:98183080-98183278
  hypo
tcttacccttgcaaccgaagtctttgcacagcttcactgtggggtggagttcctggcagtgatatatttgtagtgctgctatttaactgggtgatttgccttggcagctgctgagatctcagatctcacagagatttgagacttaatcacccgcagcaccaacaaagacctgctctttttatgcggctaaaaaaaata

SEQ ID NO: 15010 - DNA, 20 bp, Homo sapiens
  chr7:98971529-98971549
  hypo
ccggccgaggtaaggttttc

SEQ ID NO: 15011 - DNA, 30 bp, Homo sapiens
  chr7:98991702-98991732
  hypo
cactggcatggatggcggcatgagtatctg

SEQ ID NO: 15012 - DNA, 273 bp, Homo sapiens
  chr7:99020719-99020992
  hypo
caagtctccatctatcgcccaggctggagtgcagtggcgcgatcttggctcacaacaaatctcaggtattcaccccagacaatgacaccacttcactgcctgcccagtccctgagcaagcgacaacctgtttggagtacccagcaacgtgcaggtgctggggacccagatgagcacagcagacagcctctgcctccagaagcctgatacagggaaggccagggctgcccatgagcacatgatccaagactgtaggacacggcataaaggaaca

SEQ ID NO: 15013 - DNA, 37 bp, Homo sapiens
  chr7:99700198-99700235
  hypo
actagtaagaggcatcgggatccgagctcaggtctcc

SEQ ID NO: 15014 - DNA, 79 bp, Homo sapiens
  chr7:100088134-100088213
  hypo
agcagaggtcgaggacggtgcccgggcctggaatggcagtgccgagggtccaggcaaggtggagcgtgaggacaggggc

SEQ ID NO: 15015 - DNA, 30 bp, Homo sapiens
  chr7:100179772-100179802
  hypo
agcgacagctggtttcggctgtggaaggga

SEQ ID NO: 15016 - DNA, 30 bp, Homo sapiens
  chr7:100799119-100799149
  hypo
ggcgtcggttactgtcgtcttgtcactgtg

SEQ ID NO: 15017 - DNA, 67 bp, Homo sapiens; identical to SEQ ID NO: 5069
  chr7:101652623-101652690
  hypo

SEQ ID NO: 15018 - DNA, 78 bp, Homo sapiens
  chr7:101656381-101656459
  hypo
attctgccattctgccgtcataccaaaaaaaaaaaaaaagcaccatcccagggttatgaatgacgttactgtctttgg

SEQ ID NO: 15019 - DNA, 30 bp, Homo sapiens
  chr7:101707502-101707532
  hypo
agagtgtgtgtgaaacggagttttgctgtg

SEQ ID NO: 15020 - DNA, 24 bp, Homo sapiens
  chr7:102782042-102782066
  hypo
atcttcttagattcacggtatctt

SEQ ID NO: 15021 - DNA, 48 bp, Homo sapiens
  chr7:105279623-105279671
  hypo
ctgcatacattaaaacgtagcaggctttagaaccgcctgtgagtgcct

SEQ ID NO: 15022 - DNA, 148 bp, Homo sapiens
  chr7:107483719-107483867
  hypo
aggacaccacccaggcgaggagccagaaagagcagccgcagcaggtggagcgcatgggcagaggggcggtggtgggacacgcgactgtttgggattgagcgaggccacctaagcagattgcggtgagtgagcgcggaatgacgtcact

SEQ ID NO: 15023 - DNA, 30 bp, Homo sapiens; identical to SEQ ID NO: 1575
  chr7:128097589-128097619
  hypo

SEQ ID NO: 15024 - DNA, 30 bp, Homo sapiens
  chr7:128493200-128493230
  hypo
gtctgcgtcaggattcgcattctggggccc

SEQ ID NO: 15025 - DNA, 30 bp, Homo sapiens
  chr7:128528857-128528887
  hypo
gtgagaaaggcaccccgggagccccagcag

SEQ ID NO: 15026 - DNA, 30 bp, Homo sapiens
  chr7:128529102-128529132
  hypo
aagagacagagaggccgaggggagggacag

SEQ ID NO: 15027 - DNA, 77 bp, Homo sapiens
  chr7:129794662-129794739
  hypo
gtgcaacccccatgccgcagcccgtcgcctcctgctccagcctccgccaggactgtcctgtgcgcccatcagggtgt

SEQ ID NO: 15028 - DNA, 30 bp, Homo sapiens
  chr7:131041536-131041566
  hypo
cgccaaatatgttgccggtggcagataccc

SEQ ID NO: 15029 - DNA, 30 bp, Homo sapiens
  chr7:131231034-131231064
  hypo
ggagtgtacagtgggcgtgtccaggagctg

SEQ ID NO: 15030 - DNA, 57 bp, Homo sapiens
  chr7:134918564-134918621
  hypo
gacccagacaggaaccgcgatccccactccggcgcacgaagccgggtgactgctgtc

SEQ ID NO: 15031 - DNA, 20 bp, Homo sapiens
  chr7:135196094-135196114
  hypo
tttttttttttgagacggag

SEQ ID NO: 15032 - DNA, 135 bp, Homo sapiens
  chr7:135401363-135401498
  hypo
aatttattaattcaacggaggattttggtcacattgcctggggggttaagagctcaagttctggaatcatacaatcttggattcaagtcccagctccaccacttagtagctgcataaccgcgggtaagtaagtta

SEQ ID NO: 15033 - DNA, 30 bp, Homo sapiens
  chr7:137664095-137664125
  hypo
aaagcacagcaagggcgggtcatcaggcca

SEQ ID NO: 15034 - DNA, 41 bp, Homo sapiens
  chr7:139650651-139650692
  hypo
ctcgccctccatctacgggaccccctcgccctccatctaca

SEQ ID NO: 15035 - DNA, 21 bp, Homo sapiens
  chr7:140026923-140026944
  hypo
acggagcgagattctgtctca

SEQ ID NO: 15036 - DNA, 16 bp, Homo sapiens
  chr7:140097283-140097299
  hypo
gcgcccaacccgaagc

SEQ ID NO: 15037 - DNA, 30 bp, Homo sapiens
  chr7:140156648-140156678
  hypo
atgggcctcaatgcacgactagagaaggtg

SEQ ID NO: 15038 - DNA, 95 bp, Homo sapiens; identical to SEQ ID NO: 5071
  chr7:148640241-148640336
  hypo

SEQ ID NO: 15039 - DNA, 105 bp, Homo sapiens
  chr7:148846075-148846180
  hypo
cttaaattctctaggcgtcacgtttaaaaagtaaaaagccaggcgctgtgttgtgcacgcctgtagtcccagctaggccgggggctgaggcggaagaatcacttg

SEQ ID NO: 15040 - DNA, 97 bp, Homo sapiens
  chr7:150049533-150049630
  hypo
accagaatgtcttatcgttgaaattattttttacttccttttgaaatgcttgagtttttttgtttgttttggtttggtttttgagacggagtctcgc

SEQ ID NO: 15041 - DNA, 30 bp, Homo sapiens
  chr7:150070259-150070289
  hypo
tgtgtgctaaggctccgtcctgactgccct

SEQ ID NO: 15042 - DNA, 76 bp, Homo sapiens
  chr7:150746248-150746324
  hypo
aacatcaacccactgcgccgctcgcgcctaacgcccaacgacctgcactgggctgggtctgcgctgctgggcctgg

SEQ ID NO: 15043 - DNA, 99 bp, Homo sapiens
  chr7:150774704-150774803
  hypo
cacctgtacttgcagcgggcacggtcggtgatgagaggctggggaaagatgggcacttgctgccttcggggaaggcggggaccccggtatcctgggagc

SEQ ID NO: 15044 - DNA, 30 bp, Homo sapiens
  chr7:150823844-150823874
  hypo
cctggaagactccttcgcagaccaagaggc

SEQ ID NO: 15045 - DNA, 92 bp, Homo sapiens
  chr7:150870816-150870908
  hypo
ctccaaactctttcccgcaccagcgagcccgcactcgcatgatacccagacctgcgctcgacctggccccagatccccgtgccaagggccac

SEQ ID NO: 15046 - DNA, 57 bp, Homo sapiens
  chr7:150871142-150871199
  hypo
tctggcctggaccaccgccgcaggtgccccccgacccacgcccgcagccaggacggt

SEQ ID NO: 15047 - DNA, 30 bp, Homo sapiens
  chr7:151591649-151591679
  hypo
ggctcaagccctccccgatccctccgccct

SEQ ID NO: 15048 - DNA, 43 bp, Homo sapiens
  chr7:152337501-152337544
  hypo
ctgctgaccaaagtactgggattacaggcgtgaaccaccgacc

SEQ ID NO: 15049 - DNA, 175 bp, Homo sapiens
  chr7:152693809-152693984
  hypo
ccagaggaaataacccgcatggcaactcacggcaagaagtgtccttctagggaaaggagttttcatccatgtgcacactctccaagcagagcctctggatctgggtaaatatgtctgtggggtcatgtggggtgcgtagtgttggaatgagcatatactgcgttgttcattgatg

SEQ ID NO: 15050 - DNA, 39 bp, Homo sapiens
  chr7:154561150-154561189
  hypo
cacactggtggtctccggatggcacgagactcgcctacg

SEQ ID NO: 15051 - DNA, 30 bp, Homo sapiens
  chr7:154670104-154670134
  hypo
ggagcgtgtggacaacggcaaagcttagag

SEQ ID NO: 15052 - DNA, 32 bp, Homo sapiens
  chr7:155202839-155202871
  hypo
catgcggggagggggcgcggggagggggcgca

SEQ ID NO: 15053 - DNA, 43 bp, Homo sapiens
  chr7:155363419-155363462
  hypo
cctcacaggcccctccgcgagtgctgggcgtgcagcagacaaa

SEQ ID NO: 15054 - DNA, 44 bp, Homo sapiens
  chr7:155580846-155580890
  hypo
tcaggtttccccaggcggagcgctcagcatatcgacagctaaaa

SEQ ID NO: 15055 - DNA, 223 bp, Homo sapiens; identical to SEQ ID NO: 1576
  chr7:155581330-155581553
  hypo

SEQ ID NO: 15056 - DNA, 92 bp, Homo sapiens
  chr7:155581765-155581857
  hypo
ttgtgtgggtccccacgtggtcaccagcgtcctttcaggacaagagaaaactgagcaggaccagggcttccgcctgccgcattcatctgccc

SEQ ID NO: 15057 - DNA, 63 bp, Homo sapiens
  chr7:155582277-155582340
  hypo
tgtgcgtgtttaacccgcccagagactggtgctgccgcatttgttcatcggtttgttttgttt

SEQ ID NO: 15058 - DNA, 100 bp, Homo sapiens
  chr7:155753587-155753687
  hypo
gagcgtgtgtgtgtgtgtgtgtgtgtgtgtgtgtgttagaatcctgccctgagctggccttcaggaaggtgaattccggtttctgcgcactctgcactct

SEQ ID NO: 15059 - DNA, 131 bp, Homo sapiens
  chr7:155899015-155899146
  hypo
agctttcagttagatcgcagctcctggattgagctgtatacccaaacccagctatatgctctttacaagcacatacaataaagtgacagaaagggatccaaaaagtgtactgggtgcgtgcacggagggaa

SEQ ID NO: 15060 - DNA, 97 bp, Homo sapiens; identical to SEQ ID NO: 5073
  chr7:156744702-156744799
  hypo

SEQ ID NO: 15061 - DNA, 33 bp, Homo sapiens
  chr7:156832223-156832256
  hypo
aggtcacattccccacggcgagtctgctcagat

SEQ ID NO: 15062 - DNA, 69 bp, Homo sapiens
  chr7:156832823-156832892
  hypo
aagcggacttgggagcgacggggtttgggcatctgggagacgggaactccttcccgggaggaagaccgt

SEQ ID NO: 15063 - DNA, 40 bp, Homo sapiens
  chr7:156880549-156880589
  hypo
tgctcacggacagcacggccctcggcgtggatatccggaa

SEQ ID NO: 15064 - DNA, 63 bp, Homo sapiens
  chr7:157084534-157084597
  hypo
cagtggcctcccacccgccgtggcaggacaagcagagtgtggtctccacgcaagaggctggag

SEQ ID NO: 15065 - DNA, 144 bp, Homo sapiens
  chr7:157085343-157085487
  hypo
gggggaggccaggaccgtggagttctagagggggcaccaagggcccgtgtgtccgcgtggagctggacatgcttctgtgggccaggcaccctgaccctgatcctctccagtgaagaggccgggggcaggcggaactgggtcagg

SEQ ID NO: 15066 - DNA, 169 bp, Homo sapiens
  chr7:157085946-157086115
  hypo
gagcctctgctcccacggtctcaggccctccccgccctgatgagtctccgctcccaacacaagggccacgtggtctggagggaccttttgcccagctgcaggggccatctcagggagaccccgccttggaggacttgttctccggatctccagacgtttaggctgaaag

SEQ ID NO: 15067 - DNA, 239 bp, Homo sapiens
  chr7:157255083-157255322
  hypo
tggggcgaggctggacgctgccatccagcacccagctcgtttcggcctgggctgccctcagcactgcgcagacccgcgagctcctcatttccccggaagatgaacgagaaggttcgcgcgagattctctgcaaagccctggcacaggccccgtccctgcagctgtttattgacgctgtggcggccgagacggcatgtttggaaatctgcttggcatggagactgcggtgccctgaccac

SEQ ID NO: 15068 - DNA, 884 bp, Homo sapiens; identical to SEQ ID NO: 5074
  chr7:157262579-157263463
  hypo

SEQ ID NO: 15069 - DNA, 30 bp, Homo sapiens
  chr7:157294288-157294318
  hypo
gcacacagcttttgccgtcgtttggagaat

SEQ ID NO: 15070 - DNA, 57 bp, Homo sapiens
  chr7:157337964-157338021
  hypo
tgtgagcagtgtgcacggctgtatgtgggtgtgtaccacatgcgtgggtgtgtaggt

SEQ ID NO: 15071 - DNA, 43 bp, Homo sapiens
  chr7:157353030-157353073
  hypo
gcagtgctgcccacacggatgcccagagcgtgttccccaagac

SEQ ID NO: 15072 - DNA, 65 bp, Homo sapiens
  chr7:157396449-157396514
  hypo
atgttctacaagtcacggaacccaccgcccagcgtgagccgggacccacacggctcataaacagc

SEQ ID NO: 15073 - DNA, 167 bp, Homo sapiens
  chr7:157403604-157403771
  hypo
gtcattcagggcctccgcagctcagcatacaatgctgcatctgggcagactgggacaggctggggctcatatccagaaagccctgctacatccagagatggtcatgaaaatgagacctgccccacccaccactcaggaggcacgctgctcaccgctgagctgaataa

SEQ ID NO: 15074 - DNA, 32 bp, Homo sapiens
  chr7:157448480-157448512
  hypo
atgcacggccacacacgcgtgatcactccagc

SEQ ID NO: 15075 - DNA, 48 bp, Homo sapiens
  chr7:157565500-157565548
  hypo
cttctctggcctctgcgccccagctcctttgtgcgaggtcccatgtgc

SEQ ID NO: 15076 - DNA, 30 bp, Homo sapiens
  chr7:157568187-157568217
  hypo
cctgaatacaggactcgatgcctcgaggag

SEQ ID NO: 15077 - DNA, 63 bp, Homo sapiens
  chr7:157584178-157584241
  hypo
cacacgcctgcctggcgccagcctgcctgtcctccctgcacccgcccccgctccctgcaccca

SEQ ID NO: 15078 - DNA, 30 bp, Homo sapiens
  chr7:157588586-157588616
  hypo
cacatgtgatgctgacgccctcagaaacct

SEQ ID NO: 15079 - DNA, 30 bp, Homo sapiens
  chr7:157588963-157588993
  hypo
caactgctgatgttacgtgcactaagcaca

SEQ ID NO: 15080 - DNA, 46 bp, Homo sapiens
  chr7:157606706-157606752
  hypo
gcctcttcagagctgcgagactgtgcccacgcgaggcagtggtcgc

SEQ ID NO: 15081 - DNA, 30 bp, Homo sapiens
  chr7:157633412-157633442
  hypo
atccagagcctccagcgttttcacccagtg

SEQ ID NO: 15082 - DNA, 192 bp, Homo sapiens
  chr7:157659256-157659448
  hypo
ggtctgcaggaaacacgtccatagaggtggagctgaggctggtgtgcattctcccaggcacccagcatgagtgcccagctcagggtctgcaccgaggctgtctggcccgagtcccaggctcgccccagtgcttgccacacacaccctggggtctcctcagaagcagtgcctgtgccccgagatgcacggcca

SEQ ID NO: 15083 - DNA, 161 bp, Homo sapiens
  chr7:157776781-157776942
  hypo
agccatggagacagccgggaacccagcagccttctttattctggctcatattttctcatcattctcagggagttgtccaggtaacaatgaccttgtgtaaaccagcgtccctgcctgagtcctcttcacctgaaaccaccgccccacgccaggctccacct

SEQ ID NO: 15084 - DNA, 30 bp, Homo sapiens
  chr7:157793858-157793888
  hypo
gcaggtctggtgcaacgtggggctggggtc

SEQ ID NO: 15085 - DNA, 30 bp, Homo sapiens
  chr7:157877477-157877507
  hypo
cgatgcccatccacacggatgcccatacac

SEQ ID NO: 15086 - DNA, 30 bp, Homo sapiens
  chr7:157958638-157958668
  hypo
ccagacagggggcttcggaggatgtggcaa

SEQ ID NO: 15087 - DNA, 34 bp, Homo sapiens
  chr7:158301521-158301555
  hypo
cggggcaacgtgggacgctcggagcaggtgcgga

SEQ ID NO: 15088 - DNA, 140 bp, Homo sapiens
  chr8:972710-972850
  hypo
tggacagtaccgtgccgaggtagatgctccaaccacaatccaccctccctgggagtggacagtcccatgccgaggtagacactccagccgccacccatcccccccgggagtggatggttccgtgccgaggtagacactcc

SEQ ID NO: 15089 - DNA, 30 bp, Homo sapiens
  chr8:1048584-1048614
  hypo
cccacaccaggctcccggccgcccacgggc

SEQ ID NO: 15090 - DNA, 88 bp, Homo sapiens
  chr8:1137245-1137333
  hypo
ggaatctcacacacacgggacctctgtgacgtttgtctcatggaatctcacatgcccgggacctctgtgacatttccctcacacgccc

SEQ ID NO: 15091 - DNA, 99 bp, Homo sapiens
  chr8:1246701-1246800
  hypo
actggggtataaatacggtttcatggggacacacaggagggagctgagtgtgctcctctggccccggagagtgctgagaggcagcgtaccctgcagaag

SEQ ID NO: 15092 - DNA, 102 bp, Homo sapiens
  chr8:1302692-1302794
  hypo
aacgaaaagaaaataccttggaatgaaagactgtggggccattaagatgatgctgtgggtgaaggtggaaagtcacggatgatgctgcggatgaaggtggaa

SEQ ID NO: 15093 - DNA, 37 bp, Homo sapiens
  chr8:1471545-1471582
  hypo
gatttgccggcctcacgccggccgagccactgctgac

SEQ ID NO: 15094 - DNA, 30 bp, Homo sapiens
  chr8:2652772-2652802
  hypo
atactatgggaacagcggactgaaggcatc

SEQ ID NO: 15095 - DNA, 28 bp, Homo sapiens
  chr8:8639463-8639491
  hypo
agcgggatgcagccgtagggccagccac

SEQ ID NO: 15096 - DNA, 30 bp, Homo sapiens
  chr8:8639731-8639761
  hypo
agcagggcagaagaacgccccccagcaacc

SEQ ID NO: 15097 - DNA, 30 bp, Homo sapiens
  chr8:8748683-8748713
  hypo
agctaacaggcaacacgggggagaggatct

SEQ ID NO: 15098 - DNA, 30 bp, Homo sapiens
  chr8:8748926-8748956
  hypo
ccagctcacgctctccgcacaggtctgcgt

SEQ ID NO: 15099 - DNA, 117 bp, Homo sapiens
  chr8:10529008-10529125
  hypo
tggacaccccacaggcggcgcaggtccgcaggtatccgttctttggggagaggtgtggtgagtcgcacactccaagacagagaggggtgaacaccgccactgcgtaaatgtgtgagt

SEQ ID NO: 15100 - DNA, 38 bp, Homo sapiens
  chr8:11706106-11706144
  hypo
gccgccagtgaacaccgctactgcggaaccaaggcgag

SEQ ID NO: 15101 - DNA, 27 bp, Homo sapiens
  chr8:13654937-13654964
  hypo
gttatgggccgggtgcggtggctcaca

SEQ ID NO: 15102 - DNA, 30 bp, Homo sapiens
  chr8:23290404-23290434
  hypo
ttccttttgagtcttcgtggagctgtgagc

SEQ ID NO: 15103 - DNA, 38 bp, Homo sapiens
  chr8:23399594-23399632
  hypo
gtcagcaccacataacgatgtttcggtcaactatggac

SEQ ID NO: 15104 - DNA, 152 bp, Homo sapiens
  chr8:23423918-23424070
  hypo
tccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcct

SEQ ID NO: 15105 - DNA, 117 bp, Homo sapiens
  chr8:25397086-25397203
  hypo
cggctggctgctgggcgtgtagcgatcactgaggacaggtcagcctggggatttggagcgcagctacctgcagtacctgttctaactccgtctgtgtcggagcgcccttctgttatc

SEQ ID NO: 15106 - DNA, 39 bp, Homo sapiens; identical to SEQ ID NO: 5075
  chr8:37961863-37961902
  hypo

SEQ ID NO: 15107 - DNA, 58 bp, Homo sapiens
  chr8:42144632-42144690
  hypo
ggcagctggagtgcccgaggccagagccgctttccctgctgcccgtgccacagcctca

SEQ ID NO: 15108 - DNA, 30 bp, Homo sapiens
  chr8:42699267-42699297
  hypo
ctgtgttgcaaatagcgaactgctgcagca

SEQ ID NO: 15109 - DNA, 32 bp, Homo sapiens; identical to SEQ ID NO: 5076
  chr8:42749968-42750000
  hypo

SEQ ID NO: 15110 - DNA, 115 bp, Homo sapiens
  chr8:47093290-47093405
  hypo
tcccaccattccctgcggcctcgctgctacccccatctgccagcctcaacatccccatgagtccctatgtcctgtccacaccgcaccgaggccaagttttcgctagtggcggcct

SEQ ID NO: 15111 - DNA, 92 bp, Homo sapiens
  chr8:47334506-47334598
  hypo
gaagcagcgagaccgcggagaatgctgggatactgccaaggaggcctctaccatccaagaagcccgcagggatgtcccgaactggttgtaaa

SEQ ID NO: 15112 - DNA, 30 bp, Homo sapiens
  chr8:48045032-48045062
  hypo
ggaggggcagcctggcggaactcgctgcaa

SEQ ID NO: 15113 - DNA, 168 bp, Homo sapiens
  chr8:48294168-48294336
  hypo
tcagaagatcctattcgggcaggtctgggcctggtcagtaattgggtgggaggcctcagagagcagaaaccagcgattggcaggaagtggcatgggcagctcacctggcctgcgagtctgggctcagctggacctgccccacgtggcaccaggcgcacaaggtgtcct

SEQ ID NO: 15114 - DNA, 180 bp, Homo sapiens
  chr8:49335062-49335242
  hypo
tcctgcaactcttagcgagtaaatgggcacatccacactggagttgaacacaggggcgccggccacgggttcaggctagcccgggcgtctggcttccctgccaggatggctgcctcgttactgagatggaacacacaacacagccgcgtgggcagtgggaggctgcgaggttagcctggc

SEQ ID NO: 15115 - DNA, 30 bp, Homo sapiens
  chr8:49572124-49572154
  hypo
gacctgcgaggctgtcgggggtgcgcctgg

SEQ ID NO: 15116 - DNA, 41 bp, Homo sapiens
  chr8:49609162-49609203
  hypo
ctgcaacctgctaaacgccgctcctgcggagcgccagggcc

SEQ ID NO: 15117 - DNA, 28 bp, Homo sapiens
  chr8:50015582-50015610
  hypo
ctatgggaccgggcgtcttggagcaggg

SEQ ID NO: 15118 - DNA, 41 bp, Homo sapiens
  chr8:50377787-50377828
  hypo
aggcagacacacaggcggctgaacatcgaggggagcacacc

SEQ ID NO: 15119 - DNA, 34 bp, Homo sapiens
  chr8:52432891-52432925
  hypo
tccctctagaaggggcgagcgctttgaatatgtg

SEQ ID NO: 15120 - DNA, 30 bp, Homo sapiens
  chr8:55689465-55689495
  hypo
acctgaatagtgatacgacaagctctcaca

SEQ ID NO: 15121 - DNA, 30 bp, Homo sapiens
  chr8:56929748-56929778
  hypo
ggcagcgtgaggccacgccttggagagaag

SEQ ID NO: 15122 - DNA, 109 bp, Homo sapiens
  chr8:58106014-58106123
  hypo
ccacaggcccatctgcggcaggcacgtggtgccgcgagaacttggctcagggacggtttttccgccatgcgcagattctcgcctctcgcgggggcgccagggggcagct

SEQ ID NO: 15123 - DNA, 56 bp, Homo sapiens
  chr8:58116950-58117006
  hypo
cagaaacgttgcagccgatggcacggcagtggggaggaaaacgtaggaagcatgga

SEQ ID NO: 15124 - DNA, 115 bp, Homo sapiens; identical to SEQ ID NO: 5077
  chr8:58130301-58130416
  hypo

SEQ ID NO: 15125 - DNA, 100 bp, Homo sapiens
  chr8:61789885-61789985
  hypo
ataatgacgacgaggcggatggcggcggggaggctagagcccatttcagaagcctgcagtgaggattccaccagttcacatgcatcgggcactgagccct

SEQ ID NO: 15126 - DNA, 23 bp, Homo sapiens
  chr8:64023521-64023544
  hypo
accgcgcccggccttaagtgttt

SEQ ID NO: 15127 - DNA, 90 bp, Homo sapiens
  chr8:65749819-65749909
  hypo
tttattcacgatgttcggctggagtagagtggttattgtgtgaaagcattctatcttgctaggctgcctctttcccgttctttggcttaa

SEQ ID NO: 15128 - DNA, 22 bp, Homo sapiens
  chr8:66560523-66560545
  hypo
ttacaggcgtgagtcaccatgc

SEQ ID NO: 15129 - DNA, 30 bp, Homo sapiens
  chr8:71368455-71368485
  hypo
cactaacattctacacgtctaaacttcgag

SEQ ID NO: 15130 - DNA, 32 bp, Homo sapiens
  chr8:74332813-74332845
  hypo
acggatgggggtgggcgcgattcccacaacag

SEQ ID NO: 15131 - DNA, 16 bp, Homo sapiens
  chr8:74889431-74889447
  hypo
ttggaggtgaagtctc

SEQ ID NO: 15132 - DNA, 23 bp, Homo sapiens
  chr8:86406826-86406849
  hypo
tttacaaacggagacttgggggc

SEQ ID NO: 15133 - DNA, 30 bp, Homo sapiens
  chr8:86436621-86436651
  hypo
gcatccaacctgactcggcccgcgtggcag

SEQ ID NO: 15134 - DNA, 137 bp, Homo sapiens; identical to SEQ ID NO: 1578
  chr8:90913516-90913653
  hypo

SEQ ID NO: 15135 - DNA, 30 bp, Homo sapiens
  chr8:91130098-91130128
  hypo
tattccaaataatagcgggaattcaaattt

SEQ ID NO: 15136 - DNA, 99 bp, Homo sapiens; identical to SEQ ID NO: 5080
  chr8:92083523-92083622
  hypo

SEQ ID NO: 15137 - DNA, 77 bp, Homo sapiens
  chr8:95416054-95416131
  hypo
cttaaaagtaaggaccgtggtcctgattcccatatgcccacctcctagcagtatgtttggcacgtggcatctatcaa

SEQ ID NO: 15138 - DNA, 30 bp, Homo sapiens
  chr8:96208663-96208693
  hypo
atgtaatatggtggccgagttaagcgcttg

SEQ ID NO: 15139 - DNA, 81 bp, Homo sapiens
  chr8:97340121-97340202
  hypo
cattttcagtgggtacgtgcctagatttccacaggtgtgattgcaaacctgtaaattaccggcttccgtttgctgggacaa

SEQ ID NO: 15140 - DNA, 30 bp, Homo sapiens
  chr8:98738336-98738366
  hypo
actaggaaagctaaacgaacaaaatggttt

SEQ ID NO: 15141 - DNA, 41 bp, Homo sapiens
  chr8:100026614-100026655
  hypo
ggattataggcgtgagccaccgcgcccggcctgcataattt

SEQ ID NO: 15142 - DNA, 25 bp, Homo sapiens
  chr8:101156861-101156886
  hypo
aaaaaaaaaaagcagcggccgggcg

SEQ ID NO: 15143 - DNA, 16 bp, Homo sapiens
  chr8:103629866-103629882
  hypo
acgtagacctaacaaa

SEQ ID NO: 15144 - DNA, 30 bp, Homo sapiens
  chr8:104382635-104382665
  hypo
cacttatgaaaacagcgtttatatatcatt

SEQ ID NO: 15145 - DNA, 30 bp, Homo sapiens
  chr8:106500552-106500582
  hypo
tccattatcttcaaccgtgcatttccattc

SEQ ID NO: 15146 - DNA, 25 bp, Homo sapiens
  chr8:110274990-110275015
  hypo
aaacctgaatgtggccgggtgtggt

SEQ ID NO: 15147 - DNA, 30 bp, Homo sapiens
  chr8:110275321-110275351
  hypo
ctttgttctctagaacgcaccttcatttta

SEQ ID NO: 15148 - DNA, 171 bp, Homo sapiens
  chr8:110548417-110548588
  hypo
cttcaaaggtttcaccgattttattgctgtgtttccaacacatttccacatatggtatgatatttaatttgcaaaataaatccgtaaagcaggaattactaacctaattttgcagatgagaaaactgaggcttaaagttgttcaaggtcaaagtcacgatgtccatcatgc

SEQ ID NO: 15149 - DNA, 30 bp, Homo sapiens
  chr8:110961977-110962007
  hypo
ttaggaaaaatgtttcgtgacattacctaa

SEQ ID NO: 15150 - DNA, 30 bp, Homo sapiens
  chr8:117824014-117824044
  hypo
aacattgtgcactcacgttttgccaggctc

SEQ ID NO: 15151 - DNA, 38 bp, Homo sapiens
  chr8:121206396-121206434
  hypo
tgtcgaccggagccattcctattcggccatcttggctg

SEQ ID NO: 15152 - DNA, 144 bp, Homo sapiens
  chr8:123695516-123695660
  hypo
gcaggccagttgcgccgaaggtggagtgagacgaggtgatcgcgttgagggagacttgcttttcccgagtctgtcagggcaaagcatgtgtgagtttcccatggagcagaactggcctgggaggtgcggcgccagatgctaggg

SEQ ID NO: 15153 - DNA, 248 bp, Homo sapiens
  chr8:123966089-123966337
  hypo
gggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacaggtaattccacctgctcacccaggcagcaggggagaacgcagcttgctttcttttcgttgccagggttaa

SEQ ID NO: 15154 - DNA, 97 bp, Homo sapiens
  chr8:127305217-127305314
  hypo
ctagccgaggagcaggtgtccctaagaacccaaatattccagctgcaaacgtatcaacaaaaacagtctcattgcacacatacggtaggcaaaatgc

SEQ ID NO: 15155 - DNA, 28 bp, Homo sapiens
  chr8:128745586-128745614
  hypo
ttcagaggcaaaggccgaaggatcgctt

SEQ ID NO: 15156 - DNA, 30 bp, Homo sapiens
  chr8:128872385-128872415
  hypo
ctctgtgaagagaaccggctcccagtgagc

SEQ ID NO: 15157 - DNA, 41 bp, Homo sapiens
  chr8:128889207-128889248
  hypo
ttccaaagtcaggagcgtgacctccccggaagcccagctaa

SEQ ID NO: 15158 - DNA, 154 bp, Homo sapiens
  chr8:129069828-129069982
  hypo
acagaatgaggtgtccgtccctccaaggcacggtgacctagaatcccactgctcactgcctgtctctgttcagcctttcagttcataaacatgctttcctccctgcattttgacatccatcatcgtttaaattccaggtcgtcatccttgtaga

SEQ ID NO: 15159 - DNA, 30 bp, Homo sapiens
  chr8:130116433-130116463
  hypo
ctgtcttcggtgcctcgcacatttcttggc

SEQ ID NO: 15160 - DNA, 23 bp, Homo sapiens
  chr8:131922190-131922213
  hypo
tttttttttttgagacggagttt

SEQ ID NO: 15161 - DNA, 30 bp, Homo sapiens
  chr8:133062835-133062865
  hypo
gtgagacttcgggcacgtgttctttcctcg

SEQ ID NO: 15162 - DNA, 91 bp, Homo sapiens; identical to SEQ ID NO: 1580
  chr8:133686745-133686836
  hypo

SEQ ID NO: 15163 - DNA, 132 bp, Homo sapiens
  chr8:133811037-133811169
  hypo
tatgatggagtaattcgttgtttaaaaagaatgcacattaaagccatgcccgaggatgctaaggggcaggtaagagtgttcagtattcctagctacccaaagggttatcttcttgaacggtgactgatcaaa

SEQ ID NO: 15164 - DNA, 17 bp, Homo sapiens
  chr8:135301235-135301252
  hypo
gccggccagatcccaca

SEQ ID NO: 15165 - DNA, 119 bp, Homo sapiens; identical to SEQ ID NO: 5084
  chr8:140834148-140834267
  hypo

SEQ ID NO: 15166 - DNA, 30 bp, Homo sapiens
  chr8:140963317-140963347
  hypo
tcagccagacccaggcgcgcacatccccac

SEQ ID NO: 15167 - DNA, 141 bp, Homo sapiens
  chr8:141202568-141202709
  hypo
gcacagtgcctggggcgtgttttctagcagtaaaaacaggcagcatggtgcaggggaggagcaagctgcccgcccacagccctcgcaccagctgtgcagtcagggcagccccattatgcagagcctcgcttcaatacctgc

SEQ ID NO: 15168 - DNA, 30 bp, Homo sapiens
  chr8:141466682-141466712
  hypo
acacaattaaaaaaacgaacaaacacacac

SEQ ID NO: 15169 - DNA, 38 bp, Homo sapiens; identical to SEQ ID NO: 5085
  chr8:141588102-141588140
  hypo

SEQ ID NO: 15170 - DNA, 30 bp, Homo sapiens
  chr8:141597034-141597064
  hypo
atgcagttacttaaccgagcctcacaacca

SEQ ID NO: 15171 - DNA, 164 bp, Homo sapiens
  chr8:142535343-142535507
  hypo
cggcaaggctggggccggggcggcgggaagggtgaggtttctgtgcactgagatggggctgctggggctgtctggggagtccgaggtgcccaggggcaggcggtgggctcagtacacgaacgctgcgggcaaacaggccgggggaggagcgaggacctgcctgc

SEQ ID NO: 15172 - DNA, 30 bp, Homo sapiens
  chr8:142553829-142553859
  hypo
gatggggctgagccccggcgcaggctgcca

SEQ ID NO: 15173 - DNA, 30 bp, Homo sapiens
  chr8:142560172-142560202
  hypo
tgagtccccggcaggcgtcactgcccccag

SEQ ID NO: 15174 - DNA, 30 bp, Homo sapiens
  chr8:142694812-142694842
  hypo
gatggagaggtgctccgtccactctgccca

SEQ ID NO: 15175 - DNA, 170 bp, Homo sapiens
  chr8:142706692-142706862
  hypo
ccgggaagaaaactgcgtctgctcacgtcctttccttctgcccccatgctccctccaccttccttccagcctggacatggagcctcatttccgcagaggtgagccttgagtcacaagggtgtcccccacaaactctaggaagcaagcgccttgagcgccatgggcggtac

SEQ ID NO: 15176 - DNA, 88 bp, Homo sapiens
  chr8:143054995-143055083
  hypo
ggctcacggtgcctgcgctcacgggtgcctgccctcacgagcctgcgctcacgggtgcctgtgcttacaggtgcgcaccaccccccac

SEQ ID NO: 15177 - DNA, 30 bp, Homo sapiens
  chr8:143089014-143089044
  hypo
cgagcgcctcagggtcggcttcccaggcct

SEQ ID NO: 15178 - DNA, 33 bp, Homo sapiens
  chr8:143097424-143097457
  hypo
gcccagccctcagagcgccgccctatgttccca

SEQ ID NO: 15179 - DNA, 146 bp, Homo sapiens
  chr8:143105231-143105377
  hypo
gtctcaggcaggcaccgtctgctgtggccggcgggtggtgtgtctgggccggctctgctctagatgccgctaaggtgcaggaggcatggctgctgccctctgggagctcgtcctggggtgtccgtgtgacacggacctgcccatgc

SEQ ID NO: 15180 - DNA, 30 bp, Homo sapiens
  chr8:143333589-143333619
  hypo
caagaggtaaacagacggctgcttcatctt

SEQ ID NO: 15181 - DNA, 155 bp, Homo sapiens
  chr8:143405792-143405947
  hypo
tgactgaggagtctgcgaggcctgcctggggggtgtgtcacctgaggcccatttgccctagcgccctgccctagtctgccggggccagaaccgacctgagtacggaggctctcgcatttgcttgtcattacttaagatgccgtttagaagcacct

SEQ ID NO: 15182 - DNA, 53 bp, Homo sapiens
  chr8:143437078-143437131
  hypo
ggcaagggctccacccgcccacacaaacacctgaagtgcgaaggcaggtttca

SEQ ID NO: 15183 - DNA, 30 bp, Homo sapiens
  chr8:143463651-143463681
  hypo
cacgcccagaatcagcggtggagaagcacc

SEQ ID NO: 15184 - DNA, 122 bp, Homo sapiens
  chr8:143509422-143509544
  hypo
gaccgtgggtaatggcgtcaccccatccgccgtctctctctagctgccaacggcgccttcaccagacacgcccggcaccaccttccaggtcagcagtcccagccctgcgtatcggaggcctg

SEQ ID NO: 15185 - DNA, 30 bp, Homo sapiens
  chr8:143538458-143538488
  hypo
agatgcagtgaggcccggaacctgagggcc

SEQ ID NO: 15186 - DNA, 30 bp, Homo sapiens
  chr8:143557725-143557755
  hypo
gtgagggaggtggcgcggggtatgggagac

SEQ ID NO: 15187 - DNA, 36 bp, Homo sapiens
  chr8:143587455-143587491
  hypo
gactgagcacctgggcgaccccgaggtggagtaaac

SEQ ID NO: 15188 - DNA, 162 bp, Homo sapiens
  chr8:143595620-143595782
  hypo
gggtgggatgagatccgggcagggtggtagagcgaggggaggtgagacccacgagtcctcctctagagctggcctggagccagggtgtcggcgcagatgcgggctgcgcagatgccggctctgcggctgcagcaggcctacgacggccggaaggttgagtaa

SEQ ID NO: 15189 - DNA, 161 bp, Homo sapiens
  chr8:143621956-143622117
  hypo
caaggtgggtacatgcgagggaggcacatagacccctcacgtgccaggcgctcgttctgccttgtggggagcaaagtgtgaggtgtgtgggaggtcgggagccccagggtctgtgcggggtggggcggccttggggacgtgcgtcccgagagtgctgtggc

SEQ ID NO: 15190 - DNA, 36 bp, Homo sapiens
  chr8:143876928-143876964
  hypo
tctttagcacgggcacgggctcgggagaccagtggc

SEQ ID NO: 15191 - DNA, 198 bp, Homo sapiens; identical to SEQ ID NO: 5086
  chr8:143993967-143994165
  hypo

SEQ ID NO: 15192 - DNA, 36 bp, Homo sapiens
  chr8:144070623-144070659
  hypo
ggcacagggctcctgcggccacgtcagaaacgccct

SEQ ID NO: 15193 - DNA, 72 bp, Homo sapiens
  chr8:144203849-144203921
  hypo
acatgccctggatgtcgagacgcggtccacagagagatgggctcctgtgactgtcctcggataggcctctgg

SEQ ID NO: 15194 - DNA, 30 bp, Homo sapiens
  chr8:144208784-144208814
  hypo
ttgtgcatggaagagcgttagatgatcccg

SEQ ID NO: 15195 - DNA, 180 bp, Homo sapiens
  chr8:144238806-144238986
  hypo
agacatgggcatgcacgtgtgggtgtgggcacgtgcactgggacacgccagtttgtgccagttatgtgcatgccccagcacgtgtgcgcggggcacctggggtgtgtgtgtgtgaaggagcagggcgggcacgggtgtgtgtgcacatgctggctgcgtgggcaccgtttgtatgcttgt

SEQ ID NO: 15196 - DNA, 30 bp, Homo sapiens
  chr8:144293809-144293839
  hypo
atgctgggtgggtgccggtagagtggaaag

SEQ ID NO: 15197 - DNA, 41 bp, Homo sapiens
  chr8:144326894-144326935
  hypo
aaagggtctgtcaggcggaggcggagcgggggtgttcaagg

SEQ ID NO: 15198 - DNA, 100 bp, Homo sapiens
  chr8:144330280-144330380
  hypo
cccggccagtccactctgcttttaagaaatattttatttctcagggtgggcagcgtgtagagaagtgagtcattccagtctctgccggttagcacctgcc

SEQ ID NO: 15199 - DNA, 57 bp, Homo sapiens
  chr8:144343530-144343587
  hypo
tccccagagctgaggcggtggtgggcagggctcctgagaagccggggcagggcaggg

SEQ ID NO: 15200 - DNA, 289 bp, Homo sapiens
  chr8:144344254-144344543
  hypo
tcccacgcccctctccggcagcccctgcccacacccgcacccctgcacctcccacgcccgtcttgccctggggcccaggtgcaggtctgtgaggagggcagccccgtgctcccgtggccaccgctcagccaaatggattcagcgagggtttttagtgtttgtgcctgtgtccccgtgtgcctgtttcctggtgaggctggatgcctggcatgtctgaacactcacattccccaggcatgcatgtgcagccgccgccgccacccatgtactgtggcgctgacccctcctg

SEQ ID NO: 15201 - DNA, 190 bp, Homo sapiens
  chr8:144360311-144360501
  hypo
caccagcgctctggacgccccactctgccaggtgagaacgagtttaggggtgcgggctggaggtcagtgtgtctgtccgaagtcagctgggaggcaggcgcctacttgaggcgtccttgctggtgtgcggtgggcctggggttcagactgtctgcctgaaaggtaagggtgaggacgcctgcattctcct

SEQ ID NO: 15202 - DNA, 65 bp, Homo sapiens
  chr8:144361758-144361823
  hypo
acttatccttcctcacggagcctgtttctgcctctgacaatggtggttagcgcagcccgctccgc

SEQ ID NO: 15203 - DNA, 30 bp, Homo sapiens
  chr8:144372473-144372503
  hypo
cattcatgagcctctcgcccacccagtcta

SEQ ID NO: 15204 - DNA, 57 bp, Homo sapiens
  chr8:144383350-144383407
  hypo
agtaaaagcacctaccgatatctcgcacaaagatggaaggaacgacctacatccagg

SEQ ID NO: 15205 - DNA, 179 bp, Homo sapiens
  chr8:144471637-144471816
  hypo
cttcggcccctagaccgtgcgccagacatgcattaaggcaggagtgacttatcgagctgtcagggggagcgttttaagacagaattataggggagaggaaaaagatttttaccaaattaatgaaaaatcaatgtggcctcaaaaatccattagccttcataatgcgctggttccaggct

SEQ ID NO: 15206 - DNA, 83 bp, Homo sapiens
  chr8:144589999-144590082
  hypo
ttgacaatgcggtagcgggtcttgatcaccttgctggtgggtgcagtccgcacggcatgcaggctggacgctgtagagaaaac

SEQ ID NO: 15207 - DNA, 115 bp, Homo sapiens
  chr8:144656797-144656912
  hypo
cagggctgtctcccacgccggcagggcctgtgctttcactgggatgcaaatcttcctgctacctcgagctcagattcccgactccagcccagccgcagcccgggaggcgcagccc

SEQ ID NO: 15208 - DNA, 97 bp, Homo sapiens
  chr8:144668854-144668951
  hypo
gtcgggcagcagagccgcccagccgccccacgtgcagctctcacctggcgggaggcacctgccacaggcccgttcatctgctcgtagaatctccttt

SEQ ID NO: 15209 - DNA, 30 bp, Homo sapiens
  chr8:144676006-144676036
  hypo
catttccccgcttcccgcattcccaagcat

SEQ ID NO: 15210 - DNA, 30 bp, Homo sapiens
  chr8:144677984-144678014
  hypo
cccagacaatacccacgccacacctcacac

SEQ ID NO: 15211 - DNA, 57 bp, Homo sapiens
  chr8:145753490-145753547
  hypo
gcgtgcaggtgggggcggggaagctcaggaggtcctgaagctcgggaggtcctgaac

SEQ ID NO: 15212 - DNA, 106 bp, Homo sapiens
  chr8:145758572-145758678
  hypo
acccagggcagctggcgctcggggtagcgctctctctgcatgcccatgacctcctgcagtgcgctgccgaacatggacgggctgaacacggcgttcttggcatgcc

SEQ ID NO: 15213 - DNA, 30 bp, Homo sapiens
  chr8:146013567-146013597
  hypo
cctaggtgtggtgggcgcccaaagacaggt

SEQ ID NO: 15214 - DNA, 98 bp, Homo sapiens; identical to SEQ ID NO: 5087
  chr8:146079215-146079313
  hypo

SEQ ID NO: 15215 - DNA, 105 bp, Homo sapiens; identical to SEQ ID NO: 1581
  chr9:6756353-6756458
  hypo

SEQ ID NO: 15216 - DNA, 30 bp, Homo sapiens
  chr9:7164747-7164777
  hypo
ggcaacttaaagcctcgcaggagtctcagt

SEQ ID NO: 15217 - DNA, 18 bp, Homo sapiens
  chr9:15533133-15533151
  hypo
agacgtgtttactacaaa

SEQ ID NO: 15218 - DNA, 99 bp, Homo sapiens
  chr9:32999960-33000059
  hypo
tataaaaataaaaataaaaggtaacaaagagtaggtgtctgggagcttaatggacagtcgaagaaaaacaatatagaacagtggcgaagatcaaggtct

SEQ ID NO: 15219 - DNA, 24 bp, Homo sapiens
  chr9:33647199-33647223
  hypo
gcgagactgcgtctcaaaaaaaaa

SEQ ID NO: 15220 - DNA, 75 bp, Homo sapiens
  chr9:35816231-35816306
  hypo
gtatgaggcaccaataagtcaggtttgcactgctggaatatatatttttgacataagaaacgtggggtcacaaaa

SEQ ID NO: 15221 - DNA, 33 bp, Homo sapiens
  chr9:36257376-36257409
  hypo
gtttggcttcaactgcggcgctcctacagttgg

SEQ ID NO: 15222 - DNA, 30 bp, Homo sapiens; identical to SEQ ID NO: 5089
  chr9:37467610-37467640
  hypo

SEQ ID NO: 15223 - DNA, 30 bp, Homo sapiens; identical to SEQ ID NO: 5090
  chr9:37467940-37467970
  hypo

SEQ ID NO: 15224 - DNA, 30 bp, Homo sapiens
  chr9:79231349-79231379
  hypo
aaatttggggcacatcgtctaaaaactgcg

SEQ ID NO: 15225 - DNA, 41 bp, Homo sapiens
  chr9:90322123-90322164
  hypo
ctgagggagctgggtcgccgggatgccgcagactttttgct

SEQ ID NO: 15226 - DNA, 30 bp, Homo sapiens
  chr9:90421661-90421691
  hypo
caccacaatcctcagcgatgcattctccaa

SEQ ID NO: 15227 - DNA, 39 bp, Homo sapiens
  chr9:91914149-91914188
  hypo
tctggtggccaggtgcggtgactcatgcctataatccca

SEQ ID NO: 15228 - DNA, 30 bp, Homo sapiens
  chr9:92897186-92897216
  hypo
ccatcccgctggctgcgggctgctggcaag

SEQ ID NO: 15229 - DNA, 77 bp, Homo sapiens
  chr9:92980516-92980593
  hypo
ggtgtacacaccctgtgacgtcaggagcaatatccgtctaggatgttaggaagactatcacacggaacacaccccct

SEQ ID NO: 15230 - DNA, 22 bp, Homo sapiens
  chr9:93698029-93698051
  hypo
gagcaggtggttggccgggcgc

SEQ ID NO: 15231 - DNA, 30 bp, Homo sapiens
  chr9:96362025-96362055
  hypo
gcagcaagggggattcggagcacgaaaggg

SEQ ID NO: 15232 - DNA, 90 bp, Homo sapiens; identical to SEQ ID NO: 5091
  chr9:100397609-100397699
  hypo

SEQ ID NO: 15233 - DNA, 37 bp, Homo sapiens
  chr9:103174717-103174754
  hypo
ggggaaacaaatcaaatgtccccgtataaatgataaa

SEQ ID NO: 15234 - DNA, 30 bp, Homo sapiens
  chr9:107712165-107712195
  hypo
cattttctttctggccgggcacgatggctt

SEQ ID NO: 15235 - DNA, 42 bp, Homo sapiens
  chr9:115067926-115067968
  hypo
ataagagctttcagccgggcacggtggctcacgcctgtaatc

SEQ ID NO: 15236 - DNA, 24 bp, Homo sapiens
  chr9:115087591-115087615
  hypo
ctaagggcccgtctgcacactggg

SEQ ID NO: 15237 - DNA, 30 bp, Homo sapiens
  chr9:116331277-116331307
  hypo
gcctaagtcatcactcgagatgtgtggata

SEQ ID NO: 15238 - DNA, 42 bp, Homo sapiens
  chr9:116633864-116633906
  hypo
aattccacctgccgacgtgtgcgctttctctacacgagacac

SEQ ID NO: 15239 - DNA, 30 bp, Homo sapiens
  chr9:123287840-123287870
  hypo
gaagggctccgatctcggttggacctagaa

SEQ ID NO: 15240 - DNA, 30 bp, Homo sapiens
  chr9:126125543-126125573
  hypo
ttcagctttgcctttcgtgtagggacgccc

SEQ ID NO: 15241 - DNA, 39 bp, Homo sapiens
  chr9:126133778-126133817
  hypo
ctcaagccagcccagcgagctcggcggcaggcagtcctg

SEQ ID NO: 15242 - DNA, 80 bp, Homo sapiens
  chr9:126154254-126154334
  hypo
ccccacggctgctcccgcctctgcccaccttgtctccgcgtggagttcccatgcagatgacttcccgaaccccttctaat

SEQ ID NO: 15243 - DNA, 34 bp, Homo sapiens
  chr9:126158010-126158044
  hypo
actggcagcttcatacgcacgtcctaatcacacc

SEQ ID NO: 15244 - DNA, 44 bp, Homo sapiens
  chr9:126169447-126169491
  hypo
ggggggtggggagcacggagctggagcctcggaggctggggagg

SEQ ID NO: 15245 - DNA, 96 bp, Homo sapiens
  chr9:128759878-128759974
  hypo
aggtggcctggccaccgtccagaatggaggcccccggtgctggcctgcccagcagcacctgcggctcagtccctccaggatcggaaggaatcacac

SEQ ID NO: 15246 - DNA, 30 bp, Homo sapiens
  chr9:130180052-130180082
  hypo
ttctatttcctacctcgccctcttggcaac

SEQ ID NO: 15247 - DNA, 42 bp, Homo sapiens
  chr9:131060925-131060967
  hypo
tgctgggattataagcataagccaccgcgcctggccccttgg

SEQ ID NO: 15248 - DNA, 218 bp, Homo sapiens
  chr9:131504930-131505148
  hypo
tgctgagcaggagctcgttgacccggcggtactggaattccagctcctcggggatgctgaagttgcagagcgtcaggcagcagttccgctgcacctgggccgggacaggacacaagtggggcacattcagggtcagactcaggagcagggctctaggaactatctagaggtatgagctcatccagagttgtggcagtccagcccggttttctggaaga

SEQ ID NO: 15249 - DNA, 22 bp, Homo sapiens
  chr9:131580093-131580115
  hypo
tttgccaatctgggccgggcgc

SEQ ID NO: 15250 - DNA, 221 bp, Homo sapiens; identical to SEQ ID NO: 5093
  chr9:131854231-131854452
  hypo

SEQ ID NO: 15251 - DNA, 86 bp, Homo sapiens
  chr9:132402797-132402883
  hypo
cacccccggggctctcgctgaccttcaaagttgagattggccccatgccgcaagagaacgtcggccgcccgcgtcagccccagctc

SEQ ID NO: 15252 - DNA, 67 bp, Homo sapiens
  chr9:132403149-132403216
  hypo
gtagagagagggccacgctgcatctcttaatacgggagcagactgggatttgcggagaatgggctgg

SEQ ID NO: 15253 - DNA, 30 bp, Homo sapiens
  chr9:133518455-133518485
  hypo
gcctggctgcgataccggcctgccttgcca

SEQ ID NO: 15254 - DNA, 126 bp, Homo sapiens; identical to SEQ ID NO: 5094
  chr9:133773766-133773892
  hypo

SEQ ID NO: 15255 - DNA, 59 bp, Homo sapiens
  chr9:133779518-133779577
  hypo
aggaggaccactccacgccgtcggcataggaggcgtgcgcaccgcgcaggtactgccca

SEQ ID NO: 15256 - DNA, 85 bp, Homo sapiens
  chr9:133865386-133865471
  hypo
tagccgtgccaggtgcgggggatgcgcgaaccggccgacagcggcccagcccttcgcggggccctgccctcggagtcacagagag

SEQ ID NO: 15257 - DNA, 30 bp, Homo sapiens
  chr9:133928236-133928266
  hypo
cctgcaggagacctccgaggacgtggcccc

SEQ ID NO: 15258 - DNA, 133 bp, Homo sapiens
  chr9:134191085-134191218
  hypo
acctctcaggggtggcgagggtgttgcgttgcctccttctacagacgcaaatgccacctaatcacacagctccctctgcaaacccgctcccatctccatagcaactacagggcttcggcgctcttgggctcct

SEQ ID NO: 15259 - DNA, 71 bp, Homo sapiens
  chr9:134207916-134207987
  hypo
gtggctttgacttaccgtgtaagactccatttcctcatctgtaaaatgaggagaaccggccagccgggcgc

SEQ ID NO: 15260 - DNA, 50 bp, Homo sapiens
  chr9:134717269-134717319
  hypo
gggaagagaaaaagccgagaaaaaagcggtttgaacggggggtgatgtca

SEQ ID NO: 15261 - DNA, 52 bp, Homo sapiens
  chr9:135768018-135768070
  hypo
tcttagtgctttcagcgagaaaaggtgagtctcattacgcagaacttttgtt

SEQ ID NO: 15262 - DNA, 107 bp, Homo sapiens
  chr9:135865054-135865161
  hypo
ttccgcaggggatcccggccgggtccagtcctgagcctgcacctgaccccccggggcctcatttcctccggcaggagcgcagcttcgagtgccgcatgtgcggcaag

SEQ ID NO: 15263 - DNA, 202 bp, Homo sapiens; identical to SEQ ID NO: 5095
  chr9:135898911-135899113
  hypo

SEQ ID NO: 15264 - DNA, 103 bp, Homo sapiens
  chr9:136375630-136375733
  hypo
cgaacttaaattatttaaaatgaggataacatttaaagatccaggtttggggttgtaccagctacgttgcagatgcccaggcaccaggcgtgttgggcagccc

SEQ ID NO: 15265 - DNA, 30 bp, Homo sapiens
  chr9:136999528-136999558
  hypo
agggttctggggtctcgccccttatcttgc

SEQ ID NO: 15266 - DNA, 170 bp, Homo sapiens
  chr9:137656958-137657128
  hypo
tcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcag

SEQ ID NO: 15267 - DNA, 59 bp, Homo sapiens
  chr9:137710245-137710304
  hypo
tggcgctgtgacacccggtctgtggtcggcgcagtcagcggagacgggatccctgctgg

SEQ ID NO: 15268 - DNA, 218 bp, Homo sapiens
  chr9:137718872-137719090
  hypo
ctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacc

SEQ ID NO: 15269 - DNA, 34 bp, Homo sapiens
  chr9:138289547-138289581
  hypo
atgctgcaggccaggcgctcggttacactcttca

SEQ ID NO: 15270 - DNA, 44 bp, Homo sapiens
  chr9:138562752-138562796
  hypo
cccctcaccatagcccgcccagggtctctcgggcatcgaaagga

SEQ ID NO: 15271 - DNA, 68 bp, Homo sapiens; identical to SEQ ID NO: 5096
  chr9:138563212-138563280
  hypo

SEQ ID NO: 15272 - DNA, 165 bp, Homo sapiens; identical to SEQ ID NO: 5097
  chr9:138627636-138627801
  hypo

SEQ ID NO: 15273 - DNA, 30 bp, Homo sapiens
  chr9:138634173-138634203
  hypo
ggcctgggctggcttcgtgctgagcagggc

SEQ ID NO: 15274 - DNA, 35 bp, Homo sapiens; identical to SEQ ID NO: 5098
  chr9:138650129-138650164
  hypo

SEQ ID NO: 15275 - DNA, 30 bp, Homo sapiens
  chr9:138659727-138659757
  hypo
gctcccactcagggccgtggccaggagaag

SEQ ID NO: 15276 - DNA, 322 bp, Homo sapiens
  chr9:138660824-138661146
  hypo
gggcacgtgtgcacacgtgggtgatggtgcatctggggcagggcgcatgtgcacatgtgtgacggtgcgtctggggcaggacgcgtgtgcacacgtgggtgacggtgcgtctggggcaggatgcgtgtgcacacgtgggtgtcggtgcgtctggggcagggcgcatgtgcacacgtgggtgacggtgcgtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggc

SEQ ID NO: 15277 - DNA, 96 bp, Homo sapiens
  chr9:138661837-138661933
  hypo
tgaactgcatctgcccggcgacctccaccctcatcaccctgctggtgcacacgtcccgcggccagtgagtgccccgtgccccgggggaccgacctc

SEQ ID NO: 15278 - DNA, 40 bp, Homo sapiens
  chr9:138743731-138743771
  hypo
ctctgagaggggactcgctgggccacgagctaggcacgcc

SEQ ID NO: 15279 - DNA, 30 bp, Homo sapiens
  chr9:138780600-138780630
  hypo
gcgaccagtagtccacgccccagctccatc

SEQ ID NO: 15280 - DNA, 45 bp, Homo sapiens
  chr9:138994395-138994440
  hypo
aggggaggtggggagcgttcggactgaggccgggcaggtgggccc

SEQ ID NO: 15281 - DNA, 121 bp, Homo sapiens; identical to SEQ ID NO: 1583
  chr9:139012272-139012393
  hypo

SEQ ID NO: 15282 - DNA, 30 bp, Homo sapiens
  chr9:139100397-139100427
  hypo
cccttgttagaagagcgtttgtaaaaccag

SEQ ID NO: 15283 - DNA, 144 bp, Homo sapiens
  chr9:139421932-139422076
  hypo
cttccatgagtgacccgcaccccaccttccaccgtccccgcatctcctcctatcaggggcggtggggagacccctctggggctaaaaagtgaggcttgagatagggaacgccagtctcccccgactggacgagagagctgccct

SEQ ID NO: 15284 - DNA, 40 bp, Homo sapiens
  chr9:139472499-139472539
  hypo
ctggaggtaaatctgcgcaagaacgcgggctttggttaag

SEQ ID NO: 15285 - DNA, 39 bp, Homo sapiens
  chr9:139506449-139506488
  hypo
gggtgacggatgaaccgggtagaccgtctgtacaatgga

SEQ ID NO: 15286 - DNA, 51 bp, Homo sapiens
  chr9:139634047-139634098
  hypo
aggagacacatgagccgtgaacacgtctcccccggccgctccctggttcca

SEQ ID NO: 15287 - DNA, 166 bp, Homo sapiens
  chr9:139698925-139699091
  hypo
aaccctgtgcccacccgcatgtccccagaggaacatgaggcaaagggaggcgtccttcatcgaggagcgccgggcaagggagaaccggctcaaccagcagaagaagctgatcgacaagatccacacgaaggagaccagcgagaagtaccgccgggtaagccccagg

SEQ ID NO: 15288 - DNA, 17 bp, Homo sapiens
  chr9:139703929-139703946
  hypo
atgaaagttggtgtccg

SEQ ID NO: 15289 - DNA, 136 bp, Homo sapiens; identical to SEQ ID NO: 1585
  chr9:139704066-139704202
  hypo

SEQ ID NO: 15290 - DNA, 30 bp, Homo sapiens
  chr9:139714130-139714160
  hypo
caaaatgaaagagagcgggtagaaatgtga

SEQ ID NO: 15291 - DNA, 30 bp, Homo sapiens
  chr9:139717804-139717834
  hypo
atggtacccacccatcgtcttcctcccctg

SEQ ID NO: 15292 - DNA, 72 bp, Homo sapiens
  chr9:139809893-139809965
  hypo
gtggatccagccaaccgtaggttggaaatgttcaggtaaaaatgcactgaacacgcgcggacattttttatt

SEQ ID NO: 15293 - DNA, 55 bp, Homo sapiens
  chr9:139818567-139818622
  hypo
tgtctgcagcaggcacgtcaccctgtgatgctgtgtcacgcggtggagagctctg

SEQ ID NO: 15294 - DNA, 227 bp, Homo sapiens
  chr9:139859041-139859268
  hypo
gcacagagagcaggacgccaggtgcgctcccgggaagctgtcctagagaggggccggaccgcacacctggcgctggaagcctccatgactggatgtttgcaagaaacagaaagaaacttctgtccagtctcagccacaggcacgccaggtcctctgctgccttgccgcaagctcgggggtttcagtgagaccctctcccactcccacggcctcgagtggaccaggta

SEQ ID NO: 15295 - DNA, 54 bp, Homo sapiens
  chr9:139888895-139888949
  hypo
gatccctgaggccaccggttgcaggaggcctggagtctgcgccttcttagcgtg

SEQ ID NO: 15296 - DNA, 30 bp, Homo sapiens
  chr9:139978966-139978996
  hypo
ataaacacaaggtgccgtaattgactgcta

SEQ ID NO: 15297 - DNA, 30 bp, Homo sapiens
  chr9:140030509-140030539
  hypo
acagcgtctggtacacggtaggtgctcagt

SEQ ID NO: 15298 - DNA, 113 bp, Homo sapiens
  chr9:140107128-140107241
  hypo
accagcttccagggtcggcccctgcgcgcctcagggccctcgcagtggtactggcttctccacaacgctccctggtgggcaccccaggcttcacgctgcggggagggcacaga

SEQ ID NO: 15299 - DNA, 30 bp, Homo sapiens
  chr9:140108225-140108255
  hypo
ccacaggttcaacttcgtggccaagaagct

SEQ ID NO: 15300 - DNA, 268 bp, Homo sapiens; identical to SEQ ID NO: 5102
  chr9:140127812-140128080
  hypo

SEQ ID NO: 15301 - DNA, 180 bp, Homo sapiens
  chr9:140137562-140137742
  hypo
acatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccac

SEQ ID NO: 15302 - DNA, 42 bp, Homo sapiens
  chr9:140245865-140245907
  hypo
cgtccagaaggaacacgtggccctccacggccacctgcagga

SEQ ID NO: 15303 - DNA, 30 bp, Homo sapiens
  chr9:140265779-140265809
  hypo
cccgccgcgagacgacggccccgggcgtgg

SEQ ID NO: 15304 - DNA, 61 bp, Homo sapiens
  chr9:140267262-140267323
  hypo
gcccccacacagaggcggccctgagccaggcgcgtccttgccccaccgcccgagaagccgt

SEQ ID NO: 15305 - DNA, 78 bp, Homo sapiens
  chr9:140274184-140274262
  hypo
ctctgatttggggtgcgctctcgcccaggctggtttctgtcacccccggagttctgcagcacccgttctaaccacagc

SEQ ID NO: 15306 - DNA, 166 bp, Homo sapiens
  chr9:140332949-140333115
  hypo
ccttagaggcatctccggggctcaggcggcctcccgtggccatagaggcatctccggggctcagacggcctcccgtggccatagaggcatccccggggctcagacggcctcccgtggccatagaggcatccccggggctcagacggtctcccgtggccatagaggc

SEQ ID NO: 15307 - DNA, 39 bp, Homo sapiens
  chr9:140382566-140382605
  hypo
gagcttcggcctgaacgctgctctcgtggtctgatgtct

SEQ ID NO: 15308 - DNA, 142 bp, Homo sapiens
  chr9:140389345-140389487
  hypo
ccttcacctgctctgcgctctcacctgctccgcgccctcacctgctctgtgccctcacccgctccgccctcacctgttccatgccctcatccactccacaccctcatccgctccgcatcctcacccacgccatgctcacctg

SEQ ID NO: 15309 - DNA, 260 bp, Homo sapiens
  chr9:140392377-140392637
  hypo
aaatccaggaggccacgaagtgtgtttccgagctaagctggggtggggctggggaaatccagccttccatgtgtggtttccacagtaacttccgtgtgtggtttccacggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgac

SEQ ID NO: 15310 - DNA, 167 bp, Homo sapiens
  chr9:140396560-140396727
  hypo
atgccctccagggcacgaggactctggaatctgggagctcccagaggtgacccgggagtgcccaacacactggaacccagaaggcagaggttgcagtggacccggagcctgtggagaggccctggggcaaaccaagggtgagggagcgtctgcgggcaccacaccca

SEQ ID NO: 15311 - DNA, 30 bp, Homo sapiens
  chr9:140397067-140397097
  hypo
ttcaggagaagaaagcggcctccctgagga

SEQ ID NO: 15312 - DNA, 71 bp, Homo sapiens
  chr9:140400208-140400279
  hypo
tggactggagaagaacggagataccggcaattcgaagggatgtggttggggaacatcgcacaagggtgtgg

SEQ ID NO: 15313 - DNA, 45 bp, Homo sapiens
  chr9:140680320-140680365
  hypo
gccctgcaagtgcctcgcatagcagggttccgtttgtttgctttt

SEQ ID NO: 15314 - DNA, 30 bp, Homo sapiens
  chr9:140727555-140727585
  hypo
gtccacgcctttacccgcttgttggtttgg

SEQ ID NO: 15315 - DNA, 32 bp, Homo sapiens
  chr9:140969282-140969314
  hypo
tgttagtctggcagccgcgctgaaggacaggc

SEQ ID NO: 15316 - DNA, 145 bp, Homo sapiens
  chr9:141022582-141022727
  hypo
cttatttaactttaacgatggtttcccactggcatcagaacaggggtcgcagaactgacctggcccccagtccctgagcgctcccacctgctgccctctcccgcccagcccagcccagctgcctgcgttgcggcctccacctgca

SEQ ID NO: 15317 - DNA, 30 bp, Homo sapiens
  chr10:833307-833337
  hypo
caggtcctctgcaggcggggacggtgccgg

SEQ ID NO: 15318 - DNA, 35 bp, Homo sapiens
  chr10:851432-851467
  hypo
gcctggcggcctctgcggagcgccctctgcggagc

SEQ ID NO: 15319 - DNA, 76 bp, Homo sapiens
  chr10:978857-978933
  hypo
gggaccaaaaggccccggccccacgtttcctagaggcgctgggttcgggcccacgttgcaacgagtcagatgctct

SEQ ID NO: 15320 - DNA, 62 bp, Homo sapiens
  chr10:1156723-1156785
  hypo
atcgccaaggacatccgtgagcctccgatgggtgtccagcgtgttagcgcccagacccacag

SEQ ID NO: 15321 - DNA, 30 bp, Homo sapiens
  chr10:1259979-1260009
  hypo
ctttgcacctgtacccggacctgccggtga

SEQ ID NO: 15322 - DNA, 30 bp, Homo sapiens
  chr10:2283030-2283060
  hypo
agagcccctgatgctcgaggttcccaggac

SEQ ID NO: 15323 - DNA, 78 bp, Homo sapiens
  chr10:3161042-3161120
  hypo
gatcatcggtggattcgaggtacgttaccgtttctctcttgccggtcttgcaggtgtgagccgcgccctgtgttggct

SEQ ID NO: 15324 - DNA, 30 bp, Homo sapiens
  chr10:3329710-3329740
  hypo
tgttgtaattgagtgcgtgcacactcagta

SEQ ID NO: 15325 - DNA, 43 bp, Homo sapiens
  chr10:3330464-3330507
  hypo
aggtgagggctcccccgcgccgccctggcgtccaggtggtgag

SEQ ID NO: 15326 - DNA, 45 bp, Homo sapiens
  chr10:3895395-3895440
  hypo
ggtttccagctgtgtcgtgttgacttgaaccgactcagcaggcgg

SEQ ID NO: 15327 - DNA, 30 bp, Homo sapiens
  chr10:5531069-5531099
  hypo
acggagggcgacctgcgcagcctaggcact

SEQ ID NO: 15328 - DNA, 30 bp, Homo sapiens
  chr10:5538908-5538938
  hypo
caggtgggaaagagacgaatcctgactcca

SEQ ID NO: 15329 - DNA, 112 bp, Homo sapiens
  chr10:5540808-5540920
  hypo
atccaggccccggagcgcaaagccttcctcccagggggaggcagtttcccatccaccgaccaggtttccccggagagtcccagcacaaaagcagcagcgggcggtggccctg

SEQ ID NO: 15330 - DNA, 312 bp, Homo sapiens
  chr10:5541199-5541511
  hypo
cctggaagctgatttcgccgtcgccgtcgctgtcaacctcggagatgagtttccttagctgggcctccgagaggttcttgcccgtggccttcagcgccgcgcccagctcctgggcattgatggtgccgtttccatccgtgtcaaccgcggagaaagcctttttgtactgggcctcctcctcaggagtcagctcaccggccatgcctgcgtctcctgcacctcgcggagcctccgagctgctgcccaccggccctcaacctgctgctctcagagctcgtggtccagagtgcaggcagccgcagggatccgggc

SEQ ID NO: 15331 - DNA, 30 bp, Homo sapiens
  chr10:5553298-5553328
  hypo
ctactgctcacacctcgacttctcagggag

SEQ ID NO: 15332 - DNA, 30 bp, Homo sapiens
  chr10:5567180-5567210
  hypo
acggaggccgagctgcgggacatgatgagt

SEQ ID NO: 15333 - DNA, 30 bp, Homo sapiens
  chr10:5875038-5875068
  hypo
tccctgagaaccagtcggaccaggacaggc

SEQ ID NO: 15334 - DNA, 37 bp, Homo sapiens; identical to SEQ ID NO: 1586
  chr10:5875322-5875359
  hypo

SEQ ID NO: 15335 - DNA, 30 bp, Homo sapiens
  chr10:6003491-6003521
  hypo
cgaggacgctcggagcggctgcgtgtgaaa

SEQ ID NO: 15336 - DNA, 205 bp, Homo sapiens
  chr10:6042309-6042514
  hypo
agggtttccttaaggcgtgccgttaaatattcgtaaaatgaacacatgaagagcctagagtccagaggtcctagcagatggtgttacatcctcatcgtgaggcacgtggacgggggtttccgaccacctgcgttcacccctagaattgggattgatctgggcacctctgggaaacatatgggacaggacccgtgactctagttgc

SEQ ID NO: 15337 - DNA, 30 bp, Homo sapiens
  chr10:6159901-6159931
  hypo
tgatcagaccggcaccgcagtgtgggagag

SEQ ID NO: 15338 - DNA, 24 bp, Homo sapiens
  chr10:6199196-6199220
  hypo
tttttttttttgagacggagtctc

SEQ ID NO: 15339 - DNA, 15 bp, Homo sapiens
  chr10:6564170-6564185
  hypo
cgggattacaagagt

SEQ ID NO: 15340 - DNA, 47 bp, Homo sapiens
  chr10:6577682-6577729
  hypo
tttgaagtctcccctcgccgcgcctctttagacgcacctgagatcca

SEQ ID NO: 15341 - DNA, 42 bp, Homo sapiens
  chr10:7203062-7203104
  hypo
acggagagtcttgggcgcttggctccacgggaagcaaacact

SEQ ID NO: 15342 - DNA, 82 bp, Homo sapiens
  chr10:7205705-7205787
  hypo
taatgggccacctcccgagggcagactcagttggcgtactgggcgtagaaagccactttgactctctcgatctggtggcata

SEQ ID NO: 15343 - DNA, 30 bp, Homo sapiens
  chr10:7212955-7212985
  hypo
gaccgtccactccaacgggttgctctccag

SEQ ID NO: 15344 - DNA, 30 bp, Homo sapiens
  chr10:7213658-7213688
  hypo
actccattctgatgccgaaaggcccctcca

SEQ ID NO: 15345 - DNA, 30 bp, Homo sapiens
  chr10:7214234-7214264
  hypo
gccagtggtcccacccgtgggccctacgag

SEQ ID NO: 15346 - DNA, 43 bp, Homo sapiens
  chr10:7236181-7236224
  hypo
tcccctacctcccctcgctgcaccccctcgaattgaggccaga

SEQ ID NO: 15347 - DNA, 30 bp, Homo sapiens
  chr10:7340032-7340062
  hypo
gcacccagaggccctcgcagcttgtccttc

SEQ ID NO: 15348 - DNA, 21 bp, Homo sapiens
  chr10:7414164-7414185
  hypo
ccgccacgcccggccttcttg

SEQ ID NO: 15349 - DNA, 30 bp, Homo sapiens
  chr10:7414544-7414574
  hypo
ccaagaagtttagagcgtcacagacacagc

SEQ ID NO: 15350 - DNA, 128 bp, Homo sapiens
  chr10:11472865-11472993
  hypo
ggctccgagaacacacgcatgaataaataaaaccaatactctgctgctgagacatcgctacatccagaaggacccagagcaacagacgcagagaaaagcaacatggaccaccgcggcctgacagcagg

SEQ ID NO: 15351 - DNA, 30 bp, Homo sapiens
  chr10:13137625-13137655
  hypo
tcacctcctgctgttcggtctagttcctga

SEQ ID NO: 15352 - DNA, 126 bp, Homo sapiens
  chr10:13355078-13355204
  hypo
ccccaaagatgttcacgccctaatccctggaatctgtggctgttaccttacctggcaaaagggattttccaaatgtgattaacgttaaggactttgatagggggatcaccccgtattatctgggtg

SEQ ID NO: 15353 - DNA, 32 bp, Homo sapiens
  chr10:15000601-15000633
  hypo
aacatgtaaattggccgggcgcggtggctcac

SEQ ID NO: 15354 - DNA, 39 bp, Homo sapiens; identical to SEQ ID NO: 5104
  chr10:15140487-15140526
  hypo

SEQ ID NO: 15355 - DNA, 30 bp, Homo sapiens
  chr10:16715583-16715613
  hypo
atgtttcttgaagcacgtgatcatgcctga

SEQ ID NO: 15356 - DNA, 96 bp, Homo sapiens
  chr10:17429165-17429261
  hypo
gggcccagtggaagacgcacagcaccgtggattccccttgcaagcttaaggcccgctagttggaatttaaggaaaagaaaacaataattttttttt

SEQ ID NO: 15357 - DNA, 96 bp, Homo sapiens
  chr10:17429561-17429657
  hypo
ggcccagaaaactaggattttcatagggctatccttctgtgagaaacggagctaacatacaggactggactgctgtcacatcgattaacccaaatc

SEQ ID NO: 15358 - DNA, 30 bp, Homo sapiens
  chr10:24841823-24841853
  hypo
ttaccgtgccatgcacgcacccatcagcag

SEQ ID NO: 15359 - DNA, 22 bp, Homo sapiens
  chr10:26128001-26128023
  hypo
acttccacggcctggcgcggtg

SEQ ID NO: 15360 - DNA, 30 bp, Homo sapiens
  chr10:26638451-26638481
  hypo
gagggatggaagagacgagaggtggggaga

SEQ ID NO: 15361 - DNA, 30 bp, Homo sapiens
  chr10:26733386-26733416
  hypo
aagcgttggattctgcgtatattttgaagg

SEQ ID NO: 15362 - DNA, 30 bp, Homo sapiens
  chr10:26739045-26739075
  hypo
gggggttgtgttaaacgctgggcagttttg

SEQ ID NO: 15363 - DNA, 30 bp, Homo sapiens
  chr10:26877730-26877760
  hypo
gaggcgcccagaacacgctgtcccccaatg

SEQ ID NO: 15364 - DNA, 30 bp, Homo sapiens
  chr10:26926812-26926842
  hypo
aaggaccaagcagcccgagaagagcagagg

SEQ ID NO: 15365 - DNA, 46 bp, Homo sapiens
  chr10:31892894-31892940
  hypo
cccgtggccagcacccgaggcctgctggctccgatctgggccacgt

SEQ ID NO: 15366 - DNA, 30 bp, Homo sapiens
  chr10:32499025-32499055
  hypo
caaattctccagtcccgcctcagacctact

SEQ ID NO: 15367 - DNA, 31 bp, Homo sapiens
  chr10:38078895-38078926
  hypo
aaacctgcctggggccgggcgccatggctca

SEQ ID NO: 15368 - DNA, 39 bp, Homo sapiens
  chr10:43906055-43906094
  hypo
tgttgggattactggattgagccacgcatctggctgaac

SEQ ID NO: 15369 - DNA, 38 bp, Homo sapiens
  chr10:46221018-46221056
  hypo
aaacaaacaaacaaacaaacaaacgacaacaaaaaaaa

SEQ ID NO: 15370 - DNA, 30 bp, Homo sapiens
  chr10:49929928-49929958
  hypo
tagagtcagcctgaacgacattccctgtag

SEQ ID NO: 15371 - DNA, 192 bp, Homo sapiens
  chr10:50507515-50507707
  hypo
tgtctggctccttagcgtgggcagggaggctcaagttcatggcgggagggatgttcccgctgggccgatgctgtgctggggaagtagttcggtgccagggtgctgtgcagggtggtatgtgtgtgccgggagcccattggtgttggggctaaggttcttggtgtgctggatgggcctcggggaccacgtacc

SEQ ID NO: 15372 - DNA, 21 bp, Homo sapiens
  chr10:50748373-50748394
  hypo
cacgcccggcttgtaacttgc

SEQ ID NO: 15373 - DNA, 80 bp, Homo sapiens
  chr10:70288112-70288192
  hypo
agctctctcctgtctcgtcccttgacctatattgaccactgaccagtaatcgcctatcgcgctttttttttttttttttt

SEQ ID NO: 15374 - DNA, 96 bp, Homo sapiens
  chr10:70476540-70476636
  hypo
gtgcctggccaagactagaacttgataatcacgaggatgttctatagttttccattgaaactatattgtctctaaaatcaccgttatttttattaa

SEQ ID NO: 15375 - DNA, 18 bp, Homo sapiens
  chr10:70483311-70483329
  hypo
taaaagtaaatgggccgg

SEQ ID NO: 15376 - DNA, 30 bp, Homo sapiens
  chr10:73466313-73466343
  hypo
gttgtcatgattgtccgtgttgccatggtc

SEQ ID NO: 15377 - DNA, 30 bp, Homo sapiens
  chr10:77022299-77022329
  hypo
tctgtttattttctgcggccatgaaattaa

SEQ ID NO: 15378 - DNA, 30 bp, Homo sapiens
  chr10:89605951-89605981
  hypo
aacgtcattatgtcacgcaagactagataa

SEQ ID NO: 15379 - DNA, 21 bp, Homo sapiens
  chr10:94603316-94603337
  hypo
atgcatttggccgggcgcggt

SEQ ID NO: 15380 - DNA, 120 bp, Homo sapiens
  chr10:96304080-96304200
  hypo
cagtctagataacatggcgaaaaaccgtctctaccaaaaaacaaaaacacacaaaaaccccaaaccaacaaaaattagcctggaatgggctaatgtccgacactaaaatgtccgggcgtg

SEQ ID NO: 15381 - DNA, 226 bp, Homo sapiens; identical to SEQ ID NO: 1587
  chr10:98129781-98130007
  hypo

SEQ ID NO: 15382 - DNA, 22 bp, Homo sapiens
  chr10:98528164-98528186
  hypo
cagaccacggactgatacaggt

SEQ ID NO: 15383 - DNA, 16 bp, Homo sapiens
  chr10:101493058-101493074
  hypo
ccgtctcaaaaaaata

SEQ ID NO: 15384 - DNA, 55 bp, Homo sapiens
  chr10:104823193-104823248
  hypo
cgcatggggaagtcccgccttgagccgcatgcactgatcccgggttggcactgtt

SEQ ID NO: 15385 - DNA, 44 bp, Homo sapiens; identical to SEQ ID NO: 5107
  chr10:105155356-105155400
  hypo

SEQ ID NO: 15386 - DNA, 21 bp, Homo sapiens
  chr10:108522437-108522458
  hypo
agccaccgtgcccagcctatt

SEQ ID NO: 15387 - DNA, 83 bp, Homo sapiens
  chr10:113623006-113623089
  hypo
aataaactcaatcagcgtctctcggggtgagctcagttctagaccggtggtcctcaccactgctggaaagttctttaaaacta

SEQ ID NO: 15388 - DNA, 34 bp, Homo sapiens
  chr10:115844821-115844855
  hypo
gtgggaacatgcaggcggacgctgcagcagcttt

SEQ ID NO: 15389 - DNA, 30 bp, Homo sapiens
  chr10:116331147-116331177
  hypo
ccgggtggaaacgggcgcctggaggcagaa

SEQ ID NO: 15390 - DNA, 30 bp, Homo sapiens
  chr10:120791248-120791278
  hypo
attcgtgtattaactcgtattcaagaaggt

SEQ ID NO: 15391 - DNA, 17 bp, Homo sapiens
  chr10:121354427-121354444
  hypo
cccggcctgaaggacaa

SEQ ID NO: 15392 - DNA, 30 bp, Homo sapiens
  chr10:121651072-121651102
  hypo
aaggagacagggtctcgctgcacagtgagt

SEQ ID NO: 15393 - DNA, 120 bp, Homo sapiens
  chr10:122492432-122492552
  hypo
agtaggcagaagaaagtggaaggagagagatttgccgtgtcttctgcccttcatctttcctccatgttggatactcttaagttcttcagcttttggattcttggacttacaccagtgatt

SEQ ID NO: 15394 - DNA, 20 bp, Homo sapiens
  chr10:123688618-123688638
  hypo
agcactttgggaggccgagg

SEQ ID NO: 15395 - DNA, 149 bp, Homo sapiens
  chr10:126198986-126199135
  hypo
agcctccgcctccctcgccgacagcttcccggggctctgcctggaggcagcctcgctttatcccgcagaacctccacgctgttcctgcatgagaactcttcctccaagagaccacgttcctctggtcctgtctccgtgggccacatcca

SEQ ID NO: 15396 - DNA, 23 bp, Homo sapiens
  chr10:126479341-126479364
  hypo
cttctttttttgagacggagtca

SEQ ID NO: 15397 - DNA, 44 bp, Homo sapiens
  chr10:126809890-126809934
  hypo
aatgctttactcacacggcttggtgaattcgagaatccacagtc

SEQ ID NO: 15398 - DNA, 39 bp, Homo sapiens
  chr10:127463306-127463345
  hypo
cgcgggggaggaagacgctccccccggccttgcggggca

SEQ ID NO: 15399 - DNA, 84 bp, Homo sapiens
  chr10:130203435-130203519
  hypo
aggctgaagtgggaccggacagcactggcacggcttgactttggcaatggacaacagggaaaatggaggcgcaggtgagaaagg

SEQ ID NO: 15400 - DNA, 38 bp, Homo sapiens
  chr10:131641111-131641149
  hypo
cagcggcaccaacaccgtccacccgccactgcacactg

SEQ ID NO: 15401 - DNA, 190 bp, Homo sapiens
  chr10:131647747-131647937
  hypo
caggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcacgtacactcaataatgcgcccgaaagttgaggacc

SEQ ID NO: 15402 - DNA, 131 bp, Homo sapiens
  chr10:131844101-131844232
  hypo
gaagtctgatggctccggtcgtggctgttgtggggaatccgtcgtgtggagaacgtgcctgccacgtgcgggggagaaaggagccaccttccgagtacgcgacctcacctgccgggcgtgaggtgctggac

SEQ ID NO: 15403 - DNA, 65 bp, Homo sapiens
  chr10:131844627-131844692
  hypo
gacctgctccagaagcgccagttgcgggaccccacacggaaggcagtcttcggtggttctcactg

SEQ ID NO: 15404 - DNA, 172 bp, Homo sapiens
  chr10:131845044-131845216
  hypo
gaggttcatttaatccgtgcgtctatgcagcgcctaggcctaactctcccaggaggcgccagtcacgttccccagggggagctccctgacctttctgggggtgacagagtggggaagtgggcagtgtgagcccacccctgaggcgtgtgtgtgtaagcgtgcacacttgctt

SEQ ID NO: 15405 - DNA, 29 bp, Homo sapiens
  chr10:131936597-131936626
  hypo
caggcttgagcccccgtgacctgccctgt

SEQ ID NO: 15406 - DNA, 30 bp, Homo sapiens
  chr10:132001388-132001418
  hypo
acagcacacacagcacggtgcccacacagc

SEQ ID NO: 15407 - DNA, 132 bp, Homo sapiens
  chr10:132365736-132365868
  hypo
gcaaagcagaaatggcgtgacagccacatgtgcggggccggggaagtggaggctggctgctcctcacgggcactcgggtgaggctctctccacctcgcgcaggggctacccgctcgccgtgctgagcccttc

SEQ ID NO: 15408 - DNA, 119 bp, Homo sapiens
  chr10:132976493-132976612
  hypo
acaagacagtgacagcggtgaccctgccaggtgcttggaggggacttccctggaaacaaggaagccgactagcgcggggccctggacgtacttttgaaacaagacgaggcaggtttgta

SEQ ID NO: 15409 - DNA, 141 bp, Homo sapiens
  chr10:133913916-133914057
  hypo
gggtctctctccagtcgccccgtctgcctcccaggagggtgtcaggaaggccacgagaagacgtattgaccagaacagcctcacacacccttgagactggatgattctctgcaccctggttccttacgagggttggggggt

SEQ ID NO: 15410 - DNA, 57 bp, Homo sapiens
  chr10:133949378-133949435
  hypo
gacctgctggttctccgtcacttaaagaacaatcacatagtgcgttgtctttcagtt

SEQ ID NO: 15411 - DNA, 421 bp, Homo sapiens; identical to SEQ ID NO: 1589
  chr10:133951502-133951923
  hypo

SEQ ID NO: 15412 - DNA, 119 bp, Homo sapiens
  chr10:133962676-133962795
  hypo
gtgatgaactctgcccggcacatctggggtcagcgaatatacaggggcagtccttgtgggcaggtccaggtccagtgcagattctgccaccactgctgccgctgcggtttggttttcat

SEQ ID NO: 15413 - DNA, 46 bp, Homo sapiens
  chr10:133984135-133984181
  hypo
ttctcctgctcccagcgtgtgtccatgggggcggtcagggtagaca

SEQ ID NO: 15414 - DNA, 112 bp, Homo sapiens
  chr10:134012352-134012464
  hypo
aggtggaggctgaggcggtgtaccgagctgtcaccatcgccaagcaggcaaactgcccgctgtacgtcaccaaggtgatgagcaagggggcggccgacgccatcgctcaggc

SEQ ID NO: 15415 - DNA, 30 bp, Homo sapiens
  chr10:134014429-134014459
  hypo
ccccgagggcaccaacggcattgaggagcg

SEQ ID NO: 15416 - DNA, 51 bp, Homo sapiens
  chr10:134016358-134016409
  hypo
aggtaggcaggtgggcgctgagttctaggcccagaacgcacccctggtcaa

SEQ ID NO: 15417 - DNA, 67 bp, Homo sapiens
  chr10:134022845-134022912
  hypo
ggcttggacttgctccgtggggcctgcaggaccaggcagaagctgttctctgcgggactttgctgga

SEQ ID NO: 15418 - DNA, 47 bp, Homo sapiens
  chr10:134093662-134093709
  hypo
cacgcccctgcactccgtgaccacgccacctgcgctccatgaccatg

SEQ ID NO: 15419 - DNA, 212 bp, Homo sapiens; identical to SEQ ID NO: 1590
  chr10:134095580-134095792
  hypo

SEQ ID NO: 15420 - DNA, 241 bp, Homo sapiens
  chr10:134301075-134301316
  hypo
cttgggaagctgtgccgcaagcgggaatgagtggacggggctgctcacgcggctgcttttccgtcacggatgccccacccggtcctgtgcgggaggccctgttgaggtgagctccgccctgccgagtgtagggactttgcctccacctccagggttccacatccttccagtaggacacaggcagacatcgccttgggaggctgaatttgctcaaacggcaaacacacgatgagagcctggg

SEQ ID NO: 15421 - DNA, 180 bp, Homo sapiens
  chr10:134481125-134481305
  hypo
taatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaa

SEQ ID NO: 15422 - DNA, 274 bp, Homo sapiens; identical to SEQ ID NO: 5111
  chr10:134607922-134608196
  hypo

SEQ ID NO: 15423 - DNA, 38 bp, Homo sapiens
  chr10:134610885-134610923
  hypo
ggggtgcttccaaaccggtgcctcgtgaggaattggga

SEQ ID NO: 15424 - DNA, 121 bp, Homo sapiens
  chr10:134665081-134665202
  hypo
ggcattttccagaaccgtacctaagtggaggcgcacagagtgctgtctttccgtctggttcattttcctcggtaaagtcaccgtgagactcccccacgcggctgcacgcatgctccttccc

SEQ ID NO: 15425 - DNA, 30 bp, Homo sapiens
  chr10:134671588-134671618
  hypo
tgcaaggacaatgtacgacatccacagtaa

SEQ ID NO: 15426 - DNA, 77 bp, Homo sapiens
  chr10:134682737-134682814
  hypo
gactcaaaccccaggcggcgcagggtgggacggcacacacctggcctgctccagctcgctgacgcacacctgcccga

SEQ ID NO: 15427 - DNA, 21 bp, Homo sapiens
  chr10:134683679-134683700
  hypo
atgagacggtgaactgagtcg

SEQ ID NO: 15428 - DNA, 38 bp, Homo sapiens
  chr10:134690510-134690548
  hypo
aacagcagacacccccggcccaccggcatggctgtgca

SEQ ID NO: 15429 - DNA, 181 bp, Homo sapiens
  chr10:134699728-134699909
  hypo
ccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtcctcatgcttggtgcccgcagcacgggaacaatccccg

SEQ ID NO: 15430 - DNA, 74 bp, Homo sapiens
  chr10:134731905-134731979
  hypo
gatgaaccccacctccgcgaacttccgcagcaggtcggggcacacctgcctctgcaggacgacctcaggctggc

SEQ ID NO: 15431 - DNA, 41 bp, Homo sapiens
  chr10:134732884-134732925
  hypo
gacagacgtcccacacgccttgtttccgggccactttggcc

SEQ ID NO: 15432 - DNA, 471 bp, Homo sapiens; identical to SEQ ID NO: 5112
  chr10:134733221-134733692
  hypo

SEQ ID NO: 15433 - DNA, 30 bp, Homo sapiens
  chr10:134734085-134734115
  hypo
gatgttccgaatcaccgctccttttcctgg

SEQ ID NO: 15434 - DNA, 372 bp, Homo sapiens
  chr10:134738296-134738668
  hypo
gcgtggcgcacaccacgtggatgacccgggggtcgcccaggcgcacggctcgctgcagcgcgacgtctagcctctgtatgatatccagctgggcctgcggagaagacgtgggggattctagggaggttgctggctcgagctgcggggctggggcggcacctgcgtgcagggcacactgagaacgcaggccctaaattcatcaccctgcgtggcgtcatgctcaaatctgtccgtgaaaatggccagagtgactctttctaggaggaagtggacgtctcacaagatattacatgcaggaggcttggcggtgcccacacatcgtggctgcgcccgcctcccccgtgtggactcagcgggcgctgctcccttcct

SEQ ID NO: 15435 - DNA, 30 bp, Homo sapiens
  chr10:134788083-134788113
  hypo
gggagaggtggatgccgcccgcacctgcct

SEQ ID NO: 15436 - DNA, 224 bp, Homo sapiens
  chr10:134834692-134834916
  hypo
tcccgtcagcccctccgcggtcccggccccagccctgggttgagggagggctggggaggagcagggacagacgggcaggcaccaggacgctggctgctgcgtgaatgtcacctgtggtcacggccgacgcccggcgggcctgggcatggagtcaggaccggaaagcgaggccggcagcagcaccagctcctcagcaaggcccccgctgccgactgggcacgggc

SEQ ID NO: 15437 - DNA, 30 bp, Homo sapiens
  chr10:134855649-134855679
  hypo
ggtccgggatgggtccgggaaggcagggtc

SEQ ID NO: 15438 - DNA, 37 bp, Homo sapiens
  chr10:134875820-134875857
  hypo
caacacgttaagtaacgtgtcacgtgcctgctggcca

SEQ ID NO: 15439 - DNA, 49 bp, Homo sapiens
  chr10:134895296-134895345
  hypo
tccacccacagaagccgtgttctgattatcaacacgccctctggcagga

SEQ ID NO: 15440 - DNA, 39 bp, Homo sapiens
  chr10:134898411-134898450
  hypo
tgggtccctcatggccgcgtgagccgcttcctcactgta

SEQ ID NO: 15441 - DNA, 149 bp, Homo sapiens
  chr10:134913803-134913952
  hypo
caagtgcccgggaaacgccattgacgtcccgcctgtaagtgcctgcgagaggccgtcaccatcacgtctgcactttgccaccaagtacgccccacactgggatgaagcctgctggatccgcgggtgaggccccccgagggccttcagca

SEQ ID NO: 15442 - DNA, 324 bp, Homo sapiens
  chr10:134940950-134941274
  hypo
ggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaaccccatcgagtaggaacggcggtccagccatcagtgcccagagccagcctggaacctctcattcagggccctcagttccttctgcggccccaggatggcccgcccgtctgccctccgccttgccccgccc

SEQ ID NO: 15443 - DNA, 30 bp, Homo sapiens
  chr10:134941647-134941677
  hypo
agggccaatagggcccggttcccatccaca

SEQ ID NO: 15444 - DNA, 594 bp, Homo sapiens; identical to SEQ ID NO: 5113
  chr10:134942531-134943125
  hypo

SEQ ID NO: 15445 - DNA, 510 bp, Homo sapiens
  chr10:134996387-134996897
  hypo
caagggcatgggtggcgtgggtgcgagcaatgtgggcacggacggtgtgggcacaggcggtgtgggcacaggcggtgtgggcacaggcggtgtgggcacaggcggcgtgggcacaggcggcaagggcatgggtggcatgggtgcgagcagcatgggcggcgtgggtacaagtgaggagggtgtgggcggcgtgggcacgggcagtgtggacgtgggtggcggcaggggcggcaaaagtgtgggcggtatgggtgtgagcagcgtgggcgcgggcggcgagggtgccagcggcgtgggcgcgggcggcaagggtgtgggcagcgtgggcacgggtgctgcttcccctcaggggaatctcacgattcctgaaacttgagctcctggcccggagaagtgctggccgcggtcggggtggcgcacacgcagagactctggagctgacagcctgtcgtgcccacaggcgcacatctactctctgggggccacgctgaaggccgccctcgagtacgt

SEQ ID NO: 15446 - DNA, 173 bp, Homo sapiens
  chr10:135002007-135002180
  hypo
tgtccacactgacctcgccgctctcctgcccacagtgggtgtccctgcaggacctcctgtcccagctgggccggcccttccgggagtacgagctgtgggccctgtgcctggcctgcctccgcgcactgcagacacgccctgagcacccaggtgacgcacgcaccatcccatcc

SEQ ID NO: 15447 - DNA, 205 bp, Homo sapiens
  chr10:135011834-135012039
  hypo
ccccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccaggtgagcatcgtccccacaccccggagctgctgggtc

SEQ ID NO: 15448 - DNA, 195 bp, Homo sapiens
  chr10:135015152-135015347
  hypo
gcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgt

SEQ ID NO: 15449 - DNA, 32 bp, Homo sapiens
  chr10:135017129-135017161
  hypo
tgtggagctggcatccgcgtctcctgctgtta

SEQ ID NO: 15450 - DNA, 30 bp, Homo sapiens
  chr10:135017385-135017415
  hypo
actgtgaacggaggccgtggaggtgccggc

SEQ ID NO: 15451 - DNA, 106 bp, Homo sapiens
  chr10:135020767-135020873
  hypo
acgtcaacaagcacccgggcggccggcagaaggcccgcatcctgcaggccggcacgccgctggggctcatggcctacctgtactccaggtgcgttgggagaaaagc

SEQ ID NO: 15452 - DNA, 30 bp, Homo sapiens
  chr10:135023111-135023141
  hypo
ttgtggcttgcatggcgtgagtgtgagtgc

SEQ ID NO: 15453 - DNA, 66 bp, Homo sapiens
  chr10:135023434-135023500
  hypo
gtctcctgagggtggcgcggtttcacccagtgaagacccagaacctttgagcgtgcagcattgcgc

SEQ ID NO: 15454 - DNA, 30 bp, Homo sapiens
  chr10:135035009-135035039
  hypo
aatctcccaccctcccgtctcatctcatcg

SEQ ID NO: 15455 - DNA, 49 bp, Homo sapiens
  chr10:135069848-135069897
  hypo
ttttgccaccaaaggcgatcactgtggatcatgccggttcctgcacacc

SEQ ID NO: 15456 - DNA, 167 bp, Homo sapiens
  chr11:394801-394968
  hypo
ttggcacatggcaggcgggccaggccactcggtcggcaaacccggaacacgcacgcgcctggccccggtagcacagactcacatagggtctcagggacacccagacacccacgctcctcccatacctcacgggaatgagcagaacgggaaagcggggagaggtgtgg

SEQ ID NO: 15457 - DNA, 139 bp, Homo sapiens
  chr11:445925-446064
  hypo
cacttcagaagaccccgtccaccagaccgcctccccctgaggcccaacatgcagcagaggcagctcctccgtccctgcagcctccttttaactgtgggatatggcagccacccgtggagcggtccgggtgacaaagcca

SEQ ID NO: 15458 - DNA, 18 bp, Homo sapiens
  chr11:447613-447631
  hypo
gcccggccttctctgcca

SEQ ID NO: 15459 - DNA, 78 bp, Homo sapiens
  chr11:449595-449673
  hypo
taaaatcagcgtgtccgcaccattttcgcccgcccaatttcacgcgatcctgcgaaagaatgacccagaccggtccgg

SEQ ID NO: 15460 - DNA, 470 bp, Homo sapiens
  chr11:562246-562716
  hypo
acagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggag

SEQ ID NO: 15461 - DNA, 30 bp, Homo sapiens
  chr11:762939-762969
  hypo
tctgggatgaggtgacggcctggcgcaaga

SEQ ID NO: 15462 - DNA, 58 bp, Homo sapiens
  chr11:763318-763376
  hypo
gccctcacctgtccccgccccgcagggagctcgaggagcagcacggcatccactgcaa

SEQ ID NO: 15463 - DNA, 30 bp, Homo sapiens
  chr11:763637-763667
  hypo
ggcaggcaggggtggcggctcaaggtagtg

SEQ ID NO: 15464 - DNA, 268 bp, Homo sapiens
  chr11:850555-850823
  hypo
caccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcag

SEQ ID NO: 15465 - DNA, 80 bp, Homo sapiens
  chr11:859292-859372
  hypo
gcaccccggctcacacgcaccccccctttcacacgcaccccgggctcacacgcaccccgggctcacacgcaccccccctt

SEQ ID NO: 15466 - DNA, 180 bp, Homo sapiens
  chr11:862671-862851
  hypo
ctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctc

SEQ ID NO: 15467 - DNA, 68 bp, Homo sapiens
  chr11:864749-864817
  hypo
ccccaggttgtcccccgccctctgacgcagcgtcctgagccgtctgctcccagcgccccatccgggcc

SEQ ID NO: 15468 - DNA, 123 bp, Homo sapiens
  chr11:865692-865815
  hypo
gttccgctgctgtggcgtctccaactacactgactggttcgaggtgtacaacgccacgcgggtacctgactcctgctgcttggagttcagtgagagctgtgggctgcacgcccccggcacctg

SEQ ID NO: 15469 - DNA, 30 bp, Homo sapiens
  chr11:866956-866986
  hypo
tggaaaacaggttggcgctggaggagccgg

SEQ ID NO: 15470 - DNA, 30 bp, Homo sapiens
  chr11:875487-875517
  hypo
agacactgagggccccgggtgtggagaaga

SEQ ID NO: 15471 - DNA, 61 bp, Homo sapiens
  chr11:985399-985460
  hypo
gagactggtgagcaccgttctgtcttgcccagaagaccctgcagtgcgaggccgcctgact

SEQ ID NO: 15472 - DNA, 30 bp, Homo sapiens
  chr11:986983-987013
  hypo
tccctgagcaggtgccgtgggtcttcctgt

SEQ ID NO: 15473 - DNA, 231 bp, Homo sapiens
  chr11:1029190-1029421
  hypo
gagcgcccctccccacgggccacagggctcgtcctacctggaggaggatgtaggtgcaggtgccgtggaagcggtagggcctggcgtcaaatgtggtaacaaaggagccaccttccagggagcagtgtccggggcacggccgctccgtgcacacccagcggcccagggtgcaccggctgtgggtgggcgtgggggtagcggcatggtgggcagggccgctggagccagaca

SEQ ID NO: 15474 - DNA, 112 bp, Homo sapiens
  chr11:1030184-1030296
  hypo
gagagagagtgcctgcgactgccctcaccttccgggcagaagcacccgaaggtgcaggagctggagcagctgtgctgcgggttggagcaggtcttcacgcaggccgagccgc

SEQ ID NO: 15475 - DNA, 59 bp, Homo sapiens
  chr11:1075796-1075855
  hypo
gctgtgcacctgaagcggggtccgggccaggctgaggcccccgccggggtggagtccat

SEQ ID NO: 15476 - DNA, 35 bp, Homo sapiens
  chr11:1077652-1077687
  hypo
accaaagtctactcccgcgccggcctcaccctcat

SEQ ID NO: 15477 - DNA, 57 bp, Homo sapiens
  chr11:1095083-1095140
  hypo
agccctgcctctggacggtgtgatcgtgggtctgtctcccttcgcaggtgaggaggt

SEQ ID NO: 15478 - DNA, 30 bp, Homo sapiens
  chr11:1104124-1104154
  hypo
gagctgccccaatggcggctcgctgacaca

SEQ ID NO: 15479 - DNA, 30 bp, Homo sapiens
  chr11:1142462-1142492
  hypo
ctactgctgccatgtcgctgcagttcaatg

SEQ ID NO: 15480 - DNA, 30 bp, Homo sapiens
  chr11:1151771-1151801
  hypo
ctttgccctgggttccgggcaggctgcatg

SEQ ID NO: 15481 - DNA, 169 bp, Homo sapiens
  chr11:1214764-1214933
  hypo
aacgtcatctccctgcgcccgcgcacgtgcccgagggtggagaagcccacttgtgccaacggctacccggctgtgaaggtggctgaccaagatggctgctgccatcactaccagtgccagtgtgagtggagcgccgagcgggacccagggcagccggggcagccactcc

SEQ ID NO: 15482 - DNA, 123 bp, Homo sapiens
  chr11:1215867-1215990
  hypo
gtttgccaacaacaccgagggccagtgcggtgaggccacagggctcccgggcatcgtctggcattcgcgggggcgggggtgccgggcaggggcgaggccaccacgtgccgcgtgtgccggtgt

SEQ ID NO: 15483 - DNA, 177 bp, Homo sapiens
  chr11:1244354-1244531
  hypo
tgggtgccccgagcgcgtgccggacgctggtgttggctctggcggccatgctcgtggtgccgcaggcaggtaagagccccccactccgccccctctcgatgctgtcttcacggcgggggtctctgcaggtcgcttgcctgggagcttctcctgcagagtgcacgggcagatccccct

SEQ ID NO: 15484 - DNA, 67 bp, Homo sapiens
  chr11:1247815-1247882
  hypo
ggatgggcctcatcccgcgctccccacagccctgaacccggcgcacaatgggcgggtgtgcagcacc

SEQ ID NO: 15485 - DNA, 129 bp, Homo sapiens
  chr11:1250889-1251018
  hypo
gccggccctgcctcacgccgcgccccacaggcacggtgctggatgacatcacgcactctggctgcctgcccctcgggcagtgcccctgcacccacggcggccgcacctacagcccgggcacctccttca

SEQ ID NO: 15486 - DNA, 105 bp, Homo sapiens
  chr11:1252902-1253007
  hypo
gcccccagggcatggcggagatcctggtgccagcgcaggacaccagcattggaccagcggccccggaagcagccagctgggaggatggagcgggcagccctgccc

SEQ ID NO: 15487 - DNA, 279 bp, Homo sapiens
  chr11:1255015-1255294
  hypo
cttgtagttcatgtacgggtgggaagctaagctgcctgggagcctctctgcagaaaagcacaggtaagtgccacccctgccctgccctgccctgccccgccccgcatcaccccgcctggcctggccccaacacgccccaccctgccccaccccacctgaaccctgccgggccaggtcagtcctcacctgggctctgccacaggcacccatgccctgacacgccagggacggaggggccagtgggtctctgccccgcagtgtggccggggtgtcctgggg

SEQ ID NO: 15488 - DNA, 30 bp, Homo sapiens
  chr11:1256469-1256499
  hypo
cccactcctgcaggccgggcacactccagc

SEQ ID NO: 15489 - DNA, 106 bp, Homo sapiens
  chr11:1257713-1257819
  hypo
ggtcatcgagacccacgggatggccgtgtcctgggaccggaagaccagcgtgttcatccgactgcaccaggactacaaggtgagctcgggccgtgcactcctaggc

SEQ ID NO: 15490 - DNA, 42 bp, Homo sapiens
  chr11:1263602-1263644
  hypo
ggcggagaactaccccgaggtaagcatcgaccaggtcgggca

SEQ ID NO: 15491 - DNA, 30 bp, Homo sapiens
  chr11:1276708-1276738
  hypo
gagcctggaggcttacgcagagctctgccg

SEQ ID NO: 15492 - DNA, 161 bp, Homo sapiens
  chr11:1382237-1382398
  hypo
gggcggccacctgaacgagtgggaggagtgcagtcccaggccctcccagagactgtgccatagtctccaccccaagtgacggtggagggatgctgggaacggtaagctttaatgcttggtgaatcttgcattgcctcattcatgaccggtaggtcacgtgg

SEQ ID NO: 15493 - DNA, 76 bp, Homo sapiens
  chr11:1430992-1431068
  hypo
agcttcaggaaccaccgagatggggagcctgccggagacacaggttttctgagcgcaccagcggctccaaaagcag

SEQ ID NO: 15494 - DNA, 30 bp, Homo sapiens
  chr11:1444922-1444952
  hypo
gccccaggcctcccccgctgggcgttccgg

SEQ ID NO: 15495 - DNA, 30 bp, Homo sapiens
  chr11:1455198-1455228
  hypo
cacagatgaaactgacggaaagggcaaaat

SEQ ID NO: 15496 - DNA, 30 bp, Homo sapiens
  chr11:1461990-1462020
  hypo
gcgcactggtggccccgtctcctgcaggta

SEQ ID NO: 15497 - DNA, 257 bp, Homo sapiens; identical to SEQ ID NO: 5114
  chr11:1464204-1464461
  hypo

SEQ ID NO: 15498 - DNA, 243 bp, Homo sapiens
  chr11:1464674-1464917
  hypo
aaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggg

SEQ ID NO: 15499 - DNA, 127 bp, Homo sapiens
  chr11:1466979-1467106
  hypo
tactcagaccctccccggaagcgtgtggactccccgatgctgaaccggcacggcaagcggcggccagaacgcaaatccatggaggtgctcagcgtgacggacggcggctccccggtgcctgcgcggc

SEQ ID NO: 15500 - DNA, 209 bp, Homo sapiens
  chr11:1469157-1469366
  hypo
gggcaggcacatgggcgggtctggtggcgggctgggctgcagggctcctgctgcggtgaagccagccagcaagccaggcaagggcccgcgggccaggcagaggccgaggaggggtggggctgctgaggcgtggcccacgcctgcctgtgagggaccacgcaccatggcttacagggcctggggctagagcccggcgtggctgcaggccg

SEQ ID NO: 15501 - DNA, 178 bp, Homo sapiens
  chr11:1471880-1472058
  hypo
cgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaaggtgagtgtctgcccggaggcgccagagtggggct

SEQ ID NO: 15502 - DNA, 33 bp, Homo sapiens
  chr11:1477820-1477853
  hypo
cccctaggccccagccgtcgcttcaagagggtg

SEQ ID NO: 15503 - DNA, 62 bp, Homo sapiens
  chr11:1669565-1669627
  hypo
tcaccggccagagggcgcagccacccggccttcccgaagcaggacagcggcctttccaagac

SEQ ID NO: 15504 - DNA, 33 bp, Homo sapiens
  chr11:1856532-1856565
  hypo
ctgggctctcattgccggcgcccttgccgcggg

SEQ ID NO: 15505 - DNA, 48 bp, Homo sapiens; identical to SEQ ID NO: 5115
  chr11:1868130-1868178
  hypo

SEQ ID NO: 15506 - DNA, 33 bp, Homo sapiens
  chr11:1955358-1955391
  hypo
cactggctaaggccccggcgccctgcagaaccc

SEQ ID NO: 15507 - DNA, 49 bp, Homo sapiens
  chr11:1957372-1957421
  hypo
aagctagcccacagccgggcctcgatgccccagccgcccatccagcctt

SEQ ID NO: 15508 - DNA, 120 bp, Homo sapiens
  chr11:1958184-1958304
  hypo
gttcacagatcaccacgctcaggagccgcattgaccaggcccagaagcagtgagtagccctgccgtcctcgctccgcactgggcacaggggcccttggggccagccgctgtagccagtcc

SEQ ID NO: 15509 - DNA, 190 bp, Homo sapiens
  chr11:1959032-1959222
  hypo
ctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctca

SEQ ID NO: 15510 - DNA, 41 bp, Homo sapiens
  chr11:1981275-1981316
  hypo
ggggtggagggccctcgggaccgcaccgggctgtgctcata

SEQ ID NO: 15511 - DNA, 30 bp, Homo sapiens
  chr11:2037043-2037073
  hypo
tgtgctgggtgtgcacgatgcccgtgggcc

SEQ ID NO: 15512 - DNA, 43 bp, Homo sapiens
  chr11:2040105-2040148
  hypo
caaaggggcctgcatcgcgccaacctctcgcagctctccagcg

SEQ ID NO: 15513 - DNA, 238 bp, Homo sapiens
  chr11:2210040-2210278
  hypo
tgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaa

SEQ ID NO: 15514 - DNA, 40 bp, Homo sapiens
  chr11:2278423-2278463
  hypo
aggttcgacctgagccggcactgcccggctgccctggggc

SEQ ID NO: 15515 - DNA, 79 bp, Homo sapiens
  chr11:2278708-2278787
  hypo
ccacgtcaggagacccgcctcaggcagcagtggcccggtggctgcttctgcctagcccgcagcacgtgccaccctgggc

SEQ ID NO: 15516 - DNA, 75 bp, Homo sapiens
  chr11:2438114-2438189
  hypo
gctggaacctgactccgccttacaaaaggaatgaagcatggaatggcatacgcttcaacacggaggaaccgtcaa

SEQ ID NO: 15517 - DNA, 30 bp, Homo sapiens
  chr11:2543418-2543448
  hypo
gctcatgcagctccccgccccccgcatgac

SEQ ID NO: 15518 - DNA, 76 bp, Homo sapiens
  chr11:2596517-2596593
  hypo
ctgcagcccgagcctcggccatcgcgcgccctggcctggccattgttcccgccaggccccgcgcccctggtcgccc

SEQ ID NO: 15519 - DNA, 30 bp, Homo sapiens
  chr11:2818227-2818257
  hypo
ggagagattttacaacgtatgggctggtgg

SEQ ID NO: 15520 - DNA, 30 bp, Homo sapiens
  chr11:2829204-2829234
  hypo
aggatgagacaggaacggtctctctggggg

SEQ ID NO: 15521 - DNA, 30 bp, Homo sapiens
  chr11:3169805-3169835
  hypo
gcagggcgggggcaccgtcctctgcacttt

SEQ ID NO: 15522 - DNA, 30 bp, Homo sapiens
  chr11:3828932-3828962
  hypo
ttaagtggaaaagtgcgatgttaggtatgg

SEQ ID NO: 15523 - DNA, 26 bp, Homo sapiens
  chr11:5169023-5169049
  hypo
tttttttttttttttcggagacagag

SEQ ID NO: 15524 - DNA, 159 bp, Homo sapiens
  chr11:5192016-5192175
  hypo
ccacagaaaggcagacgcctcaggagaaagagcagtgggagcataagcattacactgcgcaaggcaatggcggcacccgtcccagaaatgcaggcaattgtcagaatggttgtgtagcgcagtgggctgtagatggccacaaagcggtccactgacatt

SEQ ID NO: 15525 - DNA, 80 bp, Homo sapiens
  chr11:6497229-6497309
  hypo
ttcaaactgacatccccatttccaccccagtccatgccagatgcccctcctttgtgctcccacagcgccctctgtacttc

SEQ ID NO: 15526 - DNA, 30 bp, Homo sapiens
  chr11:6731043-6731073
  hypo
actcctgaggtctctcgccccagtgccacc

SEQ ID NO: 15527 - DNA, 163 bp, Homo sapiens; identical to SEQ ID NO: 1591
  chr11:9405392-9405555
  hypo

SEQ ID NO: 15528 - DNA, 20 bp, Homo sapiens
  chr11:10815867-10815887
  hypo
acatttgaagctgggcgcgg

SEQ ID NO: 15529 - DNA, 101 bp, Homo sapiens
  chr11:10865201-10865302
  hypo
ggagtcttgaaatgactgcagctcttgctaacaccttcatcgcagccagtgagagactctgaagctaagctccacctgattcctgacgtatagcaactgtg

SEQ ID NO: 15530 - DNA, 87 bp, Homo sapiens
  chr11:14564357-14564444
  hypo
atctttgcaggttggcgaagctaatggattccttctcagaatgatttttttctttctttcttgagacggagtctagctctgtctccc

SEQ ID NO: 15531 - DNA, 88 bp, Homo sapiens
  chr11:17100697-17100785
  hypo
aagtaactggcaagacgctgggaaactagatactgaaacatccgctcttaacttttaacctgtcactatttgaaataaagttatcagg

SEQ ID NO: 15532 - DNA, 37 bp, Homo sapiens
  chr11:19137271-19137308
  hypo
tacaggtgtgagccaccacgcccggccagaaagctct

SEQ ID NO: 15533 - DNA, 139 bp, Homo sapiens
  chr11:27495284-27495423
  hypo
gctttaagggtacttcgtttcttgctctctgccatggcgttgagtcgttttactctataatggagacatttttaatgaatacattaaaacaagcaggattcggccgggcgcggtggctcacgcctgtaatcccaacact

SEQ ID NO: 15534 - DNA, 17 bp, Homo sapiens
  chr11:33181188-33181205
  hypo
cgcgcctgtactcccag

SEQ ID NO: 15535 - DNA, 29 bp, Homo sapiens
  chr11:33202774-33202803
  hypo
acacctgtaattagccgggtgtggtggtg

SEQ ID NO: 15536 - DNA, 30 bp, Homo sapiens
  chr11:33270025-33270055
  hypo
aattgaacttcaacccgggaggcggaagtt

SEQ ID NO: 15537 - DNA, 19 bp, Homo sapiens
  chr11:33277689-33277708
  hypo
ccaccgcgcccggcctcct

SEQ ID NO: 15538 - DNA, 30 bp, Homo sapiens
  chr11:34534277-34534307
  hypo
ccaaactgaaaactccggcccgagaatacc

SEQ ID NO: 15539 - DNA, 134 bp, Homo sapiens
  chr11:34535069-34535203
  hypo
gtgtcaaacagctcccggaggccctgggactgcacccagcgcaggtgccggccctggagctggagatggacgagcagacccaggccccaggccgagcctctgagccctgacaccccttacgattcatccaaaaa

SEQ ID NO: 15540 - DNA, 30 bp, Homo sapiens
  chr11:35134309-35134339
  hypo
agttaaacttggggccgagcagagccaaga

SEQ ID NO: 15541 - DNA, 35 bp, Homo sapiens
  chr11:35685096-35685131
  hypo
agaagaaggggaatccgaggcggagggagaaactg

SEQ ID NO: 15542 - DNA, 83 bp, Homo sapiens
  chr11:44922891-44922974
  hypo
taaatacaggtagtccgtttatgagctgccatatttattacaccccttaattgctaaagagccagagccggctgaagctggat

SEQ ID NO: 15543 - DNA, 32 bp, Homo sapiens
  chr11:46298483-46298515
  hypo
ttacaagctgaaaatcggctgggcatggtggc

SEQ ID NO: 15544 - DNA, 137 bp, Homo sapiens
  chr11:47358971-47359108
  hypo
tgggcctggacatgccgatggcgttgaccgcgtagacgcgcatctcgtacaccacgccctcgatcatgcgccgcgcttcatgactcagctcctgaatcaggtcgaagttcagccgcatccaccggtagctcttcttc

SEQ ID NO: 15545 - DNA, 30 bp, Homo sapiens
  chr11:57150498-57150528
  hypo
gcagattggtaggaccgggcacggtggctc

SEQ ID NO: 15546 - DNA, 106 bp, Homo sapiens
  chr11:57235330-57235436
  hypo
tctccaccatctacccgggcactttccgccacttgcaagccctggaggagctggacctcggtgacaaccggcacctgcgctcgctggagcccgacaccttccaggg

SEQ ID NO: 15547 - DNA, 30 bp, Homo sapiens
  chr11:59312651-59312681
  hypo
attccaggacagagacgacagaaacctgaa

SEQ ID NO: 15548 - DNA, 30 bp, Homo sapiens
  chr11:59609810-59609840
  hypo
tcctcctccatgggacgctctcctttgtca

SEQ ID NO: 15549 - DNA, 32 bp, Homo sapiens
  chr11:59841410-59841442
  hypo
agagagaccgtggggagcggcagcgggagcag

SEQ ID NO: 15550 - DNA, 30 bp, Homo sapiens
  chr11:60897879-60897909
  hypo
gcagcgctgacctagcgtcacgcggatggc

SEQ ID NO: 15551 - DNA, 171 bp, Homo sapiens; identical to SEQ ID NO: 5117
  chr11:60941596-60941767
  hypo

SEQ ID NO: 15552 - DNA, 30 bp, Homo sapiens
  chr11:61039084-61039114
  hypo
ctcctctgggtgaggcggggcagccaggta

SEQ ID NO: 15553 - DNA, 37 bp, Homo sapiens
  chr11:61049497-61049534
  hypo
ggtccatgcctgccccgaggtgcgggatgtgactcag

SEQ ID NO: 15554 - DNA, 78 bp, Homo sapiens
  chr11:61664613-61664691
  hypo
agtaagtggtgatggcggaggtggggtggcttcaggatttgggtttaatcccaagcacgagggcgggcagggaaagga

SEQ ID NO: 15555 - DNA, 30 bp, Homo sapiens
  chr11:61666106-61666136
  hypo
tgtcacatgccacagcggtggtccagacct

SEQ ID NO: 15556 - DNA, 41 bp, Homo sapiens
  chr11:61669905-61669946
  hypo
tgactcaccctggcccgggaagatggcgagatgtagtaatg

SEQ ID NO: 15557 - DNA, 30 bp, Homo sapiens
  chr11:61736670-61736700
  hypo
ttgcctggggctgggcgcggtggctcatgc

SEQ ID NO: 15558 - DNA, 30 bp, Homo sapiens
  chr11:62370720-62370750
  hypo
tggggagagggagcccgcccagctcagctc

SEQ ID NO: 15559 - DNA, 30 bp, Homo sapiens
  chr11:62445455-62445485
  hypo
tcatcttcctgtagccgctgtcgtgctgct

SEQ ID NO: 15560 - DNA, 30 bp, Homo sapiens
  chr11:63783752-63783782
  hypo
tccgcagcctgcgtccgtggtaactgccag

SEQ ID NO: 15561 - DNA, 39 bp, Homo sapiens
  chr11:63849387-63849426
  hypo
tggactcccggctctcgagtgccgcgttctacctgctgt

SEQ ID NO: 15562 - DNA, 77 bp, Homo sapiens
  chr11:63955145-63955222
  hypo
atttctggaataagacgttgctcttttacctttaagaaaggatctggggccgggcaccgtggctcagcctgtaatcc

SEQ ID NO: 15563 - DNA, 28 bp, Homo sapiens
  chr11:64578577-64578605
  hypo
gtttgttttgagacacggtctttctctt

SEQ ID NO: 15564 - DNA, 30 bp, Homo sapiens
  chr11:64668004-64668034
  hypo
cccgctgcccccctgcgtgcgccatgagtt

SEQ ID NO: 15565 - DNA, 30 bp, Homo sapiens
  chr11:64977482-64977512
  hypo
cctcagtccatcttccggaagtttgacctg

SEQ ID NO: 15566 - DNA, 30 bp, Homo sapiens
  chr11:65091387-65091417
  hypo
agcagggaagagtttcgctggccaggctga

SEQ ID NO: 15567 - DNA, 30 bp, Homo sapiens
  chr11:65127486-65127516
  hypo
tctgaaactccttgacgatgagactgttcc

SEQ ID NO: 15568 - DNA, 34 bp, Homo sapiens
  chr11:65511036-65511070
  hypo
gattacaggcgtgagccaccgcaccctcttggcc

SEQ ID NO: 15569 - DNA, 95 bp, Homo sapiens
  chr11:65551629-65551724
  hypo
ggcttgttcaggggacgcgggagacagcagtgtggctggcatacagggacccagctggaaggggattgggaggtcaacggcggccccagcacgcc

SEQ ID NO: 15570 - DNA, 35 bp, Homo sapiens
  chr11:65722789-65722824
  hypo
tactcggctgtacgccgtggctcacacctgtaatc

SEQ ID NO: 15571 - DNA, 30 bp, Homo sapiens
  chr11:66048072-66048102
  hypo
ggggggctgagtcagcgccaggcagcctgg

SEQ ID NO: 15572 - DNA, 104 bp, Homo sapiens
  chr11:66325272-66325376
  hypo
ggcgtctgcacaagccgccccgcattcaggaaaagtgccagctggagatcaacttcaacacactgcagaccaagttgcggctcagccaccggcctgccttcatg

SEQ ID NO: 15573 - DNA, 93 bp, Homo sapiens
  chr11:66411368-66411461
  hypo
tgctgcagcagcagccgctgctgctgttactgcagcttccacttcatattacgggcgggatcggagccccctgcgtcgcgctacagccccagt

SEQ ID NO: 15574 - DNA, 99 bp, Homo sapiens; identical to SEQ ID NO: 5119
  chr11:66511245-66511344
  hypo

SEQ ID NO: 15575 - DNA, 82 bp, Homo sapiens; identical to SEQ ID NO: 1592
  chr11:66513182-66513264
  hypo

SEQ ID NO: 15576 - DNA, 82 bp, Homo sapiens; identical to SEQ ID NO: 1593
  chr11:66513564-66513646
  hypo

SEQ ID NO: 15577 - DNA, 16 bp, Homo sapiens
  chr11:66515380-66515396
  hypo
gcgcagggcagcatta

SEQ ID NO: 15578 - DNA, 190 bp, Homo sapiens
  chr11:66625148-66625338
  hypo
ccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgttt

SEQ ID NO: 15579 - DNA, 343 bp, Homo sapiens
  chr11:66625538-66625881
  hypo
ggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcc

SEQ ID NO: 15580 - DNA, 207 bp, Homo sapiens
  chr11:66631300-66631507
  hypo
tggggtggtctttgccgtgggcaatgactttgaccagcagggagtcgtagtggggcgagatgacggctccttggaaggcggaagcattatccaggcggatgcccatgccctctccgctccggaacacctgtgggaagggtgaggcgtgaggacctgcgccagaaactgcggtcaaaagtgccccacccaccccgaggctggccaggt

SEQ ID NO: 15581 - DNA, 157 bp, Homo sapiens; identical to SEQ ID NO: 1594
  chr11:67072239-67072396
  hypo

SEQ ID NO: 15582 - DNA, 40 bp, Homo sapiens
  chr11:67210017-67210057
  hypo
cctcatagcactggtcgttcttgaccggctgcccgaacac

SEQ ID NO: 15583 - DNA, 36 bp, Homo sapiens
  chr11:67462643-67462679
  hypo
cgtatgaggtagccacggaaccgcaggcaagactca

SEQ ID NO: 15584 - DNA, 59 bp, Homo sapiens
  chr11:67764182-67764241
  hypo
tgttgccccagcccacgctgcgcagatcgatctcctccgtgggccggtaagcggctccg

SEQ ID NO: 15585 - DNA, 147 bp, Homo sapiens
  chr11:67781462-67781609
  hypo
gaccggagcaggtcccgccctcaaggtggccacttaacaatcacccacagccttgcgctcaccgatgctgggccctgggctcagaaccgactgtgtggtctcatcattagctggcaggtgccatcattacaccggtaacatgagagg

SEQ ID NO: 15586 - DNA, 93 bp, Homo sapiens; identical to SEQ ID NO: 5123
  chr11:67797202-67797295
  hypo

SEQ ID NO: 15587 - DNA, 154 bp, Homo sapiens
  chr11:68111091-68111245
  hypo
ctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccagga

SEQ ID NO: 15588 - DNA, 142 bp, Homo sapiens
  chr11:68133031-68133173
  hypo
ttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtg

SEQ ID NO: 15589 - DNA, 45 bp, Homo sapiens
  chr11:69192566-69192611
  hypo
tgggaaagtcctgggcgagccgggacaagtcgctcaccctactag

SEQ ID NO: 15590 - DNA, 72 bp, Homo sapiens; identical to SEQ ID NO: 1595
  chr11:69280561-69280633
  hypo

SEQ ID NO: 15591 - DNA, 30 bp, Homo sapiens
  chr11:69339953-69339983
  hypo
catccctgcccgccccgtccccatgcttgc

SEQ ID NO: 15592 - DNA, 30 bp, Homo sapiens
  chr11:69970448-69970478
  hypo
ccctcagctcctgtacgaagagtgggcacg

SEQ ID NO: 15593 - DNA, 30 bp, Homo sapiens
  chr11:70051066-70051096
  hypo
agaagttcagcatagcggttaagggtcgac

SEQ ID NO: 15594 - DNA, 34 bp, Homo sapiens
  chr11:71117681-71117715
  hypo
cgctgctccctaccacggacgattggaacttcca

SEQ ID NO: 15595 - DNA, 34 bp, Homo sapiens; identical to SEQ ID NO: 5125
  chr11:72475677-72475711
  hypo

SEQ ID NO: 15596 - DNA, 30 bp, Homo sapiens
  chr11:72532300-72532330
  hypo
ctgggaacatcatggcgcccgagggccgga

SEQ ID NO: 15597 - DNA, 30 bp, Homo sapiens
  chr11:72905832-72905862
  hypo
cttccttcagcctgccgccctgtcctgagt

SEQ ID NO: 15598 - DNA, 62 bp, Homo sapiens
  chr11:73073174-73073236
  hypo
tgcctgctgagcctgcgcgccgagccggacgtggaggcctgcatcgccgtctgttccgcccg

SEQ ID NO: 15599 - DNA, 20 bp, Homo sapiens
  chr11:73310437-73310457
  hypo
gcaacctctgcctcccgggt

SEQ ID NO: 15600 - DNA, 24 bp, Homo sapiens
  chr11:74246632-74246656
  hypo
tatgagccacggcacccagcccaa

SEQ ID NO: 15601 - DNA, 91 bp, Homo sapiens
  chr11:75459473-75459564
  hypo
cagataaacaaaaggcgttaggttggtgcgaaagtcattgaggtttttgccaatagcatccctacaatggactattatttgatcgtaaaaa

SEQ ID NO: 15602 - DNA, 348 bp, Homo sapiens; identical to SEQ ID NO: 5126
  chr11:76371738-76372086
  hypo

SEQ ID NO: 15603 - DNA, 30 bp, Homo sapiens
  chr11:95488699-95488729
  hypo
gacatgaaggaagcccgttagatatctctg

SEQ ID NO: 15604 - DNA, 30 bp, Homo sapiens
  chr11:95658721-95658751
  hypo
gtcggttgcacagtacggtctcactaagta

SEQ ID NO: 15605 - DNA, 45 bp, Homo sapiens; identical to SEQ ID NO: 1596
  chr11:102961347-102961392
  hypo

SEQ ID NO: 15606 - DNA, 185 bp, Homo sapiens
  chr11:113552799-113552984
  hypo
ataacatgctgagcccgcaccgggctctaggaaccagaaatcagagtgaccaggggaaactgggacatcgatatgcatggcttgccggagtaacactacacctgactcaccttcctagcctcccgcaaattgccagagaagttctgggcctaggagggccaggctgtttgcgcaaaacattaggt

SEQ ID NO: 15607 - DNA, 32 bp, Homo sapiens
  chr11:116890012-116890044
  hypo
gggtgagccaccgcacacggtctttattgtaa

SEQ ID NO: 15608 - DNA, 16 bp, Homo sapiens
  chr11:116952332-116952348
  hypo
ccgtctcaaaataaat

SEQ ID NO: 15609 - DNA, 40 bp, Homo sapiens
  chr11:120008098-120008138
  hypo
agcagctggtggtctcggaaggcggcgccctccaggtggg

SEQ ID NO: 15610 - DNA, 30 bp, Homo sapiens
  chr11:120367603-120367633
  hypo
ccctctactgtccatcgtgagccctcttcc

SEQ ID NO: 15611 - DNA, 30 bp, Homo sapiens
  chr11:121023674-121023704
  hypo
ctgcagccactactgcgtggagggctgtca

SEQ ID NO: 15612 - DNA, 54 bp, Homo sapiens
  chr11:125755569-125755623
  hypo
ccaacccccaggccacggacaggcacctaggaaccaggccgcaaggcagggggt

SEQ ID NO: 15613 - DNA, 22 bp, Homo sapiens
  chr11:126083949-126083971
  hypo
aagaatttatgtggccgggcgc

SEQ ID NO: 15614 - DNA, 37 bp, Homo sapiens
  chr11:126273042-126273079
  hypo
cccacaaggggagggcgtggctcgtgaaattcctgat

SEQ ID NO: 15615 - DNA, 30 bp, Homo sapiens
  chr11:129867029-129867059
  hypo
aaaatatggattttacgtgtaggttatgtt

SEQ ID NO: 15616 - DNA, 30 bp, Homo sapiens
  chr11:130717573-130717603
  hypo
ttacctgtgcttaaccgcagtccagaaata

SEQ ID NO: 15617 - DNA, 103 bp, Homo sapiens
  chr11:131522763-131522866
  hypo
gggtggcggtcactccgccttcagaaagccacttggaatgcaacctgcacaattgccttcatcctttaccgccctgccagattgttgacggaagcaaccttat

SEQ ID NO: 15618 - DNA, 34 bp, Homo sapiens
  chr11:131766926-131766960
  hypo
ctggcaggcatttgacgtccgtggctgaatagcc

SEQ ID NO: 15619 - DNA, 104 bp, Homo sapiens
  chr11:133231728-133231832
  hypo
aatgagctcagcatgcgggacagcagcgccggccctcactctccagggacgcatggagctctgtcaaatgacccgacaaacctttgcagcgcagaggcttctag

SEQ ID NO: 15620 - DNA, 125 bp, Homo sapiens
  chr11:134011075-134011200
  hypo
tggtgctggggttgccgatggggagaaaacacggtgtaccctgaagtgacatcctcccgggtgggaggatggtggtcagggaaggctccccaaagtggcctctctgggtgcggtgtgaagggtgg

SEQ ID NO: 15621 - DNA, 30 bp, Homo sapiens
  chr12:1948142-1948172
  hypo
cacgaccagtgacaccgggcttctacccgg

SEQ ID NO: 15622 - DNA, 52 bp, Homo sapiens
  chr12:1948496-1948548
  hypo
aacaagggtaaggagcgcttcatcgcagggacctgatcgttctcagacagct

SEQ ID NO: 15623 - DNA, 194 bp, Homo sapiens; identical to SEQ ID NO: 5128
  chr12:2566053-2566247
  hypo

SEQ ID NO: 15624 - DNA, 30 bp, Homo sapiens
  chr12:2590465-2590495
  hypo
taacctcaaaaccaccgtagagaaaggtgc

SEQ ID NO: 15625 - DNA, 295 bp, Homo sapiens; identical to SEQ ID NO: 5129
  chr12:2964499-2964794
  hypo

SEQ ID NO: 15626 - DNA, 55 bp, Homo sapiens
  chr12:4405652-4405707
  hypo
agctattgtctaccacgcctcgtgtgcacacgcacacacacgcaagttccctcag

SEQ ID NO: 15627 - DNA, 30 bp, Homo sapiens
  chr12:4554801-4554831
  hypo
ctccctccggcatggcggcaggggcttatt

SEQ ID NO: 15628 - DNA, 103 bp, Homo sapiens
  chr12:5335946-5336049
  hypo
acatcatagatcactcgctgacaggctgaactgggcgccatcttgaagaacgtaggctgcatgctaatgacgcccaggaggagctgcgcgctgcattgtggag

SEQ ID NO: 15629 - DNA, 185 bp, Homo sapiens
  chr12:6483568-6483753
  hypo
gaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtgg

SEQ ID NO: 15630 - DNA, 30 bp, Homo sapiens
  chr12:8060661-8060691
  hypo
tgctgggattacaggcgtgagccacctcag

SEQ ID NO: 15631 - DNA, 30 bp, Homo sapiens
  chr12:8117682-8117712
  hypo
agatgtggagaacagcgcaggaataataac

SEQ ID NO: 15632 - DNA, 18 bp, Homo sapiens
  chr12:8127122-8127140
  hypo
gcccggccaaggtcataa

SEQ ID NO: 15633 - DNA, 118 bp, Homo sapiens
  chr12:8790007-8790125
  hypo
tgcagagggagacatcgcagctgtctttgggcttggcttcccgccttgttttggagggcctttctgctttgtggctctgtatggcccccagaagatagtggcccggctcaagaagtat

SEQ ID NO: 15634 - DNA, 30 bp, Homo sapiens
  chr12:8799975-8800005
  hypo
tgaaaaattggatagcgaattatgagtcca

SEQ ID NO: 15635 - DNA, 81 bp, Homo sapiens
  chr12:8808559-8808640
  hypo
tacaataatgacaaacgattgatgacttctttgcaatacttatttaaaatgaaatcggatataccaaaggcattgtgattt

SEQ ID NO: 15636 - DNA, 31 bp, Homo sapiens
  chr12:10363278-10363309
  hypo
agtttaattttcagtcgctcatgttaggttt

SEQ ID NO: 15637 - DNA, 89 bp, Homo sapiens; identical to SEQ ID NO: 1597
  chr12:12848467-12848556
  hypo

SEQ ID NO: 15638 - DNA, 181 bp, Homo sapiens
  chr12:13079830-13080011
  hypo
aacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctcc

SEQ ID NO: 15639 - DNA, 94 bp, Homo sapiens
  chr12:13215216-13215310
  hypo
ttagtactgctgggccgtgtgctcacgtggagcggaataaataacatccttcccaggtttagaggttggagtttggtcgcggggtgcttctgag

SEQ ID NO: 15640 - DNA, 65 bp, Homo sapiens
  chr12:17629461-17629526
  hypo
ttccagctcccactccgacgggccagtatttttgtctcctctatcactcccgcctactcttctga

SEQ ID NO: 15641 - DNA, 45 bp, Homo sapiens
  chr12:21833068-21833113
  hypo
aattcaagtttgggccgaagtttaaagacttttgtttgggccggg

SEQ ID NO: 15642 - DNA, 83 bp, Homo sapiens
  chr12:22698113-22698196
  hypo
gagatcactcctctgtctccaaaaaaagaaaaaaaagaaagaaagaaatagagataccaggcacatctcgaatagtgaaataa

SEQ ID NO: 15643 - DNA, 77 bp, Homo sapiens
  chr12:25081492-25081569
  hypo
gagcccacaaaatcgaagctgcagcgagctgtgattgtgccatgccagcctgcaatacagagcgagacagtctcaaa

SEQ ID NO: 15644 - DNA, 16 bp, Homo sapiens
  chr12:27489593-27489609
  hypo
ttaaacctggctgggc

SEQ ID NO: 15645 - DNA, 20 bp, Homo sapiens
  chr12:30859424-30859444
  hypo
acaagcgtaagccactgtac

SEQ ID NO: 15646 - DNA, 19 bp, Homo sapiens
  chr12:32340317-32340336
  hypo
aatctatgggctgggcgcg

SEQ ID NO: 15647 - DNA, 151 bp, Homo sapiens
  chr12:32597645-32597796
  hypo
tgatttttgacaagaattttctcctttcaaaaagtgcttaattgtggcaaggtgagacctgaggtgaagataaaggatgggtgggtatttcttcagaattcagcagaaagatttgccaacctttaagtagacacgccgttccaaatttgta

SEQ ID NO: 15648 - DNA, 33 bp, Homo sapiens
  chr12:32831140-32831173
  hypo
ttttttcatgaacaccgccccccgctgctccga

SEQ ID NO: 15649 - DNA, 92 bp, Homo sapiens
  chr12:32831293-32831385
  hypo
gggattacaccgcgctcggtcctgaacacacattttgtttgtttgtttgtttgtttacaaaacccctggagaacccgcgtattctaacctgg

SEQ ID NO: 15650 - DNA, 68 bp, Homo sapiens
  chr12:34494888-34494956
  hypo
accacgcaccccattcggtgcatacacggggtcccgggtttgcactccccgagcggctggacactgcg

SEQ ID NO: 15651 - DNA, 99 bp, Homo sapiens
  chr12:34502764-34502863
  hypo
cttccaccagtgtttcggcctccccgttcaagcctccctgcggctgtgggcggctaccccaggggaccagctgctccgagggcgcgagcctaggaccct

SEQ ID NO: 15652 - DNA, 40 bp, Homo sapiens
  chr12:34520176-34520216
  hypo
gcaccttgggctagccgcctttggccggaggcgctcagtg

SEQ ID NO: 15653 - DNA, 94 bp, Homo sapiens
  chr12:38550728-38550822
  hypo
aaggggaaagcatgtcggtcttaaagagggacgttgaggcagcccggagaaaaaaacagggaggctggggtccttccaccgatgacagtgcctt

SEQ ID NO: 15654 - DNA, 147 bp, Homo sapiens; identical to SEQ ID NO: 1598
  chr12:49657607-49657754
  hypo

SEQ ID NO: 15655 - DNA, 235 bp, Homo sapiens; identical to SEQ ID NO: 5132
  chr12:51421351-51421586
  hypo

SEQ ID NO: 15656 - DNA, 21 bp, Homo sapiens
  chr12:51565449-51565470
  hypo
cgcacccggccgaaaggagat

SEQ ID NO: 15657 - DNA, 20 bp, Homo sapiens
  chr12:51930773-51930793
  hypo
gagcatgaagctgggcgctg

SEQ ID NO: 15658 - DNA, 144 bp, Homo sapiens
  chr12:53189513-53189657
  hypo
agccacctccatagccgctcccaaagccacctccatagccacctgcaaaggcacagctgctccgccctcccccaaagcctccagcccgggagccgccagctgccacgctgatggagatgctcttgttgccgcccaggttgtaga

SEQ ID NO: 15659 - DNA, 198 bp, Homo sapiens
  chr12:53663026-53663224
  hypo
ctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgca

SEQ ID NO: 15660 - DNA, 97 bp, Homo sapiens; identical to SEQ ID NO: 1599
  chr12:54720206-54720303
  hypo

SEQ ID NO: 15661 - DNA, 43 bp, Homo sapiens
  chr12:56441277-56441320
  hypo
acctgccagataggccgggcgcggtggctcacgcctgtaatcc

SEQ ID NO: 15662 - DNA, 30 bp, Homo sapiens
  chr12:57559766-57559796
  hypo
gcctgcagggcagctcggctctggcagtgc

SEQ ID NO: 15663 - DNA, 212 bp, Homo sapiens; identical to SEQ ID NO: 5136
  chr12:57881112-57881324
  hypo

SEQ ID NO: 15664 - DNA, 75 bp, Homo sapiens; identical to SEQ ID NO: 5137
  chr12:58241524-58241599
  hypo

SEQ ID NO: 15665 - DNA, 19 bp, Homo sapiens
  chr12:62539074-62539093
  hypo
cctcctgtcagttggcggt

SEQ ID NO: 15666 - DNA, 22 bp, Homo sapiens
  chr12:62563354-62563376
  hypo
gggcacagtggctcacgcctgt

SEQ ID NO: 15667 - DNA, 149 bp, Homo sapiens
  chr12:64783185-64783334
  hypo
ttggatcaagtgagccgcctgagattgccaagcgtcctgtgcgcatctcattaacgcatctgcttattcatgcatttattcttttgctggggagggggtggaggggaacggtgtctcactcattctgtagctcaggctggagtgcaggt

SEQ ID NO: 15668 - DNA, 23 bp, Homo sapiens
  chr12:64797450-64797473
  hypo
aaataaattttggaccggacacc

SEQ ID NO: 15669 - DNA, 170 bp, Homo sapiens
  chr12:65516360-65516530
  hypo
ttttttaaaagttgccgaattcacaggtgcgtgggggcaaaaccaaggctctggcctcgtctgtgagaagcatgcttggccggcagtgggctgcagcataacctatccacctggcccagcagaaagaactgatttttgcctcctgcctaattcctcggatgcacaaagaa

SEQ ID NO: 15670 - DNA, 19 bp, Homo sapiens
  chr12:65562067-65562086
  hypo
ctaacgtttttctgtacag

SEQ ID NO: 15671 - DNA, 38 bp, Homo sapiens
  chr12:66208320-66208358
  hypo
aatagacagataggccgggcgccgtggctcacgcctgt

SEQ ID NO: 15672 - DNA, 29 bp, Homo sapiens
  chr12:68978592-68978621
  hypo
aaaagctttttttccgttttcactagaaa

SEQ ID NO: 15673 - DNA, 17 bp, Homo sapiens
  chr12:69754451-69754468
  hypo
tttttttttttgagacg

SEQ ID NO: 15674 - DNA, 114 bp, Homo sapiens
  chr12:69964176-69964290
  hypo
ctgattttatacacccgcaaacgtgactcagtaaaatggcactacctctgcctgcgacgctatggctatgactcgaatctcttttcttttgaaagtggtcgaaggtgtcaaact

SEQ ID NO: 15675 - DNA, 181 bp, Homo sapiens
  chr12:70087493-70087674
  hypo
cacagcagtgctcaccgagcgaaagatgagcagggaggtgagattgacgtagcgcatcagcgtccttctaagcaggcgcccgtgctcgtcgcttccgtgaacactgctagagatgaggaacattagcctgtctggccagggcaaattcacaaactggttccaccatcggttcactaccaga

SEQ ID NO: 15676 - DNA, 25 bp, Homo sapiens
  chr12:74930406-74930431
  hypo
catgtaaggcactgtcgcaagattt

SEQ ID NO: 15677 - DNA, 30 bp, Homo sapiens
  chr12:77150018-77150048
  hypo
gggagggtgcaaagacgtgcataccaggag

SEQ ID NO: 15678 - DNA, 30 bp, Homo sapiens
  chr12:94641622-94641652
  hypo
atcacagctgggattcgttaacaaagttac

SEQ ID NO: 15679 - DNA, 81 bp, Homo sapiens
  chr12:95465839-95465920
  hypo
gatagaaatacacatcgctttttcagatatactaactggacttaaagcaaagtttaaaaacaatcatcggccgggcgcggt

SEQ ID NO: 15680 - DNA, 23 bp, Homo sapiens
  chr12:96881015-96881038
  hypo
gtgagccacgacacccagccaat

SEQ ID NO: 15681 - DNA, 42 bp, Homo sapiens
  chr12:98948376-98948418
  hypo
aacaaggcaactttagtgaagctattgcgtaccagtttatga

SEQ ID NO: 15682 - DNA, 30 bp, Homo sapiens
  chr12:104690709-104690739
  hypo
cacctgtgttgacatcgggctaggcactat

SEQ ID NO: 15683 - DNA, 66 bp, Homo sapiens
  chr12:110717680-110717746
  hypo
tggcttctctcagtgcgttgccatatagtataattttttgtttgtttgtttcgtgtagggttttgt

SEQ ID NO: 15684 - DNA, 30 bp, Homo sapiens
  chr12:110782730-110782760
  hypo
gttcattgctgctgacggtggtccaagagt

SEQ ID NO: 15685 - DNA, 41 bp, Homo sapiens
  chr12:110908130-110908171
  hypo
ctgacctcgtgatccgcccgcatggccgtcctttttgtctc

SEQ ID NO: 15686 - DNA, 30 bp, Homo sapiens
  chr12:111296630-111296660
  hypo
gttggggtgcatattcgtgatgccttaggc

SEQ ID NO: 15687 - DNA, 30 bp, Homo sapiens
  chr12:111369069-111369099
  hypo
caggatcccagagctcggatccagcctcaa

SEQ ID NO: 15688 - DNA, 30 bp, Homo sapiens
  chr12:112628549-112628579
  hypo
ccccaccctagattccgatccccagggaag

SEQ ID NO: 15689 - DNA, 16 bp, Homo sapiens
  chr12:112826001-112826017
  hypo
acgagtccatctcaaa

SEQ ID NO: 15690 - DNA, 30 bp, Homo sapiens
  chr12:112919571-112919601
  hypo
aggcatgagccactgcgccccagctgattc

SEQ ID NO: 15691 - DNA, 30 bp, Homo sapiens
  chr12:114240315-114240345
  hypo
gggaggcgacacgcccgggtgcgctcagtt

SEQ ID NO: 15692 - DNA, 30 bp, Homo sapiens
  chr12:117474645-117474675
  hypo
catctgggctccgtgcgtttgcagccttaa

SEQ ID NO: 15693 - DNA, 108 bp, Homo sapiens
  chr12:117530039-117530147
  hypo
gatgagacatctgagcgaagtggcacaggacggctccagcaccgagctcagtgcacatggaacgccatcctccagggtcccgctctgtggctgcgacagatggtgaga

SEQ ID NO: 15694 - DNA, 39 bp, Homo sapiens
  chr12:117531034-117531073
  hypo
aattggtgaatgagccgaggccaccgtctgaggccactt

SEQ ID NO: 15695 - DNA, 25 bp, Homo sapiens
  chr12:117532499-117532524
  hypo
acaataatgagcattcgtttcataa

SEQ ID NO: 15696 - DNA, 30 bp, Homo sapiens
  chr12:118198752-118198782
  hypo
caaggggcagcccctcgcaggccgggtttc

SEQ ID NO: 15697 - DNA, 85 bp, Homo sapiens
  chr12:118860397-118860482
  hypo
aaagtcaaatagtagcgtgtgtttaacatacatcacaagccttgaactttttttcttttttctttttttttagacagagtcttgc

SEQ ID NO: 15698 - DNA, 30 bp, Homo sapiens
  chr12:120148366-120148396
  hypo
cagttcatgtctagacggtcatcaccttcc

SEQ ID NO: 15699 - DNA, 30 bp, Homo sapiens
  chr12:120574326-120574356
  hypo
tgtctcgagcagagccgccttcacattcca

SEQ ID NO: 15700 - DNA, 46 bp, Homo sapiens
  chr12:122141060-122141106
  hypo
agagaagagtccctccgattcgcaacctgaccgcctggctgacctg

SEQ ID NO: 15701 - DNA, 101 bp, Homo sapiens; identical to SEQ ID NO: 1601
  chr12:122278479-122278580
  hypo

SEQ ID NO: 15702 - DNA, 81 bp, Homo sapiens
  chr12:122285027-122285108
  hypo
gccaccacaatggatcgcagagagctatattccgtgtgcacctgcgtgtcatccacggaccagaagcggtggaactgcagg

SEQ ID NO: 15703 - DNA, 30 bp, Homo sapiens
  chr12:122292767-122292797
  hypo
gcctggtggcctctgcgtggtcctgcaggc

SEQ ID NO: 15704 - DNA, 45 bp, Homo sapiens
  chr12:122439448-122439493
  hypo
gtttggcctgaatcccgagggatggaaatccgagcctgcaacctg

SEQ ID NO: 15705 - DNA, 30 bp, Homo sapiens
  chr12:122458643-122458673
  hypo
ctaggaaaaggcctgcggtctctccatttc

SEQ ID NO: 15706 - DNA, 30 bp, Homo sapiens
  chr12:122602863-122602893
  hypo
ggtaaagcacaataccgcagaaaagggagg

SEQ ID NO: 15707 - DNA, 30 bp, Homo sapiens
  chr12:122622042-122622072
  hypo
cctctccgtgtgcatcggagcagagcccca

SEQ ID NO: 15708 - DNA, 30 bp, Homo sapiens
  chr12:122622344-122622374
  hypo
aagcctgggagccaacgctgagtccacgta

SEQ ID NO: 15709 - DNA, 28 bp, Homo sapiens
  chr12:124117199-124117227
  hypo
aaagctactggtggccgggcgcggtggc

SEQ ID NO: 15710 - DNA, 30 bp, Homo sapiens
  chr12:124404180-124404210
  hypo
gtccctggcagtcaccgctctgccttccat

SEQ ID NO: 15711 - DNA, 173 bp, Homo sapiens
  chr12:124778198-124778371
  hypo
gcagcagacttccagcgttctttcctgggcgacatggaaatgggctgtaaattcacctggtgacaggtgcatgcctgtcaccctgtgggctctcaggaagcggccccaccctctgtcagtgtccggcatgcaccttactcctgctgctgcagggcctgcgccctgctgttccc

SEQ ID NO: 15712 - DNA, 30 bp, Homo sapiens
  chr12:124843833-124843863
  hypo
tgtcatctatcacgccgcctccagatgaac

SEQ ID NO: 15713 - DNA, 46 bp, Homo sapiens
  chr12:124893479-124893525
  hypo
ccagttccaagtcagcggcagcacgttgtcacgtggcactgggcac

SEQ ID NO: 15714 - DNA, 54 bp, Homo sapiens
  chr12:125009346-125009400
  hypo
tgaatgcctgaacctcgtcctcacaaccctcaccacccgcgatagcacttgctt

SEQ ID NO: 15715 - DNA, 41 bp, Homo sapiens
  chr12:125092426-125092467
  hypo
ccgaaagccaagctccgtgtccatcgcgaaggcactgggca

SEQ ID NO: 15716 - DNA, 33 bp, Homo sapiens
  chr12:125102143-125102176
  hypo
ggagccccccaaccccggcgtgcccccattttg

SEQ ID NO: 15717 - DNA, 30 bp, Homo sapiens
  chr12:125119323-125119353
  hypo
ctttgctctgtgtcccgtggttacaaaatg

SEQ ID NO: 15718 - DNA, 59 bp, Homo sapiens
  chr12:125152108-125152167
  hypo
cttgctaaatgcttgcgtagtgaggcccctgcatctccttttgccgagactgggggagg

SEQ ID NO: 15719 - DNA, 30 bp, Homo sapiens
  chr12:125167715-125167745
  hypo
tttatctacctgccacgtcctgagtgtcta

SEQ ID NO: 15720 - DNA, 27 bp, Homo sapiens
  chr12:126243097-126243124
  hypo
catgagccaccgcgcccggctgatgat

SEQ ID NO: 15721 - DNA, 35 bp, Homo sapiens
  chr12:128311016-128311051
  hypo
ctgcagaccttcgcagtgaacgttacagctcttaa

SEQ ID NO: 15722 - DNA, 122 bp, Homo sapiens
  chr12:128899719-128899841
  hypo
gaaaccagagaggtgcggggcagctgccggctgaagggggacctggggctgtgtgtggctgagctggagctcctgtccagctggttcagtgccccgacggtgggtgccgggaggaagaagtc

SEQ ID NO: 15723 - DNA, 301 bp, Homo sapiens; identical to SEQ ID NO: 5141
  chr12:130821371-130821672
  hypo

SEQ ID NO: 15724 - DNA, 30 bp, Homo sapiens
  chr12:130920621-130920651
  hypo
caggagagatgagagcgggttctgggtggg

SEQ ID NO: 15725 - DNA, 36 bp, Homo sapiens
  chr12:131268446-131268482
  hypo
gatgagggacatcaacgcctacgtaccagagacagg

SEQ ID NO: 15726 - DNA, 30 bp, Homo sapiens
  chr12:131433415-131433445
  hypo
ggctcgagtacctcacgtttctgggtgctt

SEQ ID NO: 15727 - DNA, 27 bp, Homo sapiens
  chr12:131547329-131547356
  hypo
atacaagggtcacgtggtaaatatatt

SEQ ID NO: 15728 - DNA, 177 bp, Homo sapiens
  chr12:132044061-132044238
  hypo
tctatgaaccagcagcgctgaggtcactggtgctgaggccatgggactcgtggaggtgttctgtccatgggagagaagccctgagcatctgggagccatgaggaggaatctccagagacaaacgggagaattaaccagaggccccgccccattatcataactcggctccactcacat

SEQ ID NO: 15729 - DNA, 30 bp, Homo sapiens
  chr12:132168275-132168305
  hypo
tggggccgtgcctggcgctaggaggtgagc

SEQ ID NO: 15730 - DNA, 522 bp, Homo sapiens; identical to SEQ ID NO: 1602
  chr12:132221602-132222124
  hypo

SEQ ID NO: 15731 - DNA, 30 bp, Homo sapiens
  chr12:132240239-132240269
  hypo
attgtttgtccagcacgttctaaacaaaca

SEQ ID NO: 15732 - DNA, 133 bp, Homo sapiens
  chr12:132280877-132281010
  hypo
agaccaggtggaagccgaagggtcggcctctccaggcaggagagaaggatgatctaagggcaggtgcaggccagaatgtctggaaagcatttctggtgcgggattgccagtttggtgacgtggactctgggaa

SEQ ID NO: 15733 - DNA, 30 bp, Homo sapiens
  chr12:132284463-132284493
  hypo
gcctcctgcggtcaccgcacaccccttctt

SEQ ID NO: 15734 - DNA, 118 bp, Homo sapiens
  chr12:132329877-132329995
  hypo
tggtgtccctgcagccggcacagatgcaccgcttctggcggggcctgccgctgcacctggacagcgtggacgccgtgtacgagcgcaccagcgaccacaagatcgtcttctttaaagg

SEQ ID NO: 15735 - DNA, 30 bp, Homo sapiens
  chr12:132333412-132333442
  hypo
gcgtgagtgtgcaaacgtctctccaagacc

SEQ ID NO: 15736 - DNA, 52 bp, Homo sapiens
  chr12:132377978-132378030
  hypo
gcactaacttttccccggtcctctctcccagagcaatcgctgttggctgtgt

SEQ ID NO: 15737 - DNA, 158 bp, Homo sapiens; identical to SEQ ID NO: 5143
  chr12:132423555-132423713
  hypo

SEQ ID NO: 15738 - DNA, 130 bp, Homo sapiens
  chr12:132617233-132617363
  hypo
tgggatgtgccaaaccgctgcgtggagcctgggctgacttctctggatcttggtgcaactggcgtggcccttccaggaagccgggccacctggctcagagacgccagaccctggccggcaatggggctgc

SEQ ID NO: 15739 - DNA, 67 bp, Homo sapiens
  chr12:132643941-132644008
  hypo
ttcgctgtggccccccggggtctgtcccctgcagcactgttctctgggggctcgtggtccgagttct

SEQ ID NO: 15740 - DNA, 48 bp, Homo sapiens
  chr12:132682618-132682666
  hypo
tggagcctcccaccccggggacgctgttgcgggcgggagaggaccgcc

SEQ ID NO: 15741 - DNA, 30 bp, Homo sapiens
  chr12:132688204-132688234
  hypo
gcacctccatgctgccgccacactgccaca

SEQ ID NO: 15742 - DNA, 174 bp, Homo sapiens
  chr12:132986465-132986639
  hypo
ccgtcctgtgggtgacggcagaacatctggctgccgggtggcctccgtaaccgccacacacctgcctctgctggaatcacctgaggctctggtgcctcacacggattggccaaaacagggagcggagccgggaaggccacggacatctgtgtggtgtcacgaacaaggtccggc

SEQ ID NO: 15743 - DNA, 101 bp, Homo sapiens
  chr12:133002917-133003018
  hypo
cactggcatgtctgccgacgtgcgattttccagcctttccctagagctgcggtttcgtcaggttcatggtccaacttccaagttgccgagtccagtctgac

SEQ ID NO: 15744 - DNA, 30 bp, Homo sapiens
  chr12:133100990-133101020
  hypo
aattcgcactggcaccgtctgccttgtgtg

SEQ ID NO: 15745 - DNA, 30 bp, Homo sapiens
  chr12:133122176-133122206
  hypo
cagacctgaaacccacggggagatccgtaa

SEQ ID NO: 15746 - DNA, 30 bp, Homo sapiens
  chr12:133169847-133169877
  hypo
gggcctgcatagaaacggaagctcacagtc

SEQ ID NO: 15747 - DNA, 102 bp, Homo sapiens
  chr12:133188357-133188459
  hypo
ctgtgctcagctgggcggttctcacacgtgttgcttaggcatcagctttcaggtagtttgactgtgctcagctgggcggttctcacacgtgttgcttaggca

SEQ ID NO: 15748 - DNA, 30 bp, Homo sapiens
  chr12:133200007-133200037
  hypo
gctgactggcgcccacggctgcaccgggcg

SEQ ID NO: 15749 - DNA, 30 bp, Homo sapiens
  chr12:133705743-133705773
  hypo
atctaaaacagaatacgaactaaaaaacct

SEQ ID NO: 15750 - DNA, 82 bp, Homo sapiens
  chr13:19517769-19517851
  hypo
accccctgggccccacgcaggggctgcagggaaggcactggcctctgagggatgatcccagcctcctcggcctcaccgcttt

SEQ ID NO: 15751 - DNA, 81 bp, Homo sapiens
  chr13:20078191-20078272
  hypo
tatttatgtctcacagttcactgatagctccactccagggtactgatttgaatttagacttggcagcgctacagaatttaa

SEQ ID NO: 15752 - DNA, 15 bp, Homo sapiens
  chr13:20692250-20692265
  hypo
cgtgagccactgcgc

SEQ ID NO: 15753 - DNA, 71 bp, Homo sapiens
  chr13:25670585-25670656
  hypo
atcatgtggtctcagcgtgatccatcacttcgaaaaagtggagtgggcaacatattcgttaaaaatctgga

SEQ ID NO: 15754 - DNA, 33 bp, Homo sapiens
  chr13:28240066-28240099
  hypo
gaaaagcggtccaaccggcggtgaggctggaac

SEQ ID NO: 15755 - DNA, 23 bp, Homo sapiens
  chr13:30149065-30149088
  hypo
ccaccgtgcgtggccagagcagc

SEQ ID NO: 15756 - DNA, 94 bp, Homo sapiens
  chr13:30707267-30707361
  hypo
gctgggagaaggtcccggggatcactcctcctaggccgccggggcagtctctccagccaccctctttccccagagccagcgggctggggttctt

SEQ ID NO: 15757 - DNA, 30 bp, Homo sapiens
  chr13:30761001-30761031
  hypo
attaacaagccagagcgggggcaccagagt

SEQ ID NO: 15758 - DNA, 33 bp, Homo sapiens
  chr13:31742917-31742950
  hypo
cccaggcagataacccgccggctggtgcctccc

SEQ ID NO: 15759 - DNA, 233 bp, Homo sapiens
  chr13:37643739-37643972
  hypo
acccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctatgaggccaggccaagtcgcccagcccagagg

SEQ ID NO: 15760 - DNA, 53 bp, Homo sapiens
  chr13:41681520-41681573
  hypo
gggcagggctgcagccgcccaaaatgcagcaatggatccgagcctccctgtac

SEQ ID NO: 15761 - DNA, 30 bp, Homo sapiens
  chr13:45564773-45564803
  hypo
tttgtagactagcaccgacacccagttgga

SEQ ID NO: 15762 - DNA, 22 bp, Homo sapiens
  chr13:45905242-45905264
  hypo
cttttgtcgatttgtcttttgt

SEQ ID NO: 15763 - DNA, 30 bp, Homo sapiens
  chr13:46659310-46659340
  hypo
ctttgatatttataacgctttgatatagac

SEQ ID NO: 15764 - DNA, 30 bp, Homo sapiens
  chr13:46661314-46661344
  hypo
ggagcatgaggctgccgccctgccatcaca

SEQ ID NO: 15765 - DNA, 172 bp, Homo sapiens
  chr13:46920144-46920316
  hypo
ctgttggctcagctgcgaaaattctcactcactcggcaagcctatgacttccaaatgcacgagtcaggcactgagcttaaggctcatgcagccaactgccagtggtcatggtccctagggcattcaaaacttcatcttctccaaacccggcaggtgtcgacctgaattctct

SEQ ID NO: 15766 - DNA, 30 bp, Homo sapiens
  chr13:48667877-48667907
  hypo
ctgtctaggtgttttcgggttttcttccat

SEQ ID NO: 15767 - DNA, 35 bp, Homo sapiens
  chr13:49923030-49923065
  hypo
cctccagggagaccacgccccgtccctcaccctcc

SEQ ID NO: 15768 - DNA, 24 bp, Homo sapiens
  chr13:50367862-50367886
  hypo
gggtgtggtggctcacgcctgtaa

SEQ ID NO: 15769 - DNA, 20 bp, Homo sapiens
  chr13:96031715-96031735
  hypo
atgaccggccgggcacggtg

SEQ ID NO: 15770 - DNA, 81 bp, Homo sapiens
  chr13:100356871-100356952
  hypo
tatgagccaggtgctcgactgtgtacaaacttagaagaaccaggtgcacacgccaggtttgggggccgtttgacagtcagc

SEQ ID NO: 15771 - DNA, 23 bp, Homo sapiens
  chr13:103569159-103569182
  hypo
accgcgcccggccgtcccccgtt

SEQ ID NO: 15772 - DNA, 462 bp, Homo sapiens; identical to SEQ ID NO: 5145
  chr13:110434424-110434886
  hypo

SEQ ID NO: 15773 - DNA, 251 bp, Homo sapiens
  chr13:110435933-110436184
  hypo
actggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactg

SEQ ID NO: 15774 - DNA, 34 bp, Homo sapiens
  chr13:110436410-110436444
  hypo
ccgcgagggccgcgccgggcgtcatgggcatgta

SEQ ID NO: 15775 - DNA, 40 bp, Homo sapiens
  chr13:111277585-111277625
  hypo
ttaaggcctacagcccggagctgatcgtccacccagttct

SEQ ID NO: 15776 - DNA, 35 bp, Homo sapiens; identical to SEQ ID NO: 5146
  chr13:111278361-111278396
  hypo

SEQ ID NO: 15777 - DNA, 56 bp, Homo sapiens
  chr13:111289222-111289278
  hypo
tgctgtgctacacagcggggtctggggcagcctcaccactgcgtgtcttggtttcc

SEQ ID NO: 15778 - DNA, 30 bp, Homo sapiens
  chr13:111978886-111978916
  hypo
ggagactgcgggcaacgcgagcctggtgct

SEQ ID NO: 15779 - DNA, 45 bp, Homo sapiens
  chr13:113107030-113107075
  hypo
actcctggcagcagacggaagggcggctgccgggccctcagaccc

SEQ ID NO: 15780 - DNA, 30 bp, Homo sapiens
  chr13:113400400-113400430
  hypo
tgatggactcttgggcgtctgccgtaggcc

SEQ ID NO: 15781 - DNA, 101 bp, Homo sapiens
  chr13:113598563-113598664
  hypo
atgaagggagggtcccgggtgaagagcaagctcatgaccctcatttactgggaatccattgctctggccccgtcatgagtggggttcgcagactgggccaa

SEQ ID NO: 15782 - DNA, 30 bp, Homo sapiens
  chr13:113776004-113776034
  hypo
gaggaccaggctgtgcgtggtgcccgccgt

SEQ ID NO: 15783 - DNA, 30 bp, Homo sapiens
  chr13:113985679-113985709
  hypo
gagtgaccacagctgcggggctgggatacc

SEQ ID NO: 15784 - DNA, 55 bp, Homo sapiens
  chr13:114055958-114056013
  hypo
gggagctgtggggaccggccccccagagctcagcacagcccggccctccttccag

SEQ ID NO: 15785 - DNA, 141 bp, Homo sapiens
  chr13:114060112-114060253
  hypo
ctctggggtggctttcggacaaggctctgcttccccactggcccagcgtctctggctctcccgctgtgcggtctccagggctctgggtgctgcctggcgctggtgcaggcgtggcgcggctcgcaacgctccctgcagctg

SEQ ID NO: 15786 - DNA, 575 bp, Homo sapiens
  chr13:114074574-114075149
  hypo
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggagagggaagcccactttccggtaagcgggcaaaacaggtactacgaccgtgttacttatgctagcaacagttccgacttaccttaattgggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccct

SEQ ID NO: 15787 - DNA, 43 bp, Homo sapiens
  chr13:114122929-114122972
  hypo
tctccttcagacaagcggcctatgaggacgcagcactaaaggg

SEQ ID NO: 15788 - DNA, 86 bp, Homo sapiens
  chr13:114188403-114188489
  hypo
ttcttttttcactagcggcggtttttcttttatgtcttgttataaagaagtatctcattggaccctattatcggaagctgcacatg

SEQ ID NO: 15789 - DNA, 37 bp, Homo sapiens
  chr13:114221622-114221659
  hypo
taaaccaccagtttccgacttctgtactaaaacatgt

SEQ ID NO: 15790 - DNA, 30 bp, Homo sapiens
  chr13:114271940-114271970
  hypo
gctcacctgcagagccgctcacctgcagag

SEQ ID NO: 15791 - DNA, 159 bp, Homo sapiens; identical to SEQ ID NO: 5147
  chr13:114304752-114304911
  hypo

SEQ ID NO: 15792 - DNA, 230 bp, Homo sapiens
  chr13:114497859-114498089
  hypo
cgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagttctgtgaaagaagccccgacctcgagctgggactttgaattggtttgcgtttgaaaaccggggttggtaaaag

SEQ ID NO: 15793 - DNA, 106 bp, Homo sapiens
  chr13:114526504-114526610
  hypo
acgtccagaggggtccgcactgcaatgaaagcggtgcattatagggtggtatgcacggtggagaggccacagtgaggtcggagcagggcctcgagagatgcagtcc

SEQ ID NO: 15794 - DNA, 30 bp, Homo sapiens
  chr13:114746822-114746852
  hypo
ccactgtcagagcagcgctgcccatcacca

SEQ ID NO: 15795 - DNA, 265 bp, Homo sapiens; identical to SEQ ID NO: 5148
  chr13:114748399-114748664
  hypo

SEQ ID NO: 15796 - DNA, 30 bp, Homo sapiens
  chr13:114749034-114749064
  hypo
gcaagtacatgtgcacgtgtgctctccctg

SEQ ID NO: 15797 - DNA, 44 bp, Homo sapiens
  chr13:114760951-114760995
  hypo
tggccacaacaacagcgaggtgcatctcacggagcataaccagg

SEQ ID NO: 15798 - DNA, 38 bp, Homo sapiens
  chr13:114765164-114765202
  hypo
agtgggtgcgggccccgctgtcccggctggggtccggg

SEQ ID NO: 15799 - DNA, 184 bp, Homo sapiens
  chr13:114769986-114770170
  hypo
tgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatgg

SEQ ID NO: 15800 - DNA, 30 bp, Homo sapiens
  chr13:114771035-114771065
  hypo
tgagcaaagagccctcgggagcctggaggg

SEQ ID NO: 15801 - DNA, 528 bp, Homo sapiens; identical to SEQ ID NO: 1603
  chr13:114780555-114781083
  hypo

SEQ ID NO: 15802 - DNA, 146 bp, Homo sapiens
  chr13:114807701-114807847
  hypo
ccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctaggg

SEQ ID NO: 15803 - DNA, 18 bp, Homo sapiens
  chr13:114812180-114812198
  hypo
gtccgagccctgccttca

SEQ ID NO: 15804 - DNA, 186 bp, Homo sapiens
  chr13:114855483-114855669
  hypo
atgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaa

SEQ ID NO: 15805 - DNA, 80 bp, Homo sapiens
  chr13:114961773-114961853
  hypo
gaatccctggtgccacgaaagaccccagagcagcacaatctgagctcactctgtttccaatactgcgcccaggtaacgct

SEQ ID NO: 15806 - DNA, 18 bp, Homo sapiens
  chr14:21289138-21289156
  hypo
agcactttgagaggccga

SEQ ID NO: 15807 - DNA, 121 bp, Homo sapiens
  chr14:23707517-23707638
  hypo
gaacaaataggacaacgaagctcgtggcactgtgggatgcgtttgcgttgagctgtttattcagtacattttttatcgtaaatcttacgaagtttgtatccctcagcggttacacacacac

SEQ ID NO: 15808 - DNA, 198 bp, Homo sapiens; identical to SEQ ID NO: 5150
  chr14:23776958-23777156
  hypo

SEQ ID NO: 15809 - DNA, 153 bp, Homo sapiens
  chr14:24862082-24862235
  hypo
aaagtctcccctttgcgggggcaagcagggtagtatcaggttacctgtcctctaacctggactccagtgatctaaaacaatcggaaggacactcctgacagtagtagtctctgttgttgttctccttctcctcctcctcttctctctctctct

SEQ ID NO: 15810 - DNA, 37 bp, Homo sapiens; identical to SEQ ID NO: 5151
  chr14:31027390-31027427
  hypo

SEQ ID NO: 15811 - DNA, 38 bp, Homo sapiens
  chr14:32597741-32597779
  hypo
gtgctgaggctggcccgcctctgcgtgggcaggatctt

SEQ ID NO: 15812 - DNA, 45 bp, Homo sapiens
  chr14:34921211-34921256
  hypo
tagcgtggtggctcacgcctgtaatcccatgccagcactttggga

SEQ ID NO: 15813 - DNA, 136 bp, Homo sapiens
  chr14:35023186-35023322
  hypo
agaagaattcgtccattcaacaaccgttcactgagcgcatagcctgtgcccagacactgttccaggcctctgggagcaaaaaggcctcggtgcccgtattctagttagacaacgagaagcgcggggaggtgggggg

SEQ ID NO: 15814 - DNA, 35 bp, Homo sapiens
  chr14:35507705-35507740
  hypo
ttacgaatagagcgccgcccgggaggcagcggctg

SEQ ID NO: 15815 - DNA, 30 bp, Homo sapiens
  chr14:35866882-35866912
  hypo
gctttcatctcatcacgcctttccatgcag

SEQ ID NO: 15816 - DNA, 30 bp, Homo sapiens
  chr14:50098049-50098079
  hypo
cagaagatttgcagccgggcgcggtggctc

SEQ ID NO: 15817 - DNA, 120 bp, Homo sapiens
  chr14:50333967-50334087
  hypo
cgtgagccaccgcgcccggccagccgtttgcttttttaacagtgcaaaaaacaaggccgtgtctggctatatggggctttgcttgttcaaaatgtaacctctatacggccgcgcgcagtg

SEQ ID NO: 15818 - DNA, 28 bp, Homo sapiens
  chr14:50334327-50334355
  hypo
ctgggcaagactccgtctcaaaaaaaaa

SEQ ID NO: 15819 - DNA, 37 bp, Homo sapiens
  chr14:50433979-50434016
  hypo
tacaggtgtaagccaccacacccggcccattcaggtc

SEQ ID NO: 15820 - DNA, 36 bp, Homo sapiens
  chr14:50681821-50681857
  hypo
gggattacaggcgtgagccaccgcgcccggcaaggt

SEQ ID NO: 15821 - DNA, 15 bp, Homo sapiens
  chr14:54956536-54956551
  hypo
cgctgggatcacagg

SEQ ID NO: 15822 - DNA, 30 bp, Homo sapiens
  chr14:55664068-55664098
  hypo
agtgctgtatgccagcgtattttgtttctt

SEQ ID NO: 15823 - DNA, 234 bp, Homo sapiens
  chr14:55765372-55765606
  hypo
tggagggggtaaggccggcaagggcggcctgaccctccaggaggccatccagcggctgcgggacacggaggagatgttaagcaagaaacaggagttcctggagaagaaaatcgagcagaggcacggcaccaaaaacaagcccgcggccctccaggcactgaagcgtaagaagaggtatgagaagcagctggcgcagatcgacggtacattatcaaccatcgagttccagcagca

SEQ ID NO: 15824 - DNA, 30 bp, Homo sapiens
  chr14:57045757-57045787
  hypo
gattctttttttttgcgttacagctcattg

SEQ ID NO: 15825 - DNA, 23 bp, Homo sapiens
  chr14:58599589-58599612
  hypo
actgcgcccggccaacccttgtc

SEQ ID NO: 15826 - DNA, 24 bp, Homo sapiens
  chr14:58893204-58893228
  hypo
gagccaccgcgctcagactttaaa

SEQ ID NO: 15827 - DNA, 30 bp, Homo sapiens
  chr14:65233318-65233348
  hypo
ggggaggatggagggcggggctgcgccagc

SEQ ID NO: 15828 - DNA, 96 bp, Homo sapiens
  chr14:65239506-65239602
  hypo
ggtctgcccacatctcgttcagcccgtccttccactcggcgatggtggccgcctcgctgtggcccgcgtcgatgagtcgctcgatgaaggcattca

SEQ ID NO: 15829 - DNA, 64 bp, Homo sapiens
  chr14:65406323-65406387
  hypo
caggccacatctgagcggcgcacagggctccaaatgatgagcttgggatcggtcatgagggaaa

SEQ ID NO: 15830 - DNA, 83 bp, Homo sapiens; identical to SEQ ID NO: 5152
  chr14:67886562-67886645
  hypo

SEQ ID NO: 15831 - DNA, 91 bp, Homo sapiens
  chr14:68067690-68067781
  hypo
actcttttcctgtgccgggtagtttgaggtgcttgaggatgcagcagtgaacgatgttgatgacagtctctgccctcgggcagcttccttt

SEQ ID NO: 15832 - DNA, 21 bp, Homo sapiens
  chr14:69866541-69866562
  hypo
aaatggagggctgggcgcggt

SEQ ID NO: 15833 - DNA, 30 bp, Homo sapiens
  chr14:72892242-72892272
  hypo
aaatagaataaataccgatggccaataaat

SEQ ID NO: 15834 - DNA, 74 bp, Homo sapiens
  chr14:73140612-73140686
  hypo
cactacaagaaagcacgttgccttctctccaggtttttccactctacctcgctgtggtccgtaaaaacacgcac

SEQ ID NO: 15835 - DNA, 50 bp, Homo sapiens
  chr14:73147450-73147500
  hypo
gcaggtggctaacaacgaaagccatggccagagggcgggcttctctggag

SEQ ID NO: 15836 - DNA, 149 bp, Homo sapiens; identical to SEQ ID NO: 5153
  chr14:73167750-73167899
  hypo

SEQ ID NO: 15837 - DNA, 30 bp, Homo sapiens
  chr14:73172944-73172974
  hypo
tcaattccatccatgcgccctaagggcctt

SEQ ID NO: 15838 - DNA, 30 bp, Homo sapiens
  chr14:73178859-73178889
  hypo
ttccagaaagcctgccgtcaggcctcccag

SEQ ID NO: 15839 - DNA, 69 bp, Homo sapiens
  chr14:73180190-73180259
  hypo
acccagagggagacccgtgccagggtccagcctcgactgtttcactgccatcctcgctgcagcctcttc

SEQ ID NO: 15840 - DNA, 166 bp, Homo sapiens
  chr14:73195193-73195359
  hypo
ggaatggagaggacacgcccaggaaggtcacgctcatccttttcgatttatttagtgggaaacaacagttttttagcagagttttgctctagaacaaaaggacagctagcaaagtaggacatgtcagagacgggaagaactggggacagggcgattcctggaatct

SEQ ID NO: 15841 - DNA, 34 bp, Homo sapiens
  chr14:73195668-73195702
  hypo
aggaaggccaggcaccgtggctcatgcctgtaat

SEQ ID NO: 15842 - DNA, 174 bp, Homo sapiens
  chr14:73209874-73210048
  hypo
atcaccctcggaattcggcaagggtggcaaagagccaccctgctccccaagagtcctggagcagaagggatcgacaaggcctcaggtgcattccaggtacaggaggagcgtcaactgtaaagcccttttcatctgcgggtccaggataagtgagtgtgtcgggccttcaagcaa

SEQ ID NO: 15843 - DNA, 23 bp, Homo sapiens
  chr14:73226884-73226907
  hypo
aaatacaatgatggccgggcgcg

SEQ ID NO: 15844 - DNA, 30 bp, Homo sapiens
  chr14:73275087-73275117
  hypo
acaagcaggacatttcgaactcaaatagta

SEQ ID NO: 15845 - DNA, 32 bp, Homo sapiens
  chr14:73313912-73313944
  hypo
cactctggaccagaccgcgtcctaagagcttc

SEQ ID NO: 15846 - DNA, 176 bp, Homo sapiens
  chr14:73318453-73318629
  hypo
tacaaaatgtccactcgaggatctgttcctccccgtgtgggtaatcgccctcctaccacgggcaacgggtaggcaaccgatatgcccagaaaggcggccaatgggaggacagctcgcccagcctcccgattggccaggcccgccaccagctggaaccatggcgagctttgaggaca

SEQ ID NO: 15847 - DNA, 44 bp, Homo sapiens
  chr14:73333249-73333293
  hypo
ttggagttttctcatcgataaaaaagttaatatggctgggtgtg

SEQ ID NO: 15848 - DNA, 30 bp, Homo sapiens
  chr14:73958845-73958875
  hypo
caacttcagtcaggacgacctcggtgagcc

SEQ ID NO: 15849 - DNA, 30 bp, Homo sapiens
  chr14:73959199-73959229
  hypo
tgttgatgctgtggccgaccagcgagccaa

SEQ ID NO: 15850 - DNA, 30 bp, Homo sapiens
  chr14:75389373-75389403
  hypo
caaagggatgacagccgtggctgcgggaag

SEQ ID NO: 15851 - DNA, 30 bp, Homo sapiens
  chr14:78247790-78247820
  hypo
aaaaataattaggtgcggccgggtgcggtg

SEQ ID NO: 15852 - DNA, 30 bp, Homo sapiens
  chr14:90983280-90983310
  hypo
cactctccagggccacgggatggcagcctg

SEQ ID NO: 15853 - DNA, 30 bp, Homo sapiens
  chr14:91849705-91849735
  hypo
cccaagaaagactgtcgttgtttccaccaa

SEQ ID NO: 15854 - DNA, 273 bp, Homo sapiens; identical to SEQ ID NO: 5154
  chr14:93154937-93155210
  hypo

SEQ ID NO: 15855 - DNA, 37 bp, Homo sapiens
  chr14:93697020-93697057
  hypo
aggactcaggcacaccgagccacgggaggctggggac

SEQ ID NO: 15856 - DNA, 18 bp, Homo sapiens
  chr14:96967299-96967317
  hypo
gcccggcttacattttct

SEQ ID NO: 15857 - DNA, 30 bp, Homo sapiens
  chr14:97188235-97188265
  hypo
ttcacaaggagagcacggaagtagatacag

SEQ ID NO: 15858 - DNA, 18 bp, Homo sapiens
  chr14:97262855-97262873
  hypo
taaacacaatgcggccgg

SEQ ID NO: 15859 - DNA, 144 bp, Homo sapiens
  chr14:99849909-99850053
  hypo
tgggtggagcacaggcgggaagccctgccccgtctctttgtgagctgtgggtgcgcttggcgagtcacaagcctctctgggcccagttctttctatggaagtcatgggttgcagtgttgttgagggagccggtggtgcacgtgg

SEQ ID NO: 15860 - DNA, 30 bp, Homo sapiens
  chr14:100611919-100611949
  hypo
cctggaggctgaggccgccttccccaaggc

SEQ ID NO: 15861 - DNA, 131 bp, Homo sapiens
  chr14:100643350-100643481
  hypo
gaaatgcctccagggcgtggtgggaggggccggaacagggagatggcgcgtgagtagcatctgttcttacagcaaaacctgtaaaagtaaaatatacgtaggtttgtcactaaagacgtgtctgcataaat

SEQ ID NO: 15862 - DNA, 79 bp, Homo sapiens
  chr14:100644399-100644478
  hypo
agcccagcccagtgccgcgcctgtcctcgaacctggcccaacgctcgccgggagcagggacctgcgtgcagctatggaa

SEQ ID NO: 15863 - DNA, 30 bp, Homo sapiens
  chr14:101200688-101200718
  hypo
agacctgcagccgcccggtgaccaactgcg

SEQ ID NO: 15864 - DNA, 185 bp, Homo sapiens
  chr14:101250109-101250294
  hypo
tagggtccattgacccggaggtcgaggcttccagagcgggccagccggcagccccaacgtgtgaggctgtgcacctgctggggagggtttttttgatggcgacggcgtgaggtgagcgggtttgctctgggcggtcgaggattagcgccgactgagagggtcaggtgcaccggggctttgttcag

SEQ ID NO: 15865 - DNA, 51 bp, Homo sapiens
  chr14:102335848-102335899
  hypo
ccaaagtggctgccccgtgtgattcccccaacagtgcgtgagttctcatgc

SEQ ID NO: 15866 - DNA, 138 bp, Homo sapiens
  chr14:102418540-102418678
  hypo
tcgcatgagccaccacgcccagtgtattcagattttcttcgtgtttcttttctcttccgggatcccatgcaggacaccacgtcgcatttagttgtccaccacggtttttttgtttgtttgtttttttccgagacggag

SEQ ID NO: 15867 - DNA, 30 bp, Homo sapiens
  chr14:102530479-102530509
  hypo
gctccttctccccagcgtggttcctaagag

SEQ ID NO: 15868 - DNA, 101 bp, Homo sapiens
  chr14:103007139-103007240
  hypo
atgtttgtgtgtgtgcgttgggggtgtgtgtgcggtggggggctatgggctgggatgtcccttgaggtgatcagctctctacgttccgcacacacaaacac

SEQ ID NO: 15869 - DNA, 89 bp, Homo sapiens
  chr14:103820833-103820922
  hypo
tagcaatgtaagaaacggctgaatgcatgcacactgtaataaattacttttacaagaatccccattgcaggtgccgcttataggaactt

SEQ ID NO: 15870 - DNA, 30 bp, Homo sapiens
  chr14:103996414-103996444
  hypo
gcacagacccagacccggcatggtgtcctg

SEQ ID NO: 15871 - DNA, 30 bp, Homo sapiens
  chr14:104061854-104061884
  hypo
ctggtggatgtgggccgcacccctccagct

SEQ ID NO: 15872 - DNA, 30 bp, Homo sapiens
  chr14:104202811-104202841
  hypo
ctgttcttaaggtgacgcttagcaatcaca

SEQ ID NO: 15873 - DNA, 22 bp, Homo sapiens
  chr14:104355166-104355188
  hypo
tttttttttccatgacggagtc

SEQ ID NO: 15874 - DNA, 414 bp, Homo sapiens
  chr14:104617714-104618128
  hypo
agctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtg

SEQ ID NO: 15875 - DNA, 184 bp, Homo sapiens
  chr14:104620411-104620595
  hypo
cctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacggggg

SEQ ID NO: 15876 - DNA, 34 bp, Homo sapiens
  chr14:104628653-104628687
  hypo
tggaaccacagaggacgcccggtcccagcctctg

SEQ ID NO: 15877 - DNA, 64 bp, Homo sapiens
  chr14:104630091-104630155
  hypo
cctggggcccaggcccgtgtgcctgagacccctggacctcacccggcatcgccagcatttaccc

SEQ ID NO: 15878 - DNA, 16 bp, Homo sapiens
  chr14:104631077-104631093
  hypo
gcgtgtctgtgtgtgt

SEQ ID NO: 15879 - DNA, 617 bp, Homo sapiens
  chr14:104639155-104639772
  hypo
aagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgagg

SEQ ID NO: 15880 - DNA, 30 bp, Homo sapiens
  chr14:104641364-104641394
  hypo
gggcccgtcggcccccgcacctgcggccct

SEQ ID NO: 15881 - DNA, 74 bp, Homo sapiens
  chr14:104641701-104641775
  hypo
aggtccaggtggcaccgacggagctcaggccagccccgcccgagggggccggaagccctcgccaccagaggctg

SEQ ID NO: 15882 - DNA, 32 bp, Homo sapiens
  chr14:104645126-104645158
  hypo
tggtggggagcctgccgcggatggcagagtga

SEQ ID NO: 15883 - DNA, 88 bp, Homo sapiens
  chr14:104645975-104646063
  hypo
cggccgagtacctggcggccctggagcgagccacggcggccctggagcagtgcgtgaacctgtgcaaggcgcacgtcatgatggtcac

SEQ ID NO: 15884 - DNA, 49 bp, Homo sapiens
  chr14:104647208-104647257
  hypo
gaattaaagatgcatcgatggttcccacggctgccgagttcactgggcg

SEQ ID NO: 15885 - DNA, 38 bp, Homo sapiens
  chr14:104897616-104897654
  hypo
atatctgttcattcatctcactgcggaggcagcaccat

SEQ ID NO: 15886 - DNA, 112 bp, Homo sapiens
  chr14:105196425-105196537
  hypo
gcccaactagggtgacgctgggagaggagagggcttggaggagccacgggtcaaatgcaggaggccacacctgcctgcccaggaggactgcaggagccggatccttaacacc

SEQ ID NO: 15887 - DNA, 62 bp, Homo sapiens
  chr14:105658349-105658411
  hypo
cttcctcctccacctcggctcccgagtgctgcttctcctgggacttccgacatggctccctc

SEQ ID NO: 15888 - DNA, 164 bp, Homo sapiens; identical to SEQ ID NO: 12077
  chr14:105714232-105714396
  hypo

SEQ ID NO: 15889 - DNA, 21 bp, Homo sapiens
  chr15:20499486-20499507
  hypo
gagcgcgctgactcacgcctg

SEQ ID NO: 15890 - DNA, 30 bp, Homo sapiens
  chr15:22515506-22515536
  hypo
gcagcatgggcgtcacgctgcctgccgggc

SEQ ID NO: 15891 - DNA, 255 bp, Homo sapiens
  chr15:29133539-29133794
  hypo
gtttggattgggcggcggtggctgtggtgagggctgttggagtggggagagtgggggttgagcctggcttcagagaccccctcgaggcctcagctcctctccggcgctcctggctgtcctctgccacgcatacctgccccggtgactcaacaggtgtgggcctcaggtgacaccatggtccgaagtcgtggagaaacctttactgtccaggggaggagaggactggcggtcggtggggatcgagacccagcacac

SEQ ID NO: 15892 - DNA, 30 bp, Homo sapiens
  chr15:29449033-29449063
  hypo
cctcagcaggccaggcgcagtggctcatgc

SEQ ID NO: 15893 - DNA, 43 bp, Homo sapiens
  chr15:33632093-33632136
  hypo
aaaaaaaaaaaattgccattaccttagtcgtggaacaccaaag

SEQ ID NO: 15894 - DNA, 30 bp, Homo sapiens
  chr15:40228636-40228666
  hypo
ggagtttctctctgtcgcccgggctggagt

SEQ ID NO: 15895 - DNA, 300 bp, Homo sapiens
  chr15:41165245-41165545
  hypo
ccatagctgctcaaacgaagcagaagaacttcttccagcggcagcgggagagggtgcgcacacctttggcattcagtttcttctccagccgggctttgtgctcaatggcactgagaatagccgagtcaaatacttccttcaagttcttctgcgtcaaggctgagcactcaaggtagcagcaggctcggatcttctcggccagaccctgagcctggggttggggcacggggccctcccggcccccctggtccagctgaattagtacgttgacatcgtccctcaggtcggcctgggtgccca

SEQ ID NO: 15896 - DNA, 40 bp, Homo sapiens
  chr15:42684673-42684713
  hypo
gggccactgaaggtccgttcgtggtcgtgaggcacacttt

SEQ ID NO: 15897 - DNA, 30 bp, Homo sapiens
  chr15:43020330-43020360
  hypo
agcctcagactactccgtgcacctccccac

SEQ ID NO: 15898 - DNA, 30 bp, Homo sapiens
  chr15:44037474-44037504
  hypo
atgtacccacatctacgaactaggagcagt

SEQ ID NO: 15899 - DNA, 20 bp, Homo sapiens
  chr15:52967815-52967835
  hypo
tagtgttaggccgggcgcgg

SEQ ID NO: 15900 - DNA, 145 bp, Homo sapiens
  chr15:53976280-53976425
  hypo
gcatatctttgtatacgttaatatataaaagaaagaaaacattgcaggtataatagacgaacctttaacaatgattttctgcaaatgttgagattctactgtttttaagaattgccggaggagccaagatggctgaataggaaca

SEQ ID NO: 15901 - DNA, 90 bp, Homo sapiens
  chr15:55699080-55699170
  hypo
ttttgactgaaattccgccctcagcgtaaaaggttaaaaattatgaattaacgcccgcgcggtgggtcacgcctgtaatcccagcactct

SEQ ID NO: 15902 - DNA, 49 bp, Homo sapiens; identical to SEQ ID NO: 5155
  chr15:59158488-59158537
  hypo

SEQ ID NO: 15903 - DNA, 40 bp, Homo sapiens
  chr15:62367703-62367743
  hypo
ccaatacagataggccgggcacggtgcctcacgtcggtaa

SEQ ID NO: 15904 - DNA, 45 bp, Homo sapiens
  chr15:65043594-65043639
  hypo
ggcagcatgtgaattcgcagaaccaggacacgggctggacctgcc

SEQ ID NO: 15905 - DNA, 30 bp, Homo sapiens
  chr15:65622974-65623004
  hypo
gcttgaagccgccctcgtgctgggccagcc

SEQ ID NO: 15906 - DNA, 96 bp, Homo sapiens; identical to SEQ ID NO: 5156
  chr15:66649845-66649941
  hypo

SEQ ID NO: 15907 - DNA, 81 bp, Homo sapiens
  chr15:67545405-67545486
  hypo
actatgtgccagactcggggataagcacaatcttgcgaaaattatccctattttatagatagaaggtgaaggggccgggcg

SEQ ID NO: 15908 - DNA, 30 bp, Homo sapiens
  chr15:70075720-70075750
  hypo
ctgccctccccaaagcgtgactctaatcag

SEQ ID NO: 15909 - DNA, 176 bp, Homo sapiens
  chr15:72102772-72102948
  hypo
ggtagcaggactgaccggctcccggggcaccttggtaatgctgcaggtgtggccagttgatcccctgtggagacagtaaagattaagaggatcataaactgcgtccagcggctgccccgggagaaatctcctcaagccagagcctgtgctgtgaggggcttcgggaccttggggca

SEQ ID NO: 15910 - DNA, 220 bp, Homo sapiens; identical to SEQ ID NO: 5157
  chr15:72412089-72412309
  hypo

SEQ ID NO: 15911 - DNA, 187 bp, Homo sapiens
  chr15:72581494-72581681
  hypo
cccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggccc

SEQ ID NO: 15912 - DNA, 39 bp, Homo sapiens
  chr15:76197482-76197521
  hypo
ccacattttcactattaacaacaacgctgtgcagaacct

SEQ ID NO: 15913 - DNA, 30 bp, Homo sapiens
  chr15:76510088-76510118
  hypo
cttccaaggggctttcggctgccttagctc

SEQ ID NO: 15914 - DNA, 30 bp, Homo sapiens
  chr15:77906968-77906998
  hypo
cggatgcgggcgcggcggcaggtgaagtag

SEQ ID NO: 15915 - DNA, 44 bp, Homo sapiens
  chr15:78501806-78501850
  hypo
cgaggcctcctgtgccgggcagacagaggcgtgtgaatgctgca

SEQ ID NO: 15916 - DNA, 85 bp, Homo sapiens; identical to SEQ ID NO: 1604
  chr15:78596048-78596133
  hypo

SEQ ID NO: 15917 - DNA, 139 bp, Homo sapiens
  chr15:78609750-78609889
  hypo
cacagcgtgctgctccgagcactgccatgccaggtgacttcactctcctgattttgaagatccctgtttccatgcctctccttcggtgaatcatatgttctgggcctgacctggatccccagtcctgacacccagccca

SEQ ID NO: 15918 - DNA, 95 bp, Homo sapiens
  chr15:83655934-83656029
  hypo
ttgggattacagaggtgagccaccgcgcctggccttagagcacttttactccaattctttccttgaataagactcttatgcgccaccctccccta

SEQ ID NO: 15919 - DNA, 30 bp, Homo sapiens
  chr15:90630578-90630608
  hypo
aatgcactctaatagcgaccttcccagggt

SEQ ID NO: 15920 - DNA, 82 bp, Homo sapiens
  chr15:90703242-90703324
  hypo
ttgtttgtttttttgcgggggtgggtggtttgagacggcatctcactctgtcgcccaggctggagtgctgtcgcatgatctg

SEQ ID NO: 15921 - DNA, 104 bp, Homo sapiens
  chr15:90844295-90844399
  hypo
agctggtctgttggggaccttccagacctgttacctgtatgctgcctggtgacgcgtgggggagtccacagggactgccatggcgcctacggggcacagtccgg

SEQ ID NO: 15922 - DNA, 116 bp, Homo sapiens
  chr15:91189343-91189459
  hypo
acctgggccagctcccgccgtgtcccagctgctccccattccgtcccatggcccgtcgcgccttccccagcgtccctatgccttacgaggtcctgtttccacgtcaacctgacctt

SEQ ID NO: 15923 - DNA, 30 bp, Homo sapiens
  chr15:91313685-91313715
  hypo
gtgagccaccgtgcccggccaatccccaca

SEQ ID NO: 15924 - DNA, 30 bp, Homo sapiens
  chr15:91409404-91409434
  hypo
tcacatataactcatcgctatcacagcccc

SEQ ID NO: 15925 - DNA, 39 bp, Homo sapiens
  chr15:93364629-93364668
  hypo
ggcaacaagagccagactctgtctcgggggaaaaaaaaa

SEQ ID NO: 15926 - DNA, 30 bp, Homo sapiens
  chr15:93609848-93609878
  hypo
cgtcaccaccgccgccgcctccacctcgct

SEQ ID NO: 15927 - DNA, 30 bp, Homo sapiens
  chr15:94347602-94347632
  hypo
aaaaaaaaaaagtcacgtggaaccatcgtg

SEQ ID NO: 15928 - DNA, 24 bp, Homo sapiens
  chr15:94478454-94478478
  hypo
aaagaaggaggaggccgggcgccg

SEQ ID NO: 15929 - DNA, 30 bp, Homo sapiens
  chr15:97006359-97006389
  hypo
tgtgacatccgtgagcgctgatggtgcacg

SEQ ID NO: 15930 - DNA, 31 bp, Homo sapiens
  chr15:98454964-98454995
  hypo
tgccaaccacccggcccggcacatttatttt

SEQ ID NO: 15931 - DNA, 20 bp, Homo sapiens
  chr15:99295597-99295617
  hypo
tagagtgtttattaacgaaa

SEQ ID NO: 15932 - DNA, 30 bp, Homo sapiens
  chr15:99460238-99460268
  hypo
aaaagatgacaggttcggtgaagtgagtcc

SEQ ID NO: 15933 - DNA, 132 bp, Homo sapiens
  chr15:99484456-99484588
  hypo
aggaaagcagcagcacgtgcctggcacagggcagggcctctccagatggcagttcctgtctgtgtcttattcccaccctccgggcacatggggggaactcagtttctccccactgcgcgtcaccctgggaga

SEQ ID NO: 15934 - DNA, 246 bp, Homo sapiens
  chr15:102043043-102043289
  hypo
actccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagc

SEQ ID NO: 15935 - DNA, 57 bp, Homo sapiens
  chr16:142626-142683
  hypo
ttctgacaaggagaccggcaaggagaacttggcaagaacggacggcaggtcatgaga

SEQ ID NO: 15936 - DNA, 30 bp, Homo sapiens
  chr16:189535-189565
  hypo
aaaacacttggaagccgacaggagatcttt

SEQ ID NO: 15937 - DNA, 22 bp, Homo sapiens
  chr16:319924-319946
  hypo
aaacaaggtaggccacgcatgg

SEQ ID NO: 15938 - DNA, 30 bp, Homo sapiens
  chr16:337748-337778
  hypo
acccagacctgggtacgtgggcaaatccca

SEQ ID NO: 15939 - DNA, 188 bp, Homo sapiens
  chr16:410258-410446
  hypo
taggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacc

SEQ ID NO: 15940 - DNA, 419 bp, Homo sapiens
  chr16:411085-411504
  hypo
ctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagcc

SEQ ID NO: 15941 - DNA, 30 bp, Homo sapiens
  chr16:612290-612320
  hypo
ggggccatgctgggacgtccactccccaca

SEQ ID NO: 15942 - DNA, 154 bp, Homo sapiens; identical to SEQ ID NO: 5159
  chr16:612869-613023
  hypo

SEQ ID NO: 15943 - DNA, 30 bp, Homo sapiens
  chr16:613572-613602
  hypo
tggggagtccgaccccggcaggcaacccca

SEQ ID NO: 15944 - DNA, 411 bp, Homo sapiens
  chr16:614790-615201
  hypo
cccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatga

SEQ ID NO: 15945 - DNA, 65 bp, Homo sapiens
  chr16:667484-667549
  hypo
cggaaaacctgattccgtggtggctgtgagccccttccctccccttctgtcggcttcaccttaaa

SEQ ID NO: 15946 - DNA, 30 bp, Homo sapiens
  chr16:677879-677909
  hypo
cctgggcttgaccggcggggagcctggttg

SEQ ID NO: 15947 - DNA, 42 bp, Homo sapiens
  chr16:700572-700614
  hypo
gacctgcctgcagctcgatctgcaggacgttctcctggtcta

SEQ ID NO: 15948 - DNA, 283 bp, Homo sapiens; identical to SEQ ID NO: 1605
  chr16:726729-727012
  hypo

SEQ ID NO: 15949 - DNA, 158 bp, Homo sapiens
  chr16:731412-731570
  hypo
gtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactccta

SEQ ID NO: 15950 - DNA, 748 bp, Homo sapiens; identical to SEQ ID NO: 5161
  chr16:734930-735678
  hypo

SEQ ID NO: 15951 - DNA, 30 bp, Homo sapiens
  chr16:735921-735951
  hypo
gcatctcctttgctgcggtccagccgcgtc

SEQ ID NO: 15952 - DNA, 145 bp, Homo sapiens
  chr16:741376-741521
  hypo
tttactggttgttgtcggtcacatacgagtgtgaattccaccaaggcaggaatcacattctggctcaatccccaccgaatgcccagtgcctgacacacctgttcaaccagttgctctcgttcttttttttaaaaaactttttgag

SEQ ID NO: 15953 - DNA, 30 bp, Homo sapiens
  chr16:809500-809530
  hypo
gctcaggcctctcctcgagctctgggccct

SEQ ID NO: 15954 - DNA, 180 bp, Homo sapiens
  chr16:809840-810020
  hypo
acatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccg

SEQ ID NO: 15955 - DNA, 273 bp, Homo sapiens
  chr16:824939-825212
  hypo
ggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctca

SEQ ID NO: 15956 - DNA, 230 bp, Homo sapiens; identical to SEQ ID NO: 5162
  chr16:837308-837538
  hypo

SEQ ID NO: 15957 - DNA, 205 bp, Homo sapiens; identical to SEQ ID NO: 1606
  chr16:845955-846160
  hypo

SEQ ID NO: 15958 - DNA, 66 bp, Homo sapiens
  chr16:846426-846492
  hypo
gtcctgctgccccagcgacggcaccaacttgcaggacgctgagtcactctccgtggcagccatcgg

SEQ ID NO: 15959 - DNA, 53 bp, Homo sapiens
  chr16:858748-858801
  hypo
gaggccgagaagtcccgggagggatgccatctgcaagccggagacctgggatg

SEQ ID NO: 15960 - DNA, 30 bp, Homo sapiens
  chr16:882403-882433
  hypo
ggtgtagggtgaaggcgtgagccacagtgc

SEQ ID NO: 15961 - DNA, 65 bp, Homo sapiens
  chr16:888904-888969
  hypo
ctgggaagatggatccgtcccagtgtggccgcgcggctgtcaggagggcacggggactgggcgcg

SEQ ID NO: 15962 - DNA, 80 bp, Homo sapiens
  chr16:924620-924700
  hypo
ggaggctgctcatgccgcaactccccaacggaaggatcacgggaaccaggacaggctccgggggacggtgctcagatggg

SEQ ID NO: 15963 - DNA, 128 bp, Homo sapiens
  chr16:943459-943587
  hypo
ggatgagcccaaagtcggagggagcacccagtgcacacgcgtctcagccccgccccctgcggcacaaagggagccgaggcgcaggccccgtgtgtctcccacacactgcagctcgcctgctgtgagga

SEQ ID NO: 15964 - DNA, 63 bp, Homo sapiens
  chr16:963320-963383
  hypo
gaacattcacttccacggccgctgctctccttcctgcgacacagacagcgttggcccaatcag

SEQ ID NO: 15965 - DNA, 30 bp, Homo sapiens
  chr16:981776-981806
  hypo
agtgacgtgctgagccgctgcagggtcaga

SEQ ID NO: 15966 - DNA, 134 bp, Homo sapiens
  chr16:1052493-1052627
  hypo
cccgatgtccctccccgggtgaaggaacccacggacgtggctcatccataccgcggaacgtgagccatgaaaaggggcagcctcggctcagccaccgcagggaaggactcgacacacgccgagcagaagaggcc

SEQ ID NO: 15967 - DNA, 30 bp, Homo sapiens
  chr16:1077608-1077638
  hypo
tacccccgtgggctgcgagttctggaacgt

SEQ ID NO: 15968 - DNA, 217 bp, Homo sapiens
  chr16:1081773-1081990
  hypo
acccgccctggattgcgggcacagcggcccccacaccggctgccggggctgcacaggctctggtgggctttagggtggcaaacatgcccaggttggggcctacaccccccaggttgagggagtggctccctggggtggctgccgcccatcccggcgtttctgggcttgtggacgtgtcgccccagccctgccggtcttcacgcggccttctctgtgt

SEQ ID NO: 15969 - DNA, 30 bp, Homo sapiens
  chr16:1128984-1129014
  hypo
ggcggtgctggtgcccgtgctgtacctgct

SEQ ID NO: 15970 - DNA, 30 bp, Homo sapiens
  chr16:1166711-1166741
  hypo
agagaaaatcagccacggctcccaggcccc

SEQ ID NO: 15971 - DNA, 30 bp, Homo sapiens
  chr16:1171222-1171252
  hypo
ggcgacacccctccacgcacccgtagtggc

SEQ ID NO: 15972 - DNA, 118 bp, Homo sapiens
  chr16:1173263-1173381
  hypo
cccggcacctggggccgatctacaggtgcattttgtacatagaatctgacccacaggttgtttgttggataaggggaaaatcccggaatccaggaggcccgtgcgccttcacctccgg

SEQ ID NO: 15973 - DNA, 95 bp, Homo sapiens
  chr16:1195687-1195782
  hypo
cacaggcccccgccccgggtctggctcagctggttcctcagatgtccctgggcggcctggcaccttctctgaggagcccccgggtgaaattcccc

SEQ ID NO: 15974 - DNA, 30 bp, Homo sapiens
  chr16:1217473-1217503
  hypo
ttaatgagcttggtgcggttgccatgggaa

SEQ ID NO: 15975 - DNA, 151 bp, Homo sapiens
  chr16:1228780-1228931
  hypo
ccaagctccagaagtcggggttggggtgaagagatgtggcggagtggccggggcaggcaggtgtggctgccagggcagaggaaggaccgaacggtggcatctccccagcagggtggccccgcgcccttgccagccccggaggaccagatgg

SEQ ID NO: 15976 - DNA, 143 bp, Homo sapiens
  chr16:1230054-1230197
  hypo
catctggttgccgggtgatactgagggggccgggctctgcaggcacagggctgaggggcgtcgtgtggatggacggccagcccgttgggtgccctggctgggtccctgtccctgcacaccgggtcagccggctcctgggtgca

SEQ ID NO: 15977 - DNA, 54 bp, Homo sapiens
  chr16:1236842-1236896
  hypo
cggcagacttcagggcggtccgtcccactcccgtggcctcgagggtcctttgga

SEQ ID NO: 15978 - DNA, 77 bp, Homo sapiens
  chr16:1251702-1251779
  hypo
ttgccacgcagttctcggagacgaagcagcgggagagtcagctgatgcgggagcagcgggcacgccacctgtccaac

SEQ ID NO: 15979 - DNA, 91 bp, Homo sapiens
  chr16:1268128-1268219
  hypo
gcagggggaaggggacggcactgccagggtggcacccgcgggtgggtgtggaccccggcccacagctgtcccccaccgcaggacacgctgc

SEQ ID NO: 15980 - DNA, 51 bp, Homo sapiens
  chr16:1312476-1312527
  hypo
ccagcactggtccttcggggtgagctccagcgagaccggggagagcttgac

SEQ ID NO: 15981 - DNA, 45 bp, Homo sapiens
  chr16:1324031-1324076
  hypo
gaccttcacctgctgcgggcggtaaggaggcggcagcatatctgc

SEQ ID NO: 15982 - DNA, 144 bp, Homo sapiens
  chr16:1391751-1391895
  hypo
tggactccctgaccccggcctgggcagagcctcgccggggaccctcatgggcatctctgttctccttgtagcgagattgaggatgtgagcacggaccagctgcacctggacatctggtacaggcccctgcgccatgcagggcgg

SEQ ID NO: 15983 - DNA, 62 bp, Homo sapiens
  chr16:1397548-1397610
  hypo
ctgaaggaggagctgcggctgcacaaatgttccacccgcgagtgcatcgagcagttctacct

SEQ ID NO: 15984 - DNA, 28 bp, Homo sapiens
  chr16:1407453-1407481
  hypo
agtcacccagcacctcgtgtgtatttcg

SEQ ID NO: 15985 - DNA, 190 bp, Homo sapiens
  chr16:1417148-1417338
  hypo
gcaggggaatggtgccgatgtccccacagccccgcagccccggcagtgtggaggctacgcccaggccctccagctcctcctgcagctgcttcacctgtgcctccacctcctccttcttctgcagcgccagctgccggtcgctatcggccacacgggcacgctccttggcctcctgcgcctctcgctgcca

SEQ ID NO: 15986 - DNA, 243 bp, Homo sapiens
  chr16:1417675-1417918
  hypo
gactcctcccactgccggatcttcctcttggcctcgtccagctgccgcctgacccgggccagctcagctccgtttggacttgcactcgaagaggatggggggccggcactcaggatgggggaggggctgggggagaagctgccggaaacaaagtcccagatgctcccggggacaccgttcaaacctgagtgtgaaacggtcgatgacggcccagccctgctgtgctcgcggcctggtgggatt

SEQ ID NO: 15987 - DNA, 30 bp, Homo sapiens
  chr16:1425654-1425684
  hypo
taacaggttgggggtcggggcagccaggcc

SEQ ID NO: 15988 - DNA, 43 bp, Homo sapiens
  chr16:1428212-1428255
  hypo
actgaggacaggcaccgaccccccaacccgcaggcctgcccac

SEQ ID NO: 15989 - DNA, 145 bp, Homo sapiens; identical to SEQ ID NO: 5165
  chr16:1428508-1428653
  hypo

SEQ ID NO: 15990 - DNA, 30 bp, Homo sapiens
  chr16:1428877-1428907
  hypo
gcccactttctcacccgcagcttctccccc

SEQ ID NO: 15991 - DNA, 30 bp, Homo sapiens
  chr16:1486627-1486657
  hypo
gggagaagggtcccacgccacctccaaggc

SEQ ID NO: 15992 - DNA, 37 bp, Homo sapiens
  chr16:1491115-1491152
  hypo
tctcaaaacaaaaaacgagtgtcggcctggctttgct

SEQ ID NO: 15993 - DNA, 77 bp, Homo sapiens
  chr16:1493574-1493651
  hypo
agccctgcagctgcacgcgggcccgcacctggagcagctcccgcagcaggctccgcgtggcgcgctcacagcgctgc

SEQ ID NO: 15994 - DNA, 82 bp, Homo sapiens
  chr16:1730551-1730633
  hypo
tcatctgaacggggtcgagtcgcagggcgggcgccttgtaagcgtcacatttagttttgctgtgaagcgagtcaggtggtgg

SEQ ID NO: 15995 - DNA, 122 bp, Homo sapiens
  chr16:1741761-1741883
  hypo
gtctccaaagcactgcgggggtggggtggggtggggtccggtggacgtctggttgctcagtgttctgtgatcgtttctgcagggggtaaaggaagtggtatctttgacgaatcaacccccgt

SEQ ID NO: 15996 - DNA, 120 bp, Homo sapiens
  chr16:1813598-1813718
  hypo
gggcactgtgggggccgctcaccctggacagagacatcacccatcattcttccactcagcgactgcacgtcctccgcccgtcgagagcagaagcgcgagcagtaccgccaggtgcgtgag

SEQ ID NO: 15997 - DNA, 30 bp, Homo sapiens
  chr16:2028658-2028688
  hypo
ggaaacccataaaggcgcactgccctagcc

SEQ ID NO: 15998 - DNA, 147 bp, Homo sapiens; identical to SEQ ID NO: 5166
  chr16:2029023-2029170
  hypo

SEQ ID NO: 15999 - DNA, 30 bp, Homo sapiens
  chr16:2213693-2213723
  hypo
ctgcatacctgggatcggggtgaaggacct

SEQ ID NO: 16000 - DNA, 24 bp, Homo sapiens
  chr16:2232798-2232822
  hypo
ttgctttgtttgagacggagcctc

SEQ ID NO: 16001 - DNA, 84 bp, Homo sapiens
  chr16:2233062-2233146
  hypo
caggcgtgagccaccgcgcccggccgcacctccgtgttaatgacgattggccatggcgtgtgcaggtatcgctgagaatggggg

SEQ ID NO: 16002 - DNA, 336 bp, Homo sapiens; identical to SEQ ID NO: 1608
  chr16:2234684-2235020
  hypo

SEQ ID NO: 16003 - DNA, 367 bp, Homo sapiens
  chr16:2278403-2278770
  hypo
ccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggc

SEQ ID NO: 16004 - DNA, 34 bp, Homo sapiens
  chr16:2466336-2466370
  hypo
gggccacagagcgagactccgcctcaaaaaaaaa

SEQ ID NO: 16005 - DNA, 30 bp, Homo sapiens
  chr16:2531804-2531834
  hypo
agccacagttaggcacgtttgcacttccaa

SEQ ID NO: 16006 - DNA, 37 bp, Homo sapiens
  chr16:2540828-2540865
  hypo
ctctcactccctccccggccaccgcctccggctctgc

SEQ ID NO: 16007 - DNA, 18 bp, Homo sapiens
  chr16:2589100-2589118
  hypo
atggagtctccctctcga

SEQ ID NO: 16008 - DNA, 74 bp, Homo sapiens
  chr16:2764635-2764709
  hypo
cctgaaaggctggctcggagagaaccaccctccaggtgcagcagggccagccccacctgcgggcctctggcagg

SEQ ID NO: 16009 - DNA, 117 bp, Homo sapiens; identical to SEQ ID NO: 5168
  chr16:2770122-2770239
  hypo

SEQ ID NO: 16010 - DNA, 82 bp, Homo sapiens; identical to SEQ ID NO: 5169
  chr16:2770456-2770538
  hypo

SEQ ID NO: 16011 - DNA, 30 bp, Homo sapiens
  chr16:2877506-2877536
  hypo
gaggaggagtgtcctcgtgtgtgcatgccc

SEQ ID NO: 16012 - DNA, 20 bp, Homo sapiens
  chr16:3211706-3211726
  hypo
aatgtggttggaaatcgcgg

SEQ ID NO: 16013 - DNA, 120 bp, Homo sapiens
  chr16:3211846-3211966
  hypo
aaacaattttaaaagttagcagggcgtggtggtgcgcgcctgtgatccaagctactcctgtgtctgaggcaggaggatcgcttgagcctgtctcaaataaacaaagggcggggcgcggtg

SEQ ID NO: 16014 - DNA, 78 bp, Homo sapiens
  chr16:3492662-3492740
  hypo
agactctgtatcaaaaaaaaaaaaaaaagaacttttaaaagtagccagacactgtggtatgcgcgcctctcagatact

SEQ ID NO: 16015 - DNA, 33 bp, Homo sapiens
  chr16:3598920-3598953
  hypo
accaggtgaagcagacggcgtcacactagcctc

SEQ ID NO: 16016 - DNA, 37 bp, Homo sapiens
  chr16:3957870-3957907
  hypo
agggagactgagtggcgagaaccgagatgttggcaaa

SEQ ID NO: 16017 - DNA, 30 bp, Homo sapiens
  chr16:4410956-4410986
  hypo
ccctgcagcttcagccgatcagctccagcc

SEQ ID NO: 16018 - DNA, 30 bp, Homo sapiens
  chr16:4840446-4840476
  hypo
cttctggggaactcccgctccttcctggag

SEQ ID NO: 16019 - DNA, 31 bp, Homo sapiens
  chr16:4846424-4846455
  hypo
gagctggtctcaggccgggcgcggtggctca

SEQ ID NO: 16020 - DNA, 30 bp, Homo sapiens
  chr16:5439313-5439343
  hypo
gcataacaggcttttcgaccttggctctat

SEQ ID NO: 16021 - DNA, 136 bp, Homo sapiens
  chr16:8781018-8781154
  hypo
acggaaagtgtttgccgagagcacttggccgcctgccctcccacggagcaggtgctagtcttgggtcccgctcttccgggttcttcagaagctgagctccggtctgtaatcccagcactttgggaggctgaggcgg

SEQ ID NO: 16022 - DNA, 30 bp, Homo sapiens
  chr16:8870353-8870383
  hypo
ccccctcccctgccccgcccccaccaccca

SEQ ID NO: 16023 - DNA, 76 bp, Homo sapiens
  chr16:9005728-9005804
  hypo
aaccttcagagctcacgacaggctgggaagtctgtgttcccaccagccaccgtggaaaaaccgctgaacacctggg

SEQ ID NO: 16024 - DNA, 30 bp, Homo sapiens
  chr16:9010029-9010059
  hypo
gtgactcaggaccaacgggacagccaacaa

SEQ ID NO: 16025 - DNA, 30 bp, Homo sapiens
  chr16:10804588-10804618
  hypo
tatcctctccctccccgcctagatattagg

SEQ ID NO: 16026 - DNA, 94 bp, Homo sapiens
  chr16:14725771-14725865
  hypo
tgaactgggaagcagcgtattaataaatctgtataaataactgtttaatgggggcctggcgccatgactcacacctgtaatcccagcgttttcg

SEQ ID NO: 16027 - DNA, 30 bp, Homo sapiens
  chr16:15762701-15762731
  hypo
gcccggatcatcctccgttgggagggactg

SEQ ID NO: 16028 - DNA, 68 bp, Homo sapiens
  chr16:15820825-15820893
  hypo
gcctggcccaggacccgcagctccccggccaggtctgcgttctctttctccagcgtctgcttattctt

SEQ ID NO: 16029 - DNA, 30 bp, Homo sapiens; identical to SEQ ID NO: 5170
  chr16:18802453-18802483
  hypo

SEQ ID NO: 16030 - DNA, 45 bp, Homo sapiens; identical to SEQ ID NO: 5171
  chr16:18950973-18951018
  hypo

SEQ ID NO: 16031 - DNA, 30 bp, Homo sapiens
  chr16:19534836-19534866
  hypo
aggcgtaagccatcacgcccggtgggttca

SEQ ID NO: 16032 - DNA, 30 bp, Homo sapiens
  chr16:23303315-23303345
  hypo
tgtttttttctctcacgccccacatccaat

SEQ ID NO: 16033 - DNA, 18 bp, Homo sapiens
  chr16:26664757-26664775
  hypo
acccggcccttttgtcca

SEQ ID NO: 16034 - DNA, 42 bp, Homo sapiens
  chr16:28560194-28560236
  hypo
cccagacatcattgtcgccctccgcaacggtgcatctgtgct

SEQ ID NO: 16035 - DNA, 78 bp, Homo sapiens
  chr16:28878714-28878792
  hypo
ctggagatgcctgaccgggagaacacgtttgtggttaaggtaggaattcaacttcccagccgccggcagtgcttgtgt

SEQ ID NO: 16036 - DNA, 34 bp, Homo sapiens
  chr16:29139111-29139145
  hypo
tacagaccaggaaaacgggcggagaggctgagtg

SEQ ID NO: 16037 - DNA, 55 bp, Homo sapiens
  chr16:29153203-29153258
  hypo
catggcacaagggagcggtggaataatcctctgtggcacgcgggggggggtgtgg

SEQ ID NO: 16038 - DNA, 81 bp, Homo sapiens
  chr16:29831042-29831123
  hypo
agtagtctcttccctcggcagcggaaatactgattcccactgctcctgcctctagggtgcagtgtccgtacctgctggagc

SEQ ID NO: 16039 - DNA, 337 bp, Homo sapiens; identical to SEQ ID NO: 5172
  chr16:30017290-30017627
  hypo

SEQ ID NO: 16040 - DNA, 30 bp, Homo sapiens
  chr16:30116285-30116315
  hypo
ggctgcttcaaaatccgactcttcattaag

SEQ ID NO: 16041 - DNA, 294 bp, Homo sapiens; identical to SEQ ID NO: 5173
  chr16:30124567-30124861
  hypo

SEQ ID NO: 16042 - DNA, 20 bp, Homo sapiens
  chr16:30826363-30826383
  hypo
gctcccgtccaggacaggga

SEQ ID NO: 16043 - DNA, 22 bp, Homo sapiens
  chr16:30907048-30907070
  hypo
gcgcacatgcacacacgcgcac

SEQ ID NO: 16044 - DNA, 141 bp, Homo sapiens
  chr16:30907130-30907271
  hypo
gtccgcatgcacgcacacacgcagacacacgcaagcgcacacacacacgggcctcctcgtcttcattcacaaaccccattagcttctgttgtctatgggcttcctcgacagaccgcgagcccctcgcgggggccagaaacc

SEQ ID NO: 16045 - DNA, 120 bp, Homo sapiens
  chr16:31138607-31138727
  hypo
caagctctggctctgcgagtactgcctcaagtacatgaaatatgagaagagctaccgcttccacttggtgaggctgggccggccgggccgagctgggcaggggcccggtgagaggcagag

SEQ ID NO: 16046 - DNA, 197 bp, Homo sapiens; identical to SEQ ID NO: 1609
  chr16:31446899-31447096
  hypo

SEQ ID NO: 16047 - DNA, 33 bp, Homo sapiens
  chr16:31500544-31500577
  hypo
cccagctttcctctgcggcgtgcactacctcta

SEQ ID NO: 16048 - DNA, 105 bp, Homo sapiens
  chr16:33893476-33893581
  hypo
attcgatgattcaattggatgtcattcgatgattccataagattccctttgatgatgattctattccgtcctttcaatgatgataccaatcgattccattcgatg

SEQ ID NO: 16049 - DNA, 49 bp, Homo sapiens
  chr16:46721677-46721726
  hypo
tcggatgcaaaagtgcgacaccaagaagactaagcgagctgcctaaatt

SEQ ID NO: 16050 - DNA, 91 bp, Homo sapiens
  chr16:48642042-48642133
  hypo
ctttctgacattctccgagcgttttattactattaatggtttttttccgattctcaagaacacggttttcaccgtgtgacacaggacagtc

SEQ ID NO: 16051 - DNA, 34 bp, Homo sapiens
  chr16:53448517-53448551
  hypo
accacaaagattagccgggcgtggtgggccgcac

SEQ ID NO: 16052 - DNA, 32 bp, Homo sapiens
  chr16:53563622-53563654
  hypo
caagtgtcgagcagacgcggatgtgaatatga

SEQ ID NO: 16053 - DNA, 30 bp, Homo sapiens
  chr16:55203930-55203960
  hypo
tgggatccagggacccggagtcttgcatct

SEQ ID NO: 16054 - DNA, 30 bp, Homo sapiens
  chr16:57222226-57222256
  hypo
tggttttccaaatatcgggcaatcatttcc

SEQ ID NO: 16055 - DNA, 30 bp, Homo sapiens
  chr16:57759922-57759952
  hypo
aaatctcctctcacacgctcatcctttgct

SEQ ID NO: 16056 - DNA, 38 bp, Homo sapiens
  chr16:59046529-59046567
  hypo
ggaaccccatgtattcggttaatttttttttttttttt

SEQ ID NO: 16057 - DNA, 93 bp, Homo sapiens
  chr16:67313865-67313958
  hypo
ctcgactgtcttcagcgcggttcacactgagacccagccctctcccgctggccccgagcaggcccacctttaggagggcgtgatggaaaggcc

SEQ ID NO: 16058 - DNA, 39 bp, Homo sapiens
  chr16:67578633-67578672
  hypo
gcatgggccctggagcggctgctgcgggaagcccgagta

SEQ ID NO: 16059 - DNA, 27 bp, Homo sapiens
  chr16:68770701-68770728
  hypo
aaaaaattagcctggcgtggtggtgtg

SEQ ID NO: 16060 - DNA, 147 bp, Homo sapiens
  chr16:68770848-68770995
  hypo
cccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccata

SEQ ID NO: 16061 - DNA, 18 bp, Homo sapiens
  chr16:68876852-68876870
  hypo
tttgagatggagtctcgc

SEQ ID NO: 16062 - DNA, 30 bp, Homo sapiens
  chr16:70595670-70595700
  hypo
tccaccaacaccctacggtgagtgagtctc

SEQ ID NO: 16063 - DNA, 29 bp, Homo sapiens
  chr16:71919039-71919068
  hypo
taagccactgtgcccggcctggttggacg

SEQ ID NO: 16064 - DNA, 84 bp, Homo sapiens
  chr16:72461607-72461691
  hypo
ttaatgaggaataatcgtttggctaatgagctttgaaacattaagagaaaagaggttttttccgttaatcgctctggtgcgact

SEQ ID NO: 16065 - DNA, 51 bp, Homo sapiens
  chr16:72957744-72957795
  hypo
tactttgaattgcctcgtcctaccacgttcaagacgcggctactgggcagg

SEQ ID NO: 16066 - DNA, 19 bp, Homo sapiens
  chr16:75019669-75019688
  hypo
aaaccgaagatacctcttc

SEQ ID NO: 16067 - DNA, 209 bp, Homo sapiens
  chr16:75148827-75149036
  hypo
gattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagcca

SEQ ID NO: 16068 - DNA, 37 bp, Homo sapiens
  chr16:75469082-75469119
  hypo
ttacaggcgtgagccaccgcgccgggcaccttcaagg

SEQ ID NO: 16069 - DNA, 30 bp, Homo sapiens
  chr16:80654771-80654801
  hypo
gcagcagtttgctgtcgtctgtggctgcgt

SEQ ID NO: 16070 - DNA, 30 bp, Homo sapiens
  chr16:81533258-81533288
  hypo
catgtggcctctgcccggggagcagaggtg

SEQ ID NO: 16071 - DNA, 180 bp, Homo sapiens
  chr16:81632932-81633112
  hypo
cttctaggatcatatcgttacctgccactttgcgtttgctgtatgactttccgtttgtgagattaaaaagaacatgaaatattttgacgggccttccccaaatgagcatccatgggtttctgccttggaggccaagctgatctataggtgtctgaggacctgctgcgtggggtagcaaca

SEQ ID NO: 16072 - DNA, 30 bp, Homo sapiens
  chr16:83968795-83968825
  hypo
agaaaaatgtagctgcgtgagcgggaggga

SEQ ID NO: 16073 - DNA, 41 bp, Homo sapiens
  chr16:84075186-84075227
  hypo
cgattataggcacgagccaccgtgcccggcccagctttagt

SEQ ID NO: 16074 - DNA, 30 bp, Homo sapiens
  chr16:84153364-84153394
  hypo
actggcaaccaaagtcgaacatgatggaag

SEQ ID NO: 16075 - DNA, 58 bp, Homo sapiens
  chr16:85007798-85007856
  hypo
ttgtttttatttcaacgtgcactaaaaaaaggactaagtaaaacgatgggagtcgaat

SEQ ID NO: 16076 - DNA, 173 bp, Homo sapiens
  chr16:85028164-85028337
  hypo
gagccagctcagctccgccttcctggttcaggtcctggtaagacctccacggagtgcaggatgctgctgtggctccatgcctgacctgggggtgcggatggcaggcacagctgtgtaaggagagcgcccacagacaccaaacactggccatggcaggacgttcctataagcac

SEQ ID NO: 16077 - DNA, 55 bp, Homo sapiens
  chr16:85033827-85033882
  hypo
cagcacaggtatgtacggccggtgtgatagtgcaagggtgcggcacaaggcaagt

SEQ ID NO: 16078 - DNA, 16 bp, Homo sapiens
  chr16:85043890-85043906
  hypo
gcgctgggattacagg

SEQ ID NO: 16079 - DNA, 30 bp, Homo sapiens
  chr16:85075540-85075570
  hypo
tttgcccctatgctgcgcactcctgtccct

SEQ ID NO: 16080 - DNA, 101 bp, Homo sapiens
  chr16:85083589-85083690
  hypo
tgtcccggagtcagccgctgtgtccttttgtgaaagaagtacagcccgtcacccagggagggcgcgccttatggcgggttctaacacgcagttgcaatgga

SEQ ID NO: 16081 - DNA, 197 bp, Homo sapiens
  chr16:85336384-85336581
  hypo
tggccttggccttgtcgaggtgcggtgtgctgggcagggtgggtgaggtcagcggctgtcacaagtaaccctgcgtcttcagtggcgtgatgcagccgaagcgcattctccttcaatcgggtccaacggggtgctcagtgggtcttccacaaggtgactcggggtccggtttcccggagcctcggcctccccactgc

SEQ ID NO: 16082 - DNA, 68 bp, Homo sapiens
  chr16:85455150-85455218
  hypo
caaacagctgcacagcgattttctgaccaggcggggaggagaaggcaggttttcggggctgctggcag

SEQ ID NO: 16083 - DNA, 49 bp, Homo sapiens
  chr16:85485769-85485818
  hypo
caccctggcctgcatcggggccccgcaattaagccgattatgttttgag

SEQ ID NO: 16084 - DNA, 32 bp, Homo sapiens
  chr16:85671134-85671166
  hypo
gagtccccccttgatcgcggcagtggctgtgt

SEQ ID NO: 16085 - DNA, 34 bp, Homo sapiens
  chr16:85673852-85673886
  hypo
tcgctcccttaacaccggccgggggctcatggta

SEQ ID NO: 16086 - DNA, 110 bp, Homo sapiens
  chr16:85674157-85674267
  hypo
ggtgccacctgaaaccgagatcccagctgagtgagtggggactacgtgtgcggggaccacggagcagggaccacagacccatcctcatgagctgccgtgggaatgcttcc

SEQ ID NO: 16087 - DNA, 304 bp, Homo sapiens
  chr16:85684237-85684541
  hypo
ccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatga

SEQ ID NO: 16088 - DNA, 30 bp, Homo sapiens
  chr16:85721581-85721611
  hypo
ctgaaaacgcaaagccgggcgggcgcgggg

SEQ ID NO: 16089 - DNA, 30 bp, Homo sapiens
  chr16:85731482-85731512
  hypo
aagggaggttgagaccgggaacttgagaag

SEQ ID NO: 16090 - DNA, 147 bp, Homo sapiens
  chr16:87296936-87297083
  hypo
gtgacctattctttagtaactgttcccttgaggaagaatctgacaccctggtgcattctcacgcactatccccaccagcctgccagggcattccctgagcactgggcacaggggaagctggacaaccagtcccggggcttggcaaaa

SEQ ID NO: 16091 - DNA, 22 bp, Homo sapiens
  chr16:87421399-87421421
  hypo
gcctgggcgacagagagaaaaa

SEQ ID NO: 16092 - DNA, 102 bp, Homo sapiens
  chr16:87594957-87595059
  hypo
cctaaggattggaaacgaccatcggcaggggacgggttaaaccgattaaggtgactgacaccgcgcagtgatgcgcagccagtgtaacggccctgtggagga

SEQ ID NO: 16093 - DNA, 90 bp, Homo sapiens
  chr16:87723156-87723246
  hypo
tgaggttccctctggcgccctggcccggggaccgcggcctcgctgtggaatgtgctgggtaacgccgtctggcgtcgtcttgtgtcccca

SEQ ID NO: 16094 - DNA, 465 bp, Homo sapiens; identical to SEQ ID NO: 1611
  chr16:87723648-87724113
  hypo

SEQ ID NO: 16095 - DNA, 154 bp, Homo sapiens
  chr16:88498606-88498760
  hypo
aggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctca

SEQ ID NO: 16096 - DNA, 30 bp, Homo sapiens
  chr16:88503235-88503265
  hypo
tgcttccagcgcttccgcagcctgggcgag

SEQ ID NO: 16097 - DNA, 178 bp, Homo sapiens
  chr16:88504017-88504195
  hypo
gctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaag

SEQ ID NO: 16098 - DNA, 93 bp, Homo sapiens
  chr16:88506448-88506541
  hypo
cccgcgggccctcctcgttccctcccagcctccatggccgccctctagagcctccctgctgtacggagctctgggctccgcctatttgcaatg

SEQ ID NO: 16099 - DNA, 56 bp, Homo sapiens
  chr16:88508016-88508072
  hypo
tccacttgttgctggcggaactcacaccgtaagggcgtctgcgaaggggcccagcg

SEQ ID NO: 16100 - DNA, 30 bp, Homo sapiens
  chr16:88551519-88551549
  hypo
gactgggcccctgggcggggcactggcagg

SEQ ID NO: 16101 - DNA, 46 bp, Homo sapiens
  chr16:88603730-88603776
  hypo
caccccagagggccccgccacggcccggactcgaagcttagggcag

SEQ ID NO: 16102 - DNA, 39 bp, Homo sapiens
  chr16:88623960-88623999
  hypo
tgcagcctcaaggcacgggagccacggatgcctgaggcc

SEQ ID NO: 16103 - DNA, 45 bp, Homo sapiens
  chr16:88624831-88624876
  hypo
tccgggggtgtgagtcgcgcatccccccgtcggggggtgagtcgc

SEQ ID NO: 16104 - DNA, 30 bp, Homo sapiens
  chr16:88683871-88683901
  hypo
tctttatagctaggccgatgggtgtgctca

SEQ ID NO: 16105 - DNA, 48 bp, Homo sapiens
  chr16:88757586-88757634
  hypo
gcgtgtgtccatgggcgtatgcgtgtgggaagtcgcagtagctgctct

SEQ ID NO: 16106 - DNA, 41 bp, Homo sapiens
  chr16:88832763-88832804
  hypo
agccagcgcgccctgcgaacttcagacgtgacagccccaca

SEQ ID NO: 16107 - DNA, 200 bp, Homo sapiens
  chr16:88883254-88883454
  hypo
gaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgaggg

SEQ ID NO: 16108 - DNA, 30 bp, Homo sapiens
  chr16:88931261-88931291
  hypo
ttgatgacccggccccggaagaggctctgg

SEQ ID NO: 16109 - DNA, 30 bp, Homo sapiens
  chr16:88943136-88943166
  hypo
gtcaggaggtctccgcgcggaatcattagg

SEQ ID NO: 16110 - DNA, 312 bp, Homo sapiens; identical to SEQ ID NO: 1612
  chr16:88943712-88944024
  hypo

SEQ ID NO: 16111 - DNA, 477 bp, Homo sapiens
  chr16:88945602-88946079
  hypo
tcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacacggctttctgcagctccgacatggcctgccgcttcacctcattcacggcctcttctgcaaaggacatgggcagggctggcggtcacatgggccatcccagatgggtctctggacttcctacgcgtggccacaacctggggacaggggctgtgtgcagctgaacacacgtaccatctgtgcacacaaaggcacatgttgatggggctgtaggcagctgaacacacgtagcatctgtgcacacacagacacacgttgatggccctca

SEQ ID NO: 16112 - DNA, 138 bp, Homo sapiens
  chr16:88948551-88948689
  hypo
ggtgaaggacccagccgctgcgcagggacggcgcaggccacacaggagggcactgagctcaggggcgcccacacagccctgctgtctccagcagccccaggccccatggggcagagccatggccgtgtttatgcatag

SEQ ID NO: 16113 - DNA, 186 bp, Homo sapiens
  chr16:88952219-88952405
  hypo
tagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgactt

SEQ ID NO: 16114 - DNA, 30 bp, Homo sapiens
  chr16:88952665-88952695
  hypo
aaaggtcaaggtgctcgacctctctgggcc

SEQ ID NO: 16115 - DNA, 160 bp, Homo sapiens; identical to SEQ ID NO: 5178
  chr16:88955208-88955368
  hypo

SEQ ID NO: 16116 - DNA, 109 bp, Homo sapiens
  chr16:88956230-88956339
  hypo
ctggacgatgccccgcgattcctcctcctccagggacacttcaaatccctggacgacgccccgcgattcctcctccttcagggacgacgccccgcgattcctcctcctc

SEQ ID NO: 16117 - DNA, 541 bp, Homo sapiens; identical to SEQ ID NO: 5179
  chr16:88957405-88957946
  hypo

SEQ ID NO: 16118 - DNA, 91 bp, Homo sapiens
  chr16:88958358-88958449
  hypo
ctcgatcgtcaatgtcgagttctgcaggggagaaaacccacctcacatcagcaccgctcggcatgtgagccagcgccgacccacccatgcc

SEQ ID NO: 16119 - DNA, 549 bp, Homo sapiens; identical to SEQ ID NO: 5180
  chr16:88963214-88963763
  hypo

SEQ ID NO: 16120 - DNA, 201 bp, Homo sapiens
  chr16:88966387-88966588
  hypo
agggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagta

SEQ ID NO: 16121 - DNA, 30 bp, Homo sapiens
  chr16:88976653-88976683
  hypo
aggctgcctccttcccggtgatgctgcagc

SEQ ID NO: 16122 - DNA, 48 bp, Homo sapiens
  chr16:88978024-88978072
  hypo
tggggatggaattcccgcagaatcacggagggacgaagtacatgagct

SEQ ID NO: 16123 - DNA, 57 bp, Homo sapiens
  chr16:88994398-88994455
  hypo
tctgtccacaggcagcggctcccggcacccaccgctgctgaccgagcccctggcacc

SEQ ID NO: 16124 - DNA, 32 bp, Homo sapiens
  chr16:89000172-89000204
  hypo
acagtgccacacgtctgcgtccccacagccat

SEQ ID NO: 16125 - DNA, 49 bp, Homo sapiens
  chr16:89001075-89001124
  hypo
gaggcagagatgccacgaaagaggcacgaagggccgtgccctgccctct

SEQ ID NO: 16126 - DNA, 38 bp, Homo sapiens
  chr16:89025782-89025820
  hypo
gaggtggagggaacacgcatgcacgcccagggctggag

SEQ ID NO: 16127 - DNA, 30 bp, Homo sapiens
  chr16:89026022-89026052
  hypo
ggagagggaaggtcccggggaaaccctcct

SEQ ID NO: 16128 - DNA, 256 bp, Homo sapiens
  chr16:89055673-89055929
  hypo
ccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggag

SEQ ID NO: 16129 - DNA, 271 bp, Homo sapiens; identical to SEQ ID NO: 5181
  chr16:89072503-89072774
  hypo

SEQ ID NO: 16130 - DNA, 109 bp, Homo sapiens
  chr16:89107675-89107784
  hypo
agttctccagagtgccggccctccactcgagttcccctgccccggggaatgccctttccctacacctgcaatcccctgagggacgggaggaggccggtagtccatgagc

SEQ ID NO: 16131 - DNA, 30 bp, Homo sapiens
  chr16:89109506-89109536
  hypo
attctatgattgatccgtcatgcctgccgt

SEQ ID NO: 16132 - DNA, 93 bp, Homo sapiens; identical to SEQ ID NO: 5182
  chr16:89120243-89120336
  hypo

SEQ ID NO: 16133 - DNA, 33 bp, Homo sapiens
  chr16:89120708-89120741
  hypo
tgctccccagaacctcgtcgtcttcccggtgcc

SEQ ID NO: 16134 - DNA, 44 bp, Homo sapiens
  chr16:89138016-89138060
  hypo
gaggaaagacagacacggcgttggctgcgcgggggcctgcatcc

SEQ ID NO: 16135 - DNA, 115 bp, Homo sapiens
  chr16:89172217-89172332
  hypo
gcaggttggttccatcgtcccggagggcaggttggttccatcctcccaagtaaagagtgtgttaccctcagggcgagaggcaggtgggtgtgggtgctggcgcaggccagctgtc

SEQ ID NO: 16136 - DNA, 30 bp, Homo sapiens
  chr16:89189873-89189903
  hypo
acggtcccggatccacgtggctcaagtgag

SEQ ID NO: 16137 - DNA, 71 bp, Homo sapiens; identical to SEQ ID NO: 1613
  chr16:89220327-89220398
  hypo

SEQ ID NO: 16138 - DNA, 385 bp, Homo sapiens; identical to SEQ ID NO: 5184
  chr16:89220641-89221026
  hypo

SEQ ID NO: 16139 - DNA, 30 bp, Homo sapiens
  chr16:89225881-89225911
  hypo
ggcggagggcgctgccgcaggtccccacat

SEQ ID NO: 16140 - DNA, 34 bp, Homo sapiens
  chr16:89226363-89226397
  hypo
gcgccatgcagaggccgctcggtcctcaggagct

SEQ ID NO: 16141 - DNA, 126 bp, Homo sapiens
  chr16:89245316-89245442
  hypo
ttcttggggtcattccgtgtcaggaccccacgctctccccagccctggctggcccaggggctttccgtgtgcaccgctaccctggcacctggggcgaggctgtgtccccgccgggtgaatctcagg

SEQ ID NO: 16142 - DNA, 35 bp, Homo sapiens
  chr16:89245710-89245745
  hypo
ctgagggaaacactgcgccccgtggcctcctcacc

SEQ ID NO: 16143 - DNA, 139 bp, Homo sapiens
  chr16:89254633-89254772
  hypo
gggcagttcaccatccgcacggaccccaagaccaacgagggtgttctgtccattgtgaaggtgagcggcccccggctggcacacagatgccggcagacgcagatgccgacacacacagatgcccacacacagatgccgg

SEQ ID NO: 16144 - DNA, 55 bp, Homo sapiens; identical to SEQ ID NO: 5185
  chr16:89558648-89558703
  hypo

SEQ ID NO: 16145 - DNA, 24 bp, Homo sapiens
  chr16:89575654-89575678
  hypo
aggttgttgttttttcggttattt

SEQ ID NO: 16146 - DNA, 30 bp, Homo sapiens
  chr16:89576068-89576098
  hypo
tgacagcaggagccccgtgtctgggcagcc

SEQ ID NO: 16147 - DNA, 79 bp, Homo sapiens
  chr16:89655054-89655133
  hypo
acagctcctggctcccggcccactgcaggtggccattgacttcaccgcctccaatggagacccgcggaacagctgctcc

SEQ ID NO: 16148 - DNA, 30 bp, Homo sapiens
  chr16:89668379-89668409
  hypo
aggagatgtggctcccgggaaactgacgat

SEQ ID NO: 16149 - DNA, 40 bp, Homo sapiens
  chr16:89702746-89702786
  hypo
gtccaccgcatgtgccggatgtacccggagaccttcctgt

SEQ ID NO: 16150 - DNA, 30 bp, Homo sapiens
  chr16:89704648-89704678
  hypo
cccctttagggttcccggagctccgggaag

SEQ ID NO: 16151 - DNA, 233 bp, Homo sapiens; identical to SEQ ID NO: 5186
  chr16:89883952-89884185
  hypo

SEQ ID NO: 16152 - DNA, 165 bp, Homo sapiens
  chr16:89900625-89900790
  hypo
gtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggat

SEQ ID NO: 16153 - DNA, 40 bp, Homo sapiens
  chr16:90066907-90066947
  hypo
gagctgctgggcccccggcccttctcggagaagtctacct

SEQ ID NO: 16154 - DNA, 133 bp, Homo sapiens
  chr16:90069191-90069324
  hypo
ctgtctgtgctgtagcggtctgtgcaccctgcagggacacgagccttcagcccctgtatttctcagcctgcctgcctccctccctctgccagaagggaaggtggaatggggtggaatgcgtgtacctgccagt

SEQ ID NO: 16155 - DNA, 32 bp, Homo sapiens; identical to SEQ ID NO: 5187
  chr17:1136665-1136697
  hypo

SEQ ID NO: 16156 - DNA, 18 bp, Homo sapiens
  chr17:1471448-1471466
  hypo
acccggccactctttcat

SEQ ID NO: 16157 - DNA, 84 bp, Homo sapiens
  chr17:1546366-1546450
  hypo
ctcccggcgccccgccgcggccacctgtctccgctccgccccgcccgctcacaggtctccgcgcagcctcgctcacctgtgtcc

SEQ ID NO: 16158 - DNA, 120 bp, Homo sapiens; identical to SEQ ID NO: 1614
  chr17:2207818-2207938
  hypo

SEQ ID NO: 16159 - DNA, 36 bp, Homo sapiens; identical to SEQ ID NO: 5189
  chr17:2220961-2220997
  hypo

SEQ ID NO: 16160 - DNA, 30 bp, Homo sapiens
  chr17:2298979-2299009
  hypo
gggggctgacagtcacgggggctgacagtc

SEQ ID NO: 16161 - DNA, 30 bp, Homo sapiens; identical to SEQ ID NO: 1615
  chr17:3658849-3658879
  hypo

SEQ ID NO: 16162 - DNA, 170 bp, Homo sapiens
  chr17:3741605-3741775
  hypo
ctcgggaccagaggtcgacaggtgtgataaagctatgacgccctcgcggtagagttgtgagagagactcacaggtatgcttgcgcccggctgtgcaggcacatgaaggtcaagccacacctggccttcacaggacttctcctcaaacagaaaccccgcccatgagggaag

SEQ ID NO: 16163 - DNA, 39 bp, Homo sapiens
  chr17:4236673-4236712
  hypo
gtaaaatgtaaaagacgggccgggcacggtggctctgtc

SEQ ID NO: 16164 - DNA, 30 bp, Homo sapiens
  chr17:4976853-4976883
  hypo
agacggtgggccaggcgtggtagctcacgg

SEQ ID NO: 16165 - DNA, 69 bp, Homo sapiens
  chr17:7466711-7466780
  hypo
acctcccagcggccccgcccttcccgccccactcatcgaaaaacctgctcacagcgccgccgccgagcc

SEQ ID NO: 16166 - DNA, 88 bp, Homo sapiens
  chr17:8104512-8104600
  hypo
gcagagttgcaactccggagtttcccggatagctgcaggcttacccgcaggtaacagtagaagtaggagtcagcgttaaggctgtggg

SEQ ID NO: 16167 - DNA, 33 bp, Homo sapiens
  chr17:8384676-8384709
  hypo
catctctctcctgctcggcgtgtcggcgggctc

SEQ ID NO: 16168 - DNA, 30 bp, Homo sapiens
  chr17:10212959-10212989
  hypo
gcgtcgttccggctgcggatttcagcatcc

SEQ ID NO: 16169 - DNA, 30 bp, Homo sapiens
  chr17:11572707-11572737
  hypo
gatttggcaaacatgcggcgcacactcatg

SEQ ID NO: 16170 - DNA, 30 bp, Homo sapiens
  chr17:11637568-11637598
  hypo
tacgcacaataaaatcggggactgtgccgc

SEQ ID NO: 16171 - DNA, 30 bp, Homo sapiens
  chr17:16282207-16282237
  hypo
cttgcacaacaagcacgtcaatgggagcag

SEQ ID NO: 16172 - DNA, 187 bp, Homo sapiens
  chr17:17579341-17579528
  hypo
tcatcgcagaggaggcggggcggcagcgtgggcaggagctcaggccaggagaatccctactctaagtatgactgtgtgatcttgggcaagtgacttcattccctaagtgtgtttcctcatctgaacaaggaggctattgaaatgcaggtgagacctagtgagacagcggctgcgggaatcacctggc

SEQ ID NO: 16173 - DNA, 96 bp, Homo sapiens
  chr17:17891258-17891354
  hypo
caacattgagaccatcgaggggctggacacactggtgaacctggaggacctgagcttgttcaacaaccggatctccaagatcgactccctggacgc

SEQ ID NO: 16174 - DNA, 268 bp, Homo sapiens; identical to SEQ ID NO: 5191
  chr17:18163086-18163354
  hypo

SEQ ID NO: 16175 - DNA, 20 bp, Homo sapiens
  chr17:19769860-19769880
  hypo
tcatccgataagcaacaaag

SEQ ID NO: 16176 - DNA, 37 bp, Homo sapiens
  chr17:20771887-20771924
  hypo
ctaggaatcaggagtcggtggccgtatgctggaggct

SEQ ID NO: 16177 - DNA, 23 bp, Homo sapiens
  chr17:20817586-20817609
  hypo
aatgtgactcttggccgggcgcg

SEQ ID NO: 16178 - DNA, 30 bp, Homo sapiens
  chr17:21104001-21104031
  hypo
atgtacctgaagctccgaatgtgcctgaca

SEQ ID NO: 16179 - DNA, 53 bp, Homo sapiens
  chr17:21147486-21147539
  hypo
cgatccgcttgcccacgtactcatagagcaggacggcccggtcatgacatcct

SEQ ID NO: 16180 - DNA, 142 bp, Homo sapiens; identical to SEQ ID NO: 1616
  chr17:25620573-25620715
  hypo

SEQ ID NO: 16181 - DNA, 40 bp, Homo sapiens
  chr17:26263183-26263223
  hypo
aacaagaagaatggccgggcgcggtgactcacgcctgtaa

SEQ ID NO: 16182 - DNA, 33 bp, Homo sapiens; identical to SEQ ID NO: 1617
  chr17:26927180-26927213
  hypo

SEQ ID NO: 16183 - DNA, 24 bp, Homo sapiens
  chr17:27056401-27056425
  hypo
ctccctctgtcaccccggctggag

SEQ ID NO: 16184 - DNA, 24 bp, Homo sapiens
  chr17:27056845-27056869
  hypo
gagccaccgcgacaggccagaagt

SEQ ID NO: 16185 - DNA, 30 bp, Homo sapiens
  chr17:27074858-27074888
  hypo
agatctacccagacccggagctggaagtac

SEQ ID NO: 16186 - DNA, 20 bp, Homo sapiens
  chr17:27170162-27170182
  hypo
tttttttttctgagtcgaag

SEQ ID NO: 16187 - DNA, 30 bp, Homo sapiens
  chr17:27411663-27411693
  hypo
acaaccaggctccagcggccctctatcact

SEQ ID NO: 16188 - DNA, 86 bp, Homo sapiens; identical to SEQ ID NO: 5195
  chr17:27716046-27716132
  hypo

SEQ ID NO: 16189 - DNA, 85 bp, Homo sapiens; identical to SEQ ID NO: 5196
  chr17:27716192-27716277
  hypo

SEQ ID NO: 16190 - DNA, 55 bp, Homo sapiens
  chr17:30243877-30243932
  hypo
tggggcacaggccttcgcccgccgcatgcaccctgggctgcgcagccccagccag

SEQ ID NO: 16191 - DNA, 37 bp, Homo sapiens; identical to SEQ ID NO: 5197
  chr17:30250325-30250362
  hypo

SEQ ID NO: 16192 - DNA, 30 bp, Homo sapiens
  chr17:31214057-31214087
  hypo
cccatttccccattccgtgtgaagagtgcc

SEQ ID NO: 16193 - DNA, 31 bp, Homo sapiens; identical to SEQ ID NO: 5198
  chr17:33877286-33877317
  hypo

SEQ ID NO: 16194 - DNA, 30 bp, Homo sapiens
  chr17:33917238-33917268
  hypo
aacttctaatgaagacgtcagtttttgcca

SEQ ID NO: 16195 - DNA, 23 bp, Homo sapiens
  chr17:37011132-37011155
  hypo
aatataaatagtggccgggcctt

SEQ ID NO: 16196 - DNA, 24 bp, Homo sapiens
  chr17:37192168-37192192
  hypo
gacgttagccgccacccccgggca

SEQ ID NO: 16197 - DNA, 30 bp, Homo sapiens
  chr17:37369159-37369189
  hypo
cagagcatttacccccgcaccgcagcctgt

SEQ ID NO: 16198 - DNA, 146 bp, Homo sapiens; identical to SEQ ID NO: 1618
  chr17:39682499-39682645
  hypo

SEQ ID NO: 16199 - DNA, 23 bp, Homo sapiens
  chr17:40477866-40477889
  hypo
accgcgcccggccaatcaatttc

SEQ ID NO: 16200 - DNA, 103 bp, Homo sapiens
  chr17:40975574-40975677
  hypo
aagctctcagaagtccacaatgtcagaatgctttatgtttccaaggagaaaacagggagccagatgaagtgactttcctaggttcacacgatgagtttgtggc

SEQ ID NO: 16201 - DNA, 108 bp, Homo sapiens
  chr17:41464822-41464930
  hypo
catctacattcaagacgcggtgagagccccagcctcgctccttgcctcattcactttgtcttgtccacaccaatattgacgccattacacactcgggctgatttctta

SEQ ID NO: 16202 - DNA, 39 bp, Homo sapiens
  chr17:42330587-42330626
  hypo
cgttggcatgggtgacggaacgcacggtggtggcactga

SEQ ID NO: 16203 - DNA, 102 bp, Homo sapiens; identical to SEQ ID NO: 1619
  chr17:42331669-42331771
  hypo

SEQ ID NO: 16204 - DNA, 41 bp, Homo sapiens
  chr17:42395128-42395169
  hypo
catgagggcagggaccgtgtcttgtccgttctctgtatccc

SEQ ID NO: 16205 - DNA, 24 bp, Homo sapiens
  chr17:46177212-46177236
  hypo
taaaatatggccaggcgcagtggc

SEQ ID NO: 16206 - DNA, 86 bp, Homo sapiens
  chr17:47227368-47227454
  hypo
ttgtatttcctcttccgttaattacctgtttatgttctttaccatttaaaaattttggaggtcggggggggtcagccccccacctg

SEQ ID NO: 16207 - DNA, 50 bp, Homo sapiens
  chr17:47657544-47657594
  hypo
tctcagcagcgggcacgggtggggcggggccgggccgcagagcatgtgct

SEQ ID NO: 16208 - DNA, 32 bp, Homo sapiens
  chr17:47851118-47851150
  hypo
tttttttttttctggcgactgagtttcattct

SEQ ID NO: 16209 - DNA, 31 bp, Homo sapiens
  chr17:47851390-47851421
  hypo
caggcgtgagccactgcgcctagccttaagg

SEQ ID NO: 16210 - DNA, 30 bp, Homo sapiens
  chr17:48612278-48612308
  hypo
gtgggggacagttcacgggtgaagtggagg

SEQ ID NO: 16211 - DNA, 60 bp, Homo sapiens
  chr17:48653004-48653064
  hypo
gcggttcctgtccaacgccagcaccctggctagcttctctgagcccggcagctgctatga

SEQ ID NO: 16212 - DNA, 54 bp, Homo sapiens
  chr17:48653279-48653333
  hypo
acctgggcaatgggacgctcagggccccccgggccagcccggagatccaggaca

SEQ ID NO: 16213 - DNA, 41 bp, Homo sapiens
  chr17:48687181-48687222
  hypo
aggggccctgcccagcgcacctggtccggccagtgaccaat

SEQ ID NO: 16214 - DNA, 120 bp, Homo sapiens; identical to SEQ ID NO: 1620
  chr17:49229470-49229590
  hypo

SEQ ID NO: 16215 - DNA, 39 bp, Homo sapiens
  chr17:53479136-53479175
  hypo
gaaaatgttttctgccggccgggcacggtggctcatgcc

SEQ ID NO: 16216 - DNA, 30 bp, Homo sapiens
  chr17:54473510-54473540
  hypo
tttaagaaggggccacgggccaggcacggt

SEQ ID NO: 16217 - DNA, 34 bp, Homo sapiens; identical to SEQ ID NO: 5202
  chr17:55037248-55037282
  hypo

SEQ ID NO: 16218 - DNA, 44 bp, Homo sapiens
  chr17:55184791-55184835
  hypo
ttcccaaggaactagcgccaagttgggctcgctgattaacatta

SEQ ID NO: 16219 - DNA, 102 bp, Homo sapiens
  chr17:55364127-55364229
  hypo
ccacaccccctcccccgcttattattatttatttatttttctggtgaacaaacagaattaggaaaggtgtgttcttccaggagagagcgggcagtgtgggag

SEQ ID NO: 16220 - DNA, 37 bp, Homo sapiens; identical to SEQ ID NO: 1621
  chr17:57297023-57297060
  hypo

SEQ ID NO: 16221 - DNA, 228 bp, Homo sapiens
  chr17:60856637-60856865
  hypo
cagaaagaagaggcccgacccacaaggaatctgagaatgggcaagcagaaattagagaaaattaaaagcatgattcatggaacacatatgccacatcctaagccgtggctgctttcatgacactgtaaagggtgtcagtgggttgacattgacagattaatgggaggatgtctccccaagagccgtttgaaagtggagaagctgaaggtttcacggacacgataggat

SEQ ID NO: 16222 - DNA, 37 bp, Homo sapiens
  chr17:61677502-61677539
  hypo
tacaggcgtgagccaccgcgcccggctgtcctgcttc

SEQ ID NO: 16223 - DNA, 89 bp, Homo sapiens
  chr17:61817866-61817955
  hypo
catctcaaaaaaattaaaataaaaataaagagagaaaataataaacccagcaaacatttatggcaaacttcctacgtgtcaggcactgt

SEQ ID NO: 16224 - DNA, 30 bp, Homo sapiens
  chr17:66643303-66643333
  hypo
ggggaggggtctgtccgttgcagacccctg

SEQ ID NO: 16225 - DNA, 16 bp, Homo sapiens
  chr17:67410381-67410397
  hypo
gcgagactccctctcg

SEQ ID NO: 16226 - DNA, 44 bp, Homo sapiens
  chr17:68268160-68268204
  hypo
ttaaaaaaatattgtcggccgggcgcagtggctcatgcctgtaa

SEQ ID NO: 16227 - DNA, 38 bp, Homo sapiens
  chr17:70657503-70657541
  hypo
ctgagaattggcaagcgaagggacggcaacctgcagcc

SEQ ID NO: 16228 - DNA, 30 bp, Homo sapiens
  chr17:70712704-70712734
  hypo
aaggaaaaaaaaaatcggaaactttaaccc

SEQ ID NO: 16229 - DNA, 30 bp, Homo sapiens
  chr17:71391476-71391506
  hypo
tgatcttatagcccacggactcagggttcc

SEQ ID NO: 16230 - DNA, 30 bp, Homo sapiens
  chr17:71879558-71879588
  hypo
ctccaaaatccgaaacgctccaaaatccga

SEQ ID NO: 16231 - DNA, 47 bp, Homo sapiens
  chr17:72356264-72356311
  hypo
cccgcagaaccacatcgctggcgttgccctgccgcagcagctcctgc

SEQ ID NO: 16232 - DNA, 30 bp, Homo sapiens
  chr17:72370768-72370798
  hypo
gaggaccccctcacccgcccacacctccat

SEQ ID NO: 16233 - DNA, 19 bp, Homo sapiens
  chr17:73031621-73031640
  hypo
actccagtctctggccggg

SEQ ID NO: 16234 - DNA, 26 bp, Homo sapiens
  chr17:73083437-73083463
  hypo
agcgagactcccggccaactgagtac

SEQ ID NO: 16235 - DNA, 41 bp, Homo sapiens
  chr17:73089693-73089734
  hypo
cattggcagtgaggccgtggcagcgtcggcagcagaggatg

SEQ ID NO: 16236 - DNA, 17 bp, Homo sapiens
  chr17:73135904-73135921
  hypo
tccgtctcaaaaataaa

SEQ ID NO: 16237 - DNA, 151 bp, Homo sapiens; identical to SEQ ID NO: 5206
  chr17:73586267-73586418
  hypo

SEQ ID NO: 16238 - DNA, 30 bp, Homo sapiens
  chr17:73606380-73606410
  hypo
gctgcctgagctggccgagctggccaaatc

SEQ ID NO: 16239 - DNA, 142 bp, Homo sapiens
  chr17:73615938-73616080
  hypo
catgcccgatccctgcgcagctttgcggaggtgctgggtgtggagtgccggggcggctccaccctggagctgtcactgaagagcgagcagctggtgctgcacacagcccgggcaagggccatcgaggcgctggttgagctat

SEQ ID NO: 16240 - DNA, 54 bp, Homo sapiens; identical to SEQ ID NO: 5207
  chr17:73636283-73636337
  hypo

SEQ ID NO: 16241 - DNA, 37 bp, Homo sapiens
  chr17:73638388-73638425
  hypo
catcatcttggcctgcgtgacccgtgctctggccacc

SEQ ID NO: 16242 - DNA, 165 bp, Homo sapiens
  chr17:74128189-74128354
  hypo
ctactttcctgggagcgcgggtcctggggctcagacctctctgtcctcagaacagggtggtgcggcccaagggcaggtgaggggctggtgggagtcagttcagggctgtactggaaggctatcaggggccagtagggagaccctcatccccgacagccccttccg

SEQ ID NO: 16243 - DNA, 30 bp, Homo sapiens
  chr17:74908784-74908814
  hypo
gctgcaagatgcttccggggtgagggaggt

SEQ ID NO: 16244 - DNA, 44 bp, Homo sapiens
  chr17:75049830-75049874
  hypo
tggtgtggacttggccgcgggactgagcgcggggcctgctcagg

SEQ ID NO: 16245 - DNA, 30 bp, Homo sapiens
  chr17:75523118-75523148
  hypo
cccctcctccctctccgctgctgcaatgcc

SEQ ID NO: 16246 - DNA, 34 bp, Homo sapiens
  chr17:75733974-75734008
  hypo
ataaaagacgcggcccgtacgcagagctgaagtg

SEQ ID NO: 16247 - DNA, 30 bp, Homo sapiens
  chr17:76021291-76021321
  hypo
aaatcccctgtgctccgcatagtcatcccc

SEQ ID NO: 16248 - DNA, 292 bp, Homo sapiens; identical to SEQ ID NO: 5208
  chr17:76137898-76138190
  hypo

SEQ ID NO: 16249 - DNA, 31 bp, Homo sapiens; identical to SEQ ID NO: 1623
  chr17:76211256-76211287
  hypo

SEQ ID NO: 16250 - DNA, 91 bp, Homo sapiens; identical to SEQ ID NO: 1624
  chr17:76211527-76211618
  hypo

SEQ ID NO: 16251 - DNA, 30 bp, Homo sapiens
  chr17:76419409-76419439
  hypo
tctagactctgggggcgggggcttgggtgt

SEQ ID NO: 16252 - DNA, 82 bp, Homo sapiens
  chr17:77002830-77002912
  hypo
agtgtgtgaaaataacgggatgggatcatcgccccatggacctggatcagggctgccttccacaccgcggtggcacctgcac

SEQ ID NO: 16253 - DNA, 30 bp, Homo sapiens
  chr17:77105030-77105060
  hypo
ccctgcgttgaacagcgaggatgcagcaca

SEQ ID NO: 16254 - DNA, 30 bp, Homo sapiens
  chr17:77127147-77127177
  hypo
atgtgctgcgtgtcccgtgtgtgctgtgtg

SEQ ID NO: 16255 - DNA, 63 bp, Homo sapiens
  chr17:77135878-77135941
  hypo
gcatctctgcactgacgatgccggaggggcagaaccaccgtgtgtgcccggggaggacgtctt

SEQ ID NO: 16256 - DNA, 115 bp, Homo sapiens
  chr17:77807753-77807868
  hypo
ccggctacaccgtcacgtactccttgaaagtaacggtgaggcagttcgcggtgacgtcggtgataattatattcccaaagaagggcttgaactcgctcagcgactctgcaggttc

SEQ ID NO: 16257 - DNA, 78 bp, Homo sapiens
  chr17:77926480-77926558
  hypo
tgtggcccaggtccacgcggaacacgccgcaaatctgctccagggcgcacacccgctgcggctcgtcccagcgtgggg

SEQ ID NO: 16258 - DNA, 30 bp, Homo sapiens
  chr17:77948916-77948946
  hypo
aacaatccgccaggccgcgtcactcctcac

SEQ ID NO: 16259 - DNA, 92 bp, Homo sapiens
  chr17:78122161-78122253
  hypo
cacaggtgtccacgcgcagccactaaccgctttcttatctgacactttaagtgcttcttcgtacccagctcctctaacgccttttgaagcag

SEQ ID NO: 16260 - DNA, 30 bp, Homo sapiens
  chr17:78447089-78447119
  hypo
cgtgcccacacctggcgtggcgctggactt

SEQ ID NO: 16261 - DNA, 144 bp, Homo sapiens
  chr17:78667900-78668044
  hypo
tagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacaca

SEQ ID NO: 16262 - DNA, 35 bp, Homo sapiens
  chr17:79096981-79097016
  hypo
tggggccctcaccagcggtccgacagggtcagctg

SEQ ID NO: 16263 - DNA, 39 bp, Homo sapiens
  chr17:79099769-79099808
  hypo
gggctgacggggccacgtgtccttcgccacttcttccag

SEQ ID NO: 16264 - DNA, 48 bp, Homo sapiens
  chr17:79100184-79100232
  hypo
tggcctagggcttcccggccgctggcccgcgcccgccctcacctgtgc

SEQ ID NO: 16265 - DNA, 30 bp, Homo sapiens
  chr17:79107633-79107663
  hypo
tctagcatcacacatcgtcccctccagaag

SEQ ID NO: 16266 - DNA, 30 bp, Homo sapiens
  chr17:79211720-79211750
  hypo
tcgctccccgagaaccgactgatgtcgtgt

SEQ ID NO: 16267 - DNA, 48 bp, Homo sapiens
  chr17:79609256-79609304
  hypo
actcaactgtgactccggcatctgggtagggctcgcacctcccccatt

SEQ ID NO: 16268 - DNA, 309 bp, Homo sapiens; identical to SEQ ID NO: 1625
  chr17:79769384-79769693
  hypo

SEQ ID NO: 16269 - DNA, 30 bp, Homo sapiens
  chr17:79774960-79774990
  hypo
atcaagaataattcacgttagaaataaaaa

SEQ ID NO: 16270 - DNA, 30 bp, Homo sapiens
  chr17:79847763-79847793
  hypo
agtgtggggatactccggccgcaggcacac

SEQ ID NO: 16271 - DNA, 30 bp, Homo sapiens
  chr17:79870492-79870522
  hypo
gccaaaaagggaaagcggcatcaggcgggc

SEQ ID NO: 16272 - DNA, 173 bp, Homo sapiens
  chr17:79874854-79875027
  hypo
tcccaactccaagagcgcagagtgtgtgtctgagtttgctctagcgacccagcacagccagctttacagtatggttatttgttcacatgcctgatccttgtcacctaaaagcttcctgagaacagaaatcacctgggttcagatctgctaggccgacgcgtgcccaacacccc

SEQ ID NO: 16273 - DNA, 112 bp, Homo sapiens
  chr17:79887664-79887776
  hypo
caggagctcacttcccgtcacagctggatgcctcctcccgcaggcacctcccgggcatcctcccgccccaggctgcaccttctgtgggactggcccccgcaggcacctcccg

SEQ ID NO: 16274 - DNA, 17 bp, Homo sapiens
  chr17:79913149-79913166
  hypo
cccggcctacaagacct

SEQ ID NO: 16275 - DNA, 30 bp, Homo sapiens
  chr17:80251974-80252004
  hypo
gacaggataagcacacgagtagatctaagt

SEQ ID NO: 16276 - DNA, 30 bp, Homo sapiens
  chr17:80254287-80254317
  hypo
ccattcattcgttgacggacacttaggcga

SEQ ID NO: 16277 - DNA, 180 bp, Homo sapiens
  chr17:80479344-80479524
  hypo
gcctacaaattggaatttttaacgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttc

SEQ ID NO: 16278 - DNA, 30 bp, Homo sapiens
  chr17:80654983-80655013
  hypo
cctctgggtgctggtcgtgagcccaagccc

SEQ ID NO: 16279 - DNA, 67 bp, Homo sapiens; identical to SEQ ID NO: 1626
  chr17:80797692-80797759
  hypo

SEQ ID NO: 16280 - DNA, 723 bp, Homo sapiens; identical to SEQ ID NO: 1627
  chr17:80797997-80798720
  hypo

SEQ ID NO: 16281 - DNA, 255 bp, Homo sapiens
  chr17:80832541-80832796
  hypo
ctccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaa

SEQ ID NO: 16282 - DNA, 30 bp, Homo sapiens
  chr17:80972340-80972370
  hypo
gctgaacggcagcctcgtgttgcagcctca

SEQ ID NO: 16283 - DNA, 210 bp, Homo sapiens
  chr17:81008664-81008874
  hypo
gcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgag

SEQ ID NO: 16284 - DNA, 156 bp, Homo sapiens
  chr17:81015300-81015456
  hypo
ctcacctccaggggacggccccgcaagccggagctgccctcctgcacactcagcactcaaggtggatttggaggtgacctaagcccacagctctccaagtcttggggaaatctacagtggatggcaggtgcctgcggacgccgagtgggtgcggcc

SEQ ID NO: 16285 - DNA, 58 bp, Homo sapiens
  chr17:81048783-81048841
  hypo
gggtgggccacaccccggggcccccataggagagcgcaccgggcggcttccagcttgg

SEQ ID NO: 16286 - DNA, 87 bp, Homo sapiens
  chr17:81050193-81050280
  hypo
cctccttttgggtgccgctgccgtcgcgacccagggaagtgggcagcagagctgtggggagtgtctgcccttcgaggaagctgggaa

SEQ ID NO: 16287 - DNA, 30 bp, Homo sapiens
  chr17:81050936-81050966
  hypo
cgaggtgctcctagccgtctgcaccagcga

SEQ ID NO: 16288 - DNA, 30 bp, Homo sapiens
  chr17:81062138-81062168
  hypo
ctgaaggttgagtcccgcagcctagagact

SEQ ID NO: 16289 - DNA, 30 bp, Homo sapiens
  chr17:81076347-81076377
  hypo
ggcagatcctggagccgggaagggatttgg

SEQ ID NO: 16290 - DNA, 19 bp, Homo sapiens
  chr17:81081890-81081909
  hypo
gggcgacgctcagggcggc

SEQ ID NO: 16291 - DNA, 30 bp, Homo sapiens
  chr18:597381-597411
  hypo
aggaggaggtagaggcggggagacacacca

SEQ ID NO: 16292 - DNA, 41 bp, Homo sapiens
  chr18:2755837-2755878
  hypo
tacaggtgtgaatcaccgccctcggccgtgtattttctttt

SEQ ID NO: 16293 - DNA, 44 bp, Homo sapiens
  chr18:5133188-5133232
  hypo
caccaccaccgaccacgatggctgcgccccgggccgcgaggaag

SEQ ID NO: 16294 - DNA, 40 bp, Homo sapiens
  chr18:8845133-8845173
  hypo
tccgcaggctaatgccgctctgccacgtgcagtgagagga

SEQ ID NO: 16295 - DNA, 16 bp, Homo sapiens
  chr18:9364512-9364528
  hypo
aggtgtggtggctcac

SEQ ID NO: 16296 - DNA, 290 bp, Homo sapiens; identical to SEQ ID NO: 5214
  chr18:10589096-10589386
  hypo

SEQ ID NO: 16297 - DNA, 17 bp, Homo sapiens
  chr18:11014809-11014826
  hypo
tccggggccccctcatt

SEQ ID NO: 16298 - DNA, 30 bp, Homo sapiens
  chr18:11979044-11979074
  hypo
aatagcaaacacatacgttccaagcacaag

SEQ ID NO: 16299 - DNA, 22 bp, Homo sapiens
  chr18:12376107-12376129
  hypo
tgagccccggcactagcctatc

SEQ ID NO: 16300 - DNA, 30 bp, Homo sapiens
  chr18:12701811-12701841
  hypo
acccacatgtttcagcggtaaagaaaccct

SEQ ID NO: 16301 - DNA, 26 bp, Homo sapiens
  chr18:12949149-12949175
  hypo
gccaccgcgcccggcctacaagcaga

SEQ ID NO: 16302 - DNA, 39 bp, Homo sapiens
  chr18:13461328-13461367
  hypo
aaaggtcaagaagagcgaggaagacgtggggatggggac

SEQ ID NO: 16303 - DNA, 153 bp, Homo sapiens
  chr18:13826383-13826536
  hypo
acatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatc

SEQ ID NO: 16304 - DNA, 59 bp, Homo sapiens
  chr18:13940522-13940581
  hypo
cctgctgtgggtacccggccgctgagtgtacatgatttcatcgtcgtttgccttaattc

SEQ ID NO: 16305 - DNA, 30 bp, Homo sapiens
  chr18:20911344-20911374
  hypo
gtgaaacctgccccccgccaccacctgtag

SEQ ID NO: 16306 - DNA, 181 bp, Homo sapiens
  chr18:53968903-53969084
  hypo
cctacttcattagttcgttgtggggatgaaataagacaatatatgtaaatcactctaaacagcgattggtatgtagcaactactcagcatgcattagctattatgaggtagcgtgcttagcacagtacctgggacaaaataagagctcaatgaacaatagtatgatcgtgctgatgctgac

SEQ ID NO: 16307 - DNA, 72 bp, Homo sapiens; identical to SEQ ID NO: 5215
  chr18:55850845-55850917
  hypo

SEQ ID NO: 16308 - DNA, 20 bp, Homo sapiens
  chr18:56483918-56483938
  hypo
aagtttgaaattccccggcc

SEQ ID NO: 16309 - DNA, 39 bp, Homo sapiens
  chr18:68051369-68051408
  hypo
aagaaaaaaaagaaaagaacaaagcgcctacctcctgca

SEQ ID NO: 16310 - DNA, 30 bp, Homo sapiens
  chr18:72896219-72896249
  hypo
aggggaggttgaggacgtccctgcactccc

SEQ ID NO: 16311 - DNA, 143 bp, Homo sapiens
  chr18:75229713-75229856
  hypo
caaatgatcatacaccgtctgcggcggcttttctgtgtccacaaagagaccctcccacaggcacatgcatgatgctgcttcccagtgagaaacttcggagagaagacaggaggagacgtggaatgtttcggggctagaaatgt

SEQ ID NO: 16312 - DNA, 99 bp, Homo sapiens
  chr18:75230687-75230786
  hypo
aactgaagtctagctcgtgcttctgaaatgacgcataaataattcaagcttgagagggaagaactggccacactttggaggcgccgagctggggaacct

SEQ ID NO: 16313 - DNA, 378 bp, Homo sapiens
  chr18:75998610-75998988
  hypo
tgtgtgtgctgttcacgtggtgtgtgtgtgtgtcgtgtgtcgtgtggcgtgtgccgtgcgtgtgcgcaccgtgggcgggaggcgagaggaagcgcagtgggagccgcgggcaggcggtcgcagaggggcctggggaggcgaagcagcccgggtgggggcgttcgctggaaacggggcccctctgaagggcgtgggcagccggtgcctgcagagcgtggagagctgcggccgcctcacctgacacaattgggcagcgatttctcaggtccaaagagcggaccccgtgggcactttcctgacggaggactcggctcctgggagctccggcaacatcagcgacagtggagcccggtctcaaaagaccgacccggcggcctg

SEQ ID NO: 16314 - DNA, 30 bp, Homo sapiens
  chr18:76073322-76073352
  hypo
ccgcaaaaccatggacgtcacaagaccacg

SEQ ID NO: 16315 - DNA, 30 bp, Homo sapiens
  chr18:76123862-76123892
  hypo
ggacggcctgttgttcgcgtgctgagtgca

SEQ ID NO: 16316 - DNA, 63 bp, Homo sapiens
  chr18:76239475-76239538
  hypo
gggttaaccagagtccggagtcagagaaataatttggtgtttcagggtcgcctgctgcagggc

SEQ ID NO: 16317 - DNA, 30 bp, Homo sapiens
  chr18:76412736-76412766
  hypo
gactttcctgggttgcgcactgaaagtccc

SEQ ID NO: 16318 - DNA, 30 bp, Homo sapiens
  chr18:76477600-76477630
  hypo
cgggtctgcacctcccgagcctatgactga

SEQ ID NO: 16319 - DNA, 30 bp, Homo sapiens
  chr18:76501479-76501509
  hypo
ctcagtctatggatccgctggacgacccat

SEQ ID NO: 16320 - DNA, 30 bp, Homo sapiens
  chr18:76541560-76541590
  hypo
tgggtgaggcggagccgctcctgaaggatc

SEQ ID NO: 16321 - DNA, 30 bp, Homo sapiens
  chr18:76686197-76686227
  hypo
acagacatggaggagcggcttaccaggtct

SEQ ID NO: 16322 - DNA, 42 bp, Homo sapiens
  chr18:77167812-77167854
  hypo
gagggcatttctttacgatggggaaggcgggactggggcctg

SEQ ID NO: 16323 - DNA, 109 bp, Homo sapiens
  chr18:77181317-77181426
  hypo
acagacctggaatcacgaggaaatgcccgtcctcctcccacgggcagacaggtcgagtgtgtttccagagaccgggccgtccgtggggcagtagcgcctggatgacgtc

SEQ ID NO: 16324 - DNA, 30 bp, Homo sapiens
  chr18:77194948-77194978
  hypo
gagcgcacagtggcccgtttgacatttaaa

SEQ ID NO: 16325 - DNA, 30 bp, Homo sapiens
  chr18:77201979-77202009
  hypo
cccctgcaccctccacgtcagtgccctggc

SEQ ID NO: 16326 - DNA, 64 bp, Homo sapiens
  chr18:77246511-77246575
  hypo
gtcacctcggactcccgcagccggccggagaggcccccgccgtccaggacgtgcccaggccagt

SEQ ID NO: 16327 - DNA, 39 bp, Homo sapiens
  chr18:77272049-77272088
  hypo
atggctccttgtctccggcccaagcgacccctggcatgg

SEQ ID NO: 16328 - DNA, 200 bp, Homo sapiens
  chr18:77285870-77286070
  hypo
gcaaggctgaaccagcgcagtgggaaaggagttaactggtctcgaattctggggcatccctgtctcgtgccacagatgccaagcacagcagggcacggagctcctgggggccgctgcactcagcagcacagtgggcgggaggccgctgagcaaccagcagcctagggcatttgggtggggacgtgcgacccccacacaga

SEQ ID NO: 16329 - DNA, 30 bp, Homo sapiens
  chr18:77288262-77288292
  hypo
tttttaatctggcttcgaacatagcacaag

SEQ ID NO: 16330 - DNA, 32 bp, Homo sapiens
  chr18:77313917-77313949
  hypo
tggctgattgtggcacgcgtgccttccgagcc

SEQ ID NO: 16331 - DNA, 30 bp, Homo sapiens; identical to SEQ ID NO: 1628
  chr18:77329727-77329757
  hypo

SEQ ID NO: 16332 - DNA, 30 bp, Homo sapiens
  chr18:77329972-77330002
  hypo
cagtacagccaaacacgccctcaccttcac

SEQ ID NO: 16333 - DNA, 131 bp, Homo sapiens
  chr18:77364414-77364545
  hypo
tccagtgtccccaggcgttccgggcttgtggctgcgtcattctgccctctgccccctgggcacgcagctgactcccctgtatgggcccatctctccgaattcacatgaccgtccttcggtaaagacaccag

SEQ ID NO: 16334 - DNA, 30 bp, Homo sapiens
  chr18:77410108-77410138
  hypo
ggcacgttctatcctcggccctgtcagccc

SEQ ID NO: 16335 - DNA, 30 bp, Homo sapiens
  chr18:77542905-77542935
  hypo
tcccctttcaaaacacgtacagcgaatgac

SEQ ID NO: 16336 - DNA, 106 bp, Homo sapiens
  chr18:77543230-77543336
  hypo
catccccgtgagctccgcctggccctgctgctcccgcccggaaagctcagacccataacccagcccacttggcagcagcgtgccgcctgatcggcaaggtttactc

SEQ ID NO: 16337 - DNA, 171 bp, Homo sapiens
  chr18:77550196-77550367
  hypo
gacacaagagcgtggcggggccttccgaggatgcggtgcaagggcgctgttagcacccacgcgaggcggcagcgcatggaggaagcctcccatcgtaagcgcgtttctgcctgaaatgcacgtgtccttataggcagcggtcttgccactcatggacggagaggcagcata

SEQ ID NO: 16338 - DNA, 30 bp, Homo sapiens
  chr18:77636150-77636180
  hypo
ccaggacccatctcccgcctggtgccgctg

SEQ ID NO: 16339 - DNA, 183 bp, Homo sapiens
  chr18:77636591-77636774
  hypo
cagtggtgccctctgcgagcagcttgctcacctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccggg

SEQ ID NO: 16340 - DNA, 30 bp, Homo sapiens
  chr18:77644664-77644694
  hypo
ggtttccaaagagaccggacacgcccaagg

SEQ ID NO: 16341 - DNA, 30 bp, Homo sapiens
  chr19:292163-292193
  hypo
caccgttcctatcagcgcacttgctgtccc

SEQ ID NO: 16342 - DNA, 30 bp, Homo sapiens
  chr19:349135-349165
  hypo
aaaacttagtctattcgtgctgctgtaata

SEQ ID NO: 16343 - DNA, 405 bp, Homo sapiens; identical to SEQ ID NO: 5217
  chr19:403367-403772
  hypo

SEQ ID NO: 16344 - DNA, 145 bp, Homo sapiens
  chr19:407470-407615
  hypo
cccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcacc

SEQ ID NO: 16345 - DNA, 30 bp, Homo sapiens
  chr19:468757-468787
  hypo
tgtggcagtgagccacgggtgagggaggaa

SEQ ID NO: 16346 - DNA, 92 bp, Homo sapiens
  chr19:470863-470955
  hypo
ggagctgcttcactgcgcccgttctagacaggagcaggcaccatggggcaaggccaccagcctgtggcacagcgagccggtgcaccccatgc

SEQ ID NO: 16347 - DNA, 229 bp, Homo sapiens
  chr19:485165-485394
  hypo
atggagggtcattgccgtgctctaccacgtaacacacgtacacacacacacacaggtgcacgtttacaccacgtgggtgcgcacgatgaggcacacacaggcaggcgcgcacacacacgcgtgctcacataggaacacgaagaggcaggagccgggcgtgcccgagccccgtggcgccctgggcatcccaaacaccgcctgcccagaacaggtgcgcagtgagtgcctg

SEQ ID NO: 16348 - DNA, 181 bp, Homo sapiens
  chr19:491311-491492
  hypo
cctttatggtgtttgcgacgtcgtgtaaacaccagctctctagtctcaaacccggcgagggcggttcatagacaatttcagtctctcgacgcgacgccgtgtggcttgtgcccttctagccacctagaccctcgggagaggcctgtgcggctcctggctgggcccccgtcttcaaagcagc

SEQ ID NO: 16349 - DNA, 23 bp, Homo sapiens
  chr19:530233-530256
  hypo
accgtgcccggcctgtatgttga

SEQ ID NO: 16350 - DNA, 30 bp, Homo sapiens
  chr19:548574-548604
  hypo
caccctggacagccccggtctcaccttcca

SEQ ID NO: 16351 - DNA, 319 bp, Homo sapiens
  chr19:549361-549680
  hypo
aggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccaga

SEQ ID NO: 16352 - DNA, 111 bp, Homo sapiens
  chr19:550388-550499
  hypo
tctccctgtaaactgcgattcaggggcctttggtacctgcacagagctgggcaaccaccaccgtgacatgtcaccccagcaccccgaaaacaggcccgtccccagtcaccc

SEQ ID NO: 16353 - DNA, 199 bp, Homo sapiens
  chr19:593150-593349
  hypo
agtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcgg

SEQ ID NO: 16354 - DNA, 30 bp, Homo sapiens
  chr19:599200-599230
  hypo
tttggaccgtttcctcgggatcatttcccc

SEQ ID NO: 16355 - DNA, 197 bp, Homo sapiens
  chr19:752136-752333
  hypo
cccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttg

SEQ ID NO: 16356 - DNA, 632 bp, Homo sapiens; identical to SEQ ID NO: 1629
  chr19:883582-884214
  hypo

SEQ ID NO: 16357 - DNA, 90 bp, Homo sapiens
  chr19:891529-891619
  hypo
cccgaaggaagagcccgcagacaggcaagcggtggggcggctccctgtagccgaggcggggctgagtgacagggaacacctgtggccgag

SEQ ID NO: 16358 - DNA, 163 bp, Homo sapiens
  chr19:900851-901014
  hypo
ccagggcccctcctccgcgccttgctcctgccctcatcctccaggtagcgaagaacccgctcctgctcctccccggagcggttcatgaaatcgttccagacctggaagagaggcagggaggcaggcttgccatgaaacactggggctgcgctgacatccccgg

SEQ ID NO: 16359 - DNA, 157 bp, Homo sapiens
  chr19:955719-955876
  hypo
aggcagggtagaccccgtaataccgggtcagaatctcagaggagaggaccttccgctcgccctggaagggcccaaggtgtgctggcctctacgtgcggttcttagccggggggctgcgtaacgaaggacctcaaaccgcgggcgtaaaacaaacgaa

SEQ ID NO: 16360 - DNA, 237 bp, Homo sapiens
  chr19:1003205-1003442
  hypo
gcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcg

SEQ ID NO: 16361 - DNA, 55 bp, Homo sapiens
  chr19:1003679-1003734
  hypo
gcagccggccgggcccgagtccccggggcgcttcttggcacggtgagtggggacc

SEQ ID NO: 16362 - DNA, 460 bp, Homo sapiens; identical to SEQ ID NO: 1630
  chr19:1004981-1005441
  hypo

SEQ ID NO: 16363 - DNA, 32 bp, Homo sapiens
  chr19:1030092-1030124
  hypo
cctcagtgctgtctccgcggtcactagtggct

SEQ ID NO: 16364 - DNA, 69 bp, Homo sapiens
  chr19:1112645-1112714
  hypo
gcagcgagaggcctgcggggcgcggacaccacccgccacacggccactcgcgcccgcacctggcacaca

SEQ ID NO: 16365 - DNA, 17 bp, Homo sapiens
  chr19:1128414-1128431
  hypo
ggattcttacactgtcg

SEQ ID NO: 16366 - DNA, 30 bp, Homo sapiens
  chr19:1156568-1156598
  hypo
ctcacaacagccacccgaggaagcagccca

SEQ ID NO: 16367 - DNA, 298 bp, Homo sapiens; identical to SEQ ID NO: 5220
  chr19:1171099-1171397
  hypo

SEQ ID NO: 16368 - DNA, 53 bp, Homo sapiens
  chr19:1227555-1227608
  hypo
caggctgacctcttccgtcttccttccaccctgcagcccgtgtccaggagccc

SEQ ID NO: 16369 - DNA, 30 bp, Homo sapiens
  chr19:1236238-1236268
  hypo
gagaggtagcagagccggaggcagcctcca

SEQ ID NO: 16370 - DNA, 35 bp, Homo sapiens
  chr19:1236474-1236509
  hypo
ccaaggcggtgcagccggctcgagaaggactccag

SEQ ID NO: 16371 - DNA, 53 bp, Homo sapiens
  chr19:1274693-1274746
  hypo
ctggagcacgggctgcggtgcgccggcagcttacggggcggccagtccttgcc

SEQ ID NO: 16372 - DNA, 30 bp, Homo sapiens
  chr19:1308187-1308217
  hypo
tggaacgtctcagaccggacccctcccttt

SEQ ID NO: 16373 - DNA, 30 bp, Homo sapiens
  chr19:1325942-1325972
  hypo
acagtggctcaaacccgctgggcacagtgg

SEQ ID NO: 16374 - DNA, 43 bp, Homo sapiens
  chr19:1482018-1482061
  hypo
ggaggtgcagtccctcggggagccgccgcggcaggtgtagcag

SEQ ID NO: 16375 - DNA, 106 bp, Homo sapiens
  chr19:1482370-1482476
  hypo
gtcccgctgcacacacgcgctgctggtcacctgggggcctgtaggccgcgctgtcatgtcctcggccgtcccatagagcagcagcgtgtagcggtacaacgtccct

SEQ ID NO: 16376 - DNA, 68 bp, Homo sapiens
  chr19:1496626-1496694
  hypo
cccggtggctgtggccgggccctccactcccctggaagctgaccgtacgtaaccgctgtggggagata

SEQ ID NO: 16377 - DNA, 186 bp, Homo sapiens
  chr19:1525774-1525960
  hypo
ccatctgcacctcgccgctgccccccgtaccatcctgtgtgccctctgctgtccattcgccagcgcttcttacgcctacgtagggccaattgtgtccatcctttactcacctgggcacacccaggctctcttgatccacctgggcccagcttacgctgtgctcatcaggcccgtctcagactcacc

SEQ ID NO: 16378 - DNA, 30 bp, Homo sapiens
  chr19:1527258-1527288
  hypo
tacagcgtgtgtgggcgcagggcaggtgtg

SEQ ID NO: 16379 - DNA, 30 bp, Homo sapiens
  chr19:1533726-1533756
  hypo
ctacatgcccaactgcgggaggctggaagc

SEQ ID NO: 16380 - DNA, 48 bp, Homo sapiens
  chr19:1799852-1799900
  hypo
gggcatggggccagacgtggctctggttctcaggcaccctgagcccct

SEQ ID NO: 16381 - DNA, 261 bp, Homo sapiens; identical to SEQ ID NO: 1631
  chr19:1808152-1808413
  hypo

SEQ ID NO: 16382 - DNA, 377 bp, Homo sapiens
  chr19:1809512-1809889
  hypo
aaaaccaaaaaaagaaaactatcgagcaaatacaagcagaggcaggactcaggaggagcaaaaaatagattccccgagggtaccacggcagctcctctggagcagggaggcgcgggaggggccgcccaccttgtatttcttcctttgccagcacaggatcaccttctccttgaactgcccgttgtaggcacggttgttggcctggaccttccaggtgaatgctgcagcgagagagccgggcgtcgctggagctcgaggcccaggacaaacacccctaatgaccgcccggaggagggctcatggggcccgtgggacccaggcactggggaggcccgagatgtcagagcccgtaaacagacagtcgggcagcaggcacc

SEQ ID NO: 16383 - DNA, 37 bp, Homo sapiens
  chr19:1912092-1912129
  hypo
ggatggagcccgccccgggcctcgtggagcagcccaa

SEQ ID NO: 16384 - DNA, 79 bp, Homo sapiens
  chr19:1970005-1970084
  hypo
gccgccccgagtcaccggagcctctggtggggccgcccggggtcactggagcctctggcggggccgccccatgtcactg

SEQ ID NO: 16385 - DNA, 35 bp, Homo sapiens
  chr19:1970474-1970509
  hypo
cacaccaacctctcccgggtcggggtctgattgcc

SEQ ID NO: 16386 - DNA, 306 bp, Homo sapiens
  chr19:1978313-1978619
  hypo
ctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtcta

SEQ ID NO: 16387 - DNA, 141 bp, Homo sapiens
  chr19:1993071-1993212
  hypo
ccacgcaatgggcctcgagcgctggcaccgcgtacttcttggcggtgtatagcgtggtcatcaccgtctccgggccaatctgcacctcgtccgagtagagaaacctgcagaagcaacgcgggtggccgtgaggtgggaccg

SEQ ID NO: 16388 - DNA, 55 bp, Homo sapiens
  chr19:2274600-2274655
  hypo
gctcctgagagtgggcggagaacgcagggtaaggagctagcgatggcccagagtg

SEQ ID NO: 16389 - DNA, 124 bp, Homo sapiens
  chr19:2359026-2359150
  hypo
caaacccacttgaggcgtgtcctgcaaaacacctgacctgccttccccaggagcgggcagggtgtcagaaataggaatgtctgggaaactgcgacagcccagagagatccgaggaggcgtgacg

SEQ ID NO: 16390 - DNA, 124 bp, Homo sapiens
  chr19:2363060-2363184
  hypo
tgcagagcctcacgccgcctgcttgtcctgccacgcggaatgggagtccgtgtgtgccccgctgcccacagcgtgtgaacgtgagttggggaccatgtggcccactgcgcgctgggtcccgtcc

SEQ ID NO: 16391 - DNA, 29 bp, Homo sapiens
  chr19:2471700-2471729
  hypo
aaatacggtgactcacgcctgtaattcca

SEQ ID NO: 16392 - DNA, 40 bp, Homo sapiens
  chr19:2513207-2513247
  hypo
gggatccccgcctcacgggcctgcacggaggacctgggcg

SEQ ID NO: 16393 - DNA, 39 bp, Homo sapiens
  chr19:2513455-2513494
  hypo
ggctgcacctgctcccgtccgtgccgcagaggaggacgc

SEQ ID NO: 16394 - DNA, 22 bp, Homo sapiens
  chr19:2524913-2524935
  hypo
gtgcgcacgggagtgcatgtgg

SEQ ID NO: 16395 - DNA, 109 bp, Homo sapiens; identical to SEQ ID NO: 5222
  chr19:2683891-2684000
  hypo

SEQ ID NO: 16396 - DNA, 45 bp, Homo sapiens
  chr19:2899991-2900036
  hypo
aatcaggacactggccgtgcgcggtggctcacgcctgtaatccca

SEQ ID NO: 16397 - DNA, 91 bp, Homo sapiens; identical to SEQ ID NO: 5223
  chr19:3219543-3219634
  hypo

SEQ ID NO: 16398 - DNA, 57 bp, Homo sapiens; identical to SEQ ID NO: 5224
  chr19:3296613-3296670
  hypo

SEQ ID NO: 16399 - DNA, 30 bp, Homo sapiens
  chr19:3562380-3562410
  hypo
tttatgtgctggctgcggaatgccacctga

SEQ ID NO: 16400 - DNA, 75 bp, Homo sapiens
  chr19:3578148-3578223
  hypo
aggcccggatgtgcccgccctggggttccccaggtccgcgagggctgctgggtgggactccgcagcttactagag

SEQ ID NO: 16401 - DNA, 194 bp, Homo sapiens; identical to SEQ ID NO: 5225
  chr19:3778200-3778394
  hypo

SEQ ID NO: 16402 - DNA, 107 bp, Homo sapiens
  chr19:3779159-3779266
  hypo
ggtactccatgccctcggccacgtgcctgggggtagtagggggcagtgggggctcaggtgccaggatgcccacattcagggctcagaaagctcggggtgcctggggc

SEQ ID NO: 16403 - DNA, 89 bp, Homo sapiens
  chr19:3821044-3821133
  hypo
aggcacctctgcagccgtgtggtccagcgagttggccggcagtgtccctgcgtctacggaggccctggagcccacgtgtcaggtccgca

SEQ ID NO: 16404 - DNA, 161 bp, Homo sapiens
  chr19:3855416-3855577
  hypo
cagtcccgggcgatccggcggcagattcattgagtcattggataaatacttcctgggtgctagtggggaccagctgctgtcatgggcgctgtcacagcagcggggaataaccagaccaaagtcccgtcctccaggagggtgctgcgcgatagtccagggag

SEQ ID NO: 16405 - DNA, 30 bp, Homo sapiens
  chr19:4131483-4131513
  hypo
aagaaaagaaaaaggcgggctgggcgcggt

SEQ ID NO: 16406 - DNA, 30 bp, Homo sapiens
  chr19:4512122-4512152
  hypo
ggacggtccctttggcgacattcactgccc

SEQ ID NO: 16407 - DNA, 350 bp, Homo sapiens; identical to SEQ ID NO: 5226
  chr19:4548034-4548384
  hypo

SEQ ID NO: 16408 - DNA, 38 bp, Homo sapiens
  chr19:4555023-4555061
  hypo
gggtgggcctgtccccgaggctgcggtagatgacagca

SEQ ID NO: 16409 - DNA, 216 bp, Homo sapiens; identical to SEQ ID NO: 1632
  chr19:4555896-4556112
  hypo

SEQ ID NO: 16410 - DNA, 202 bp, Homo sapiens
  chr19:4557098-4557300
  hypo
atccacccagctccccggcgcagtgccgcgtccccctggccctacccctccactcccacctgcaccccttcctcaccctctggtaccgcagctccgtggacgtggggggctccagctctacgcggtagaggttgtccctgggggaggggcatagttagtgagaactgggggctccgccaccctctcccgttccatccttccc

SEQ ID NO: 16411 - DNA, 85 bp, Homo sapiens; identical to SEQ ID NO: 5228
  chr19:4670740-4670825
  hypo

SEQ ID NO: 16412 - DNA, 38 bp, Homo sapiens
  chr19:4789994-4790032
  hypo
gagataacaattctgaatgaagacgctgttgaacatct

SEQ ID NO: 16413 - DNA, 90 bp, Homo sapiens
  chr19:4792950-4793040
  hypo
cgctgatcaccgacccggatgagatgcgcatgcaggccctgttgatccgggagcgcatcctcggtccctcgcacccggacacttcctatt

SEQ ID NO: 16414 - DNA, 30 bp, Homo sapiens
  chr19:4800545-4800575
  hypo
tgtcagtcactgctgcgtcctcagcaccca

SEQ ID NO: 16415 - DNA, 30 bp, Homo sapiens
  chr19:5676881-5676911
  hypo
cccctctaacagtgacggtaacaggtgtga

SEQ ID NO: 16416 - DNA, 30 bp, Homo sapiens
  chr19:5759751-5759781
  hypo
ggtccatccgcacatcgcaatatgactcag

SEQ ID NO: 16417 - DNA, 30 bp, Homo sapiens
  chr19:5789897-5789927
  hypo
ccctacaatgtatcccgaggagaatgaaga

SEQ ID NO: 16418 - DNA, 37 bp, Homo sapiens
  chr19:5790176-5790213
  hypo
cctcctccgtctgcccgtccgccgtctgtccatcctc

SEQ ID NO: 16419 - DNA, 19 bp, Homo sapiens
  chr19:5826127-5826146
  hypo
agagcgagactccgtctca

SEQ ID NO: 16420 - DNA, 102 bp, Homo sapiens; identical to SEQ ID NO: 5229
  chr19:5914992-5915094
  hypo

SEQ ID NO: 16421 - DNA, 30 bp, Homo sapiens
  chr19:5915421-5915451
  hypo
agccacaccacagagcggggaggggcaggt

SEQ ID NO: 16422 - DNA, 30 bp, Homo sapiens
  chr19:5915925-5915955
  hypo
gctgggagctctgggcgggggcagaccggc

SEQ ID NO: 16423 - DNA, 188 bp, Homo sapiens
  chr19:6358262-6358450
  hypo
atgccggctttccaccgtgaggccctgcctgccagcgctggctgccatgtgggctttctgctttgcggacctgcaaggtattctcctaactctgtcaccttcaactccctccctctgtcttactcctgattctacaaaactgggagtgtctgtgtccccttctatctccccatcggactgcagtcccc

SEQ ID NO: 16424 - DNA, 35 bp, Homo sapiens
  chr19:7727784-7727819
  hypo
tgacaagggccaactcgtcccgggcaagggcagca

SEQ ID NO: 16425 - DNA, 30 bp, Homo sapiens
  chr19:8009581-8009611
  hypo
gaggcagcttggccccggagagcatgcatt

SEQ ID NO: 16426 - DNA, 99 bp, Homo sapiens
  chr19:8475426-8475525
  hypo
aaagaaaatcaccatttggttgctattatggtaataactgactcaggcaagggtcatcaattgatattaagctcttggaaacggcgtgtgttgaggaac

SEQ ID NO: 16427 - DNA, 49 bp, Homo sapiens
  chr19:8576903-8576952
  hypo
ctgtgcaatgccacccgcccttcgagcgtgggaacggagcctgggcact

SEQ ID NO: 16428 - DNA, 24 bp, Homo sapiens
  chr19:9937362-9937386
  hypo
aaaatcccacggccggggaaatca

SEQ ID NO: 16429 - DNA, 41 bp, Homo sapiens; identical to SEQ ID NO: 1633
  chr19:10231201-10231242
  hypo

SEQ ID NO: 16430 - DNA, 30 bp, Homo sapiens
  chr19:10231504-10231534
  hypo
aaagaaaccaaagttcggggaaaacaatcc

SEQ ID NO: 16431 - DNA, 68 bp, Homo sapiens
  chr19:10370372-10370440
  hypo
ctctggcaggactcacgttacagacccctctaccccttcagcctgccctacagcgacttcccccgacc

SEQ ID NO: 16432 - DNA, 151 bp, Homo sapiens
  chr19:10562153-10562304
  hypo
gctacgcatttgcagcgctggggtgttgggaatagattctgaagagtggcacgccagtgtgtacttgtgtaggtgtataggtttgcacgggtaattatgcagggttataggtgtgtggggctgtgccagaggggtgcgcatgtctgcaggg

SEQ ID NO: 16433 - DNA, 30 bp, Homo sapiens
  chr19:10570365-10570395
  hypo
ccataacagcctgcacgcagctgacgtgct

SEQ ID NO: 16434 - DNA, 18 bp, Homo sapiens
  chr19:10711942-10711960
  hypo
acccggcctgttttcacc

SEQ ID NO: 16435 - DNA, 204 bp, Homo sapiens
  chr19:10875903-10876107
  hypo
gattacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggg

SEQ ID NO: 16436 - DNA, 30 bp, Homo sapiens
  chr19:10954418-10954448
  hypo
gcatggtgggagacacgggacactgcaggt

SEQ ID NO: 16437 - DNA, 30 bp, Homo sapiens
  chr19:11002992-11003022
  hypo
tgctggggaagtgcccgttcagggccatgg

SEQ ID NO: 16438 - DNA, 30 bp, Homo sapiens
  chr19:11005335-11005365
  hypo
gtggcctttctcccccgagctgctgctgct

SEQ ID NO: 16439 - DNA, 25 bp, Homo sapiens
  chr19:11008369-11008394
  hypo
atgctagctctgggccgggcacggt

SEQ ID NO: 16440 - DNA, 30 bp, Homo sapiens
  chr19:11252737-11252767
  hypo
cagaaacaccagttacgagcagggggctgg

SEQ ID NO: 16441 - DNA, 23 bp, Homo sapiens
  chr19:12220425-12220448
  hypo
cacacaaacgtttttatgtttga

SEQ ID NO: 16442 - DNA, 30 bp, Homo sapiens
  chr19:12222728-12222758
  hypo
agtttctgtgcctttcgataccatcaaagg

SEQ ID NO: 16443 - DNA, 152 bp, Homo sapiens
  chr19:12863419-12863571
  hypo
acacagcccgagtggcgaacgcccgcttcggtggcttctcccagctgctgctactgtggcgtgggagcatctacaaactcctgtggcgagagctgctctgcttccttgggttctacatggcgctgagtgctgcctaccggtgaggctgccct

SEQ ID NO: 16444 - DNA, 30 bp, Homo sapiens
  chr19:13335742-13335772
  hypo
tttctcttggtggcccgcagggagggcaca

SEQ ID NO: 16445 - DNA, 30 bp, Homo sapiens
  chr19:13781908-13781938
  hypo
caaccaaatttggcccgtgggccataattt

SEQ ID NO: 16446 - DNA, 20 bp, Homo sapiens
  chr19:13988706-13988726
  hypo
agttgattttatttacgtat

SEQ ID NO: 16447 - DNA, 50 bp, Homo sapiens
  chr19:14181305-14181355
  hypo
gtggcaggtgcctcccgccaggagaacggcgccagcgtgatcctccatga

SEQ ID NO: 16448 - DNA, 40 bp, Homo sapiens
  chr19:14327052-14327092
  hypo
attatacaggtcagccgggcgcagtgactcatgcctgtaa

SEQ ID NO: 16449 - DNA, 36 bp, Homo sapiens
  chr19:14630627-14630663
  hypo
caattgtaggcaacacgatcgcgtttggctctgaaa

SEQ ID NO: 16450 - DNA, 30 bp, Homo sapiens
  chr19:15237724-15237754
  hypo
gaatttgagaccaaccggggccaaaaagtg

SEQ ID NO: 16451 - DNA, 30 bp, Homo sapiens
  chr19:15292289-15292319
  hypo
aggactcccccaagtcgttgctgtccccac

SEQ ID NO: 16452 - DNA, 136 bp, Homo sapiens
  chr19:16275694-16275830
  hypo
acgcacaaatgtagtcgtcgttgttaaaatctgcagagcaggatggatggggagtgacagcaggtggcaggagggctaggccggctgtgggcacatactgtgcccatgttacaagaaggggaaactaaggtcgggc

SEQ ID NO: 16453 - DNA, 30 bp, Homo sapiens
  chr19:16638285-16638315
  hypo
gccaaccaggccccacgggcaagggggaaa

SEQ ID NO: 16454 - DNA, 30 bp, Homo sapiens
  chr19:16638706-16638736
  hypo
tcacttgacctgtcccggagccacaggaag

SEQ ID NO: 16455 - DNA, 50 bp, Homo sapiens
  chr19:16939668-16939718
  hypo
agcaaaaattcaccacgcaaggccctatattagggcgctgggggctcata

SEQ ID NO: 16456 - DNA, 30 bp, Homo sapiens
  chr19:17365715-17365745
  hypo
aaagagggaagtgaccggtgttcctggcag

SEQ ID NO: 16457 - DNA, 25 bp, Homo sapiens
  chr19:17379245-17379270
  hypo
tttttttttttgagacggagtttcg

SEQ ID NO: 16458 - DNA, 30 bp, Homo sapiens
  chr19:17404772-17404802
  hypo
aattatataggtcaccggtctcatacaaat

SEQ ID NO: 16459 - DNA, 164 bp, Homo sapiens
  chr19:17405108-17405272
  hypo
ctggtcttcctccaccggcacaaacttatcgtgcatgccgtggacaagcaggacgggcacggtgagctcggcgtggtagacctcgtcgccctcgggccagtactggccgctcatcatggcccggagtacgaaggatgacacgttgaaagcgttgccctccttta

SEQ ID NO: 16460 - DNA, 75 bp, Homo sapiens
  chr19:17759263-17759338
  hypo
ggtcctggcacttctcgtggcacttgacaccgcactcggtgcagcgcatgccctgcctcgcgatgccccacagca

SEQ ID NO: 16461 - DNA, 30 bp, Homo sapiens
  chr19:17836551-17836581
  hypo
ggatgagggtgtcctcgcccagttttccca

SEQ ID NO: 16462 - DNA, 96 bp, Homo sapiens
  chr19:18041146-18041242
  hypo
agccaccgcgcccggcctttaataatctttttacctagaaggcgggggaacctgctgggaattggcgaaaactagcagtcacgccctttggccagg

SEQ ID NO: 16463 - DNA, 144 bp, Homo sapiens
  chr19:18054338-18054482
  hypo
cggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaac

SEQ ID NO: 16464 - DNA, 30 bp, Homo sapiens
  chr19:18054810-18054840
  hypo
gtgggtggggagaggcgggcgaagaatggg

SEQ ID NO: 16465 - DNA, 176 bp, Homo sapiens
  chr19:18092619-18092795
  hypo
gtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcag

SEQ ID NO: 16466 - DNA, 41 bp, Homo sapiens
  chr19:18103700-18103741
  hypo
acctccccagagcaacggcagcccctcggccatctgggaac

SEQ ID NO: 16467 - DNA, 88 bp, Homo sapiens
  chr19:18104430-18104518
  hypo
gggctcagctcctgccggaggagggcacaaggacccgctgtgggctgagtgcagtggcgggcggatcgcttgagctcaggagtttgag

SEQ ID NO: 16468 - DNA, 47 bp, Homo sapiens
  chr19:18207919-18207966
  hypo
ggtgagatcctcactcgcctcaccctagaacccgttctgctgtgtgt

SEQ ID NO: 16469 - DNA, 18 bp, Homo sapiens
  chr19:18298268-18298286
  hypo
acaggcataagccaccga

SEQ ID NO: 16470 - DNA, 200 bp, Homo sapiens
  chr19:18330991-18331191
  hypo
gtactcctaaaatgtcgtccaggcagtgactcaacaaagctcacccaggaaggtccgggagatgtactcggacacctggttcccggagcggctggtttcggacaggtgggtcaactcccggttcaggatccgcttgaactggggcggagagaaggtgaagaccgtgatgatggggcaccgtgggccgaggcaggtgagct

SEQ ID NO: 16471 - DNA, 30 bp, Homo sapiens
  chr19:18383321-18383351
  hypo
tctggatccagggctcgggcaggcttcacc

SEQ ID NO: 16472 - DNA, 42 bp, Homo sapiens
  chr19:18788397-18788439
  hypo
ataagcatgtggagccgccaggaggagggtatttttttttta

SEQ ID NO: 16473 - DNA, 30 bp, Homo sapiens
  chr19:18883509-18883539
  hypo
cactgcctgtagccccgtgttctggaggca

SEQ ID NO: 16474 - DNA, 65 bp, Homo sapiens
  chr19:18883973-18884038
  hypo
atagggacatcagtacggggctctcaggggcagatggttctaggtggagccgagacctgccttcc

SEQ ID NO: 16475 - DNA, 83 bp, Homo sapiens
  chr19:18988902-18988985
  hypo
cttccctgaaaccatcgttcccacgtcaccgatggcccccaccggccaaatcagagggcctggctggtcggcaccttccaggg

SEQ ID NO: 16476 - DNA, 557 bp, Homo sapiens; identical to SEQ ID NO: 1634
  chr19:18989724-18990281
  hypo

SEQ ID NO: 16477 - DNA, 230 bp, Homo sapiens
  chr19:18994850-18995080
  hypo
gtgtgggctgtgcctcggccccctgccacccgatcctgtccttaccggaaggcgtaggaggagacgatgaggatgagagtgaccacgtggtggagcagcatgaccaccgagtccttgcgccaggtgtccatgtatagcgtagcgtagatggagtggccatagaagcttccctggagcaggtaggcggctgcaatgtcccgtggcactgccatgcccggcgtccagtctgg

SEQ ID NO: 16478 - DNA, 138 bp, Homo sapiens
  chr19:19218614-19218752
  hypo
ggcttcgggaggagccgagagcctctgtggctcctccctgtgcctgggaggcctgagtcccacctgctgggctgctctgtcctggcaggtacagcaacatctttcatgtcttcatccgcatctcgagagaagaggggc

SEQ ID NO: 16479 - DNA, 30 bp, Homo sapiens
  chr19:19335195-19335225
  hypo
cccacaggaactctacgatgtgtattgctt

SEQ ID NO: 16480 - DNA, 30 bp, Homo sapiens
  chr19:22017749-22017779
  hypo
aaaaaaaaaatagcccggctcggtggctat

SEQ ID NO: 16481 - DNA, 46 bp, Homo sapiens
  chr19:30555362-30555408
  hypo
ggcacctgcccagggcggcccactgtgctcccggcagccctcctga

SEQ ID NO: 16482 - DNA, 47 bp, Homo sapiens
  chr19:30637506-30637553
  hypo
cagcgagactcgatgcgaaggcaaggcaagcacgtgacatccagtac

SEQ ID NO: 16483 - DNA, 30 bp, Homo sapiens
  chr19:31587530-31587560
  hypo
ctcacctgagcctggcgctgccctccattt

SEQ ID NO: 16484 - DNA, 38 bp, Homo sapiens
  chr19:32364365-32364403
  hypo
gcagccctatggccccgggcatgcgcttctcttcttcc

SEQ ID NO: 16485 - DNA, 30 bp, Homo sapiens
  chr19:32672333-32672363
  hypo
agcggctggtgagtgcgcttgcacacaaaa

SEQ ID NO: 16486 - DNA, 30 bp, Homo sapiens
  chr19:32835111-32835141
  hypo
tctcttaccttttatcgaaaaaaaaattac

SEQ ID NO: 16487 - DNA, 30 bp, Homo sapiens
  chr19:33415273-33415303
  hypo
ccattagccacaacacgaggtctgtcgctg

SEQ ID NO: 16488 - DNA, 25 bp, Homo sapiens
  chr19:33557305-33557330
  hypo
cgcacccggccgtggagcacggttc

SEQ ID NO: 16489 - DNA, 30 bp, Homo sapiens
  chr19:34263853-34263883
  hypo
cgcccaccagtacttcgcccaactctcggc

SEQ ID NO: 16490 - DNA, 30 bp, Homo sapiens
  chr19:35615979-35616009
  hypo
gatgaacgtggcccacggtcagcagctcac

SEQ ID NO: 16491 - DNA, 162 bp, Homo sapiens
  chr19:35616256-35616418
  hypo
ttgtcaggctcaaggcggaggacctggctgaaggcgaagtcgctgcctaggatggccagctggtccctggcgatgagcagtggctggaagacgtgggcaccgcgcgagggaagttgctgcagcagacgaaacatggagccgtcccagcgcatgacctgtggg

SEQ ID NO: 16492 - DNA, 85 bp, Homo sapiens
  chr19:35781374-35781459
  hypo
gacagggcacctgcccgccagtcacaggtcctgtcacccagccccttcctctcatgggctccagccgcctcgctcccacaggtct

SEQ ID NO: 16493 - DNA, 37 bp, Homo sapiens
  chr19:35797909-35797946
  hypo
aaaagatactaagcacgtgcaccggcagggtgtcggc

SEQ ID NO: 16494 - DNA, 344 bp, Homo sapiens
  chr19:36221572-36221916
  hypo
cccaagcatcctaaccgtcttatcccacatgccaggtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcaggtgtggctttggctctgtcttcttcctgaataccgctctccctaaacaaacctacagatctctgttccccgctcccttttggaaagtccaggaggcttgcttttgcttcagttgctgtaatgtaacggcagctcgcttactgccatgc

SEQ ID NO: 16495 - DNA, 50 bp, Homo sapiens
  chr19:36222432-36222482
  hypo
gtaatggagagcctccgggccggggcgggcgggagcgtctgatgtggctt

SEQ ID NO: 16496 - DNA, 30 bp, Homo sapiens
  chr19:36250123-36250153
  hypo
atcctgaatgtgcaacggtgcttcatggaa

SEQ ID NO: 16497 - DNA, 169 bp, Homo sapiens
  chr19:36604561-36604730
  hypo
gatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaat

SEQ ID NO: 16498 - DNA, 100 bp, Homo sapiens
  chr19:37702069-37702169
  hypo
ggttataggcgtgagccaccgcctccggctgttatatttacaatacctaagttaccccttggttacggcacactgcagaaaacaacgatttactaggaga

SEQ ID NO: 16499 - DNA, 36 bp, Homo sapiens
  chr19:38481038-38481074
  hypo
agccagtgagacaggcggggtcgtggggtgaatacc

SEQ ID NO: 16500 - DNA, 20 bp, Homo sapiens
  chr19:38828365-38828385
  hypo
tttatttttttgagacggag

SEQ ID NO: 16501 - DNA, 138 bp, Homo sapiens
  chr19:38905584-38905722
  hypo
ttgggtaggtgcaggcggccgtcaggcaacctgtcgggctgtgcctcatgcagggacaccaggtccttgaggtgcacgcccagtacaggcagccggaaacccgcgcagccagcccaggtgcggcggtagcgggcgtag

SEQ ID NO: 16502 - DNA, 30 bp, Homo sapiens
  chr19:38974232-38974262
  hypo
tcctcaacacaaccccgggattccagacta

SEQ ID NO: 16503 - DNA, 47 bp, Homo sapiens
  chr19:38998362-38998409
  hypo
acatggaactggactcgtcttccattgaaaagcggtttgcctttggc

SEQ ID NO: 16504 - DNA, 30 bp, Homo sapiens
  chr19:39330221-39330251
  hypo
acttcacctgtgttacgaactactctaagt

SEQ ID NO: 16505 - DNA, 26 bp, Homo sapiens
  chr19:39392993-39393019
  hypo
gccaccgcgcccggcctcattttatt

SEQ ID NO: 16506 - DNA, 39 bp, Homo sapiens
  chr19:39646149-39646188
  hypo
aaccaagcagccctccggaggcctcgaggggaacagaca

SEQ ID NO: 16507 - DNA, 189 bp, Homo sapiens
  chr19:40218707-40218896
  hypo
actagttctgccacccgggatccacattgacatatgtgggaagatgcacagctgcttcatcagaggcgctactgtgtgaggaggaaccttcccatgcacagaaggccacatgcatgttcacagctcaacacccagtcacatcgcagcacacacacccacagtcacacagagccacgccaatcactgagt

SEQ ID NO: 16508 - DNA, 31 bp, Homo sapiens
  chr19:40951175-40951206
  hypo
aatattattttttgccgggcgcagtggcgca

SEQ ID NO: 16509 - DNA, 49 bp, Homo sapiens
  chr19:41062945-41062994
  hypo
ctcagagtttgccagcgagacaggtatggcagggcgggaacggctggca

SEQ ID NO: 16510 - DNA, 120 bp, Homo sapiens; identical to SEQ ID NO: 1635
  chr19:41881475-41881595
  hypo

SEQ ID NO: 16511 - DNA, 31 bp, Homo sapiens
  chr19:42202366-42202397
  hypo
aagaataaaatcagccgggcgcggtggctca

SEQ ID NO: 16512 - DNA, 127 bp, Homo sapiens
  chr19:42349306-42349433
  hypo
tcgcgggccccttggcgcgttcccggttccccactcgctccctggggcacgggaaggggggagggggacatgcatgaaattaattgttggtagtggccacaggagcaggaagcgctggacacagtga

SEQ ID NO: 16513 - DNA, 30 bp, Homo sapiens
  chr19:42373877-42373907
  hypo
ccaaagcccatacttcgtcaggtagactta

SEQ ID NO: 16514 - DNA, 44 bp, Homo sapiens
  chr19:42408203-42408247
  hypo
gaagaaattggtccacgagggcccactgacgtggcgggtgacta

SEQ ID NO: 16515 - DNA, 30 bp, Homo sapiens
  chr19:42408664-42408694
  hypo
tggaggtgggcagggcggggccaggcctag

SEQ ID NO: 16516 - DNA, 19 bp, Homo sapiens
  chr19:42579050-42579069
  hypo
tttcagatggagtctcgct

SEQ ID NO: 16517 - DNA, 33 bp, Homo sapiens
  chr19:45381918-45381951
  hypo
cccccgacctgaccacgccggcctagggttcca

SEQ ID NO: 16518 - DNA, 30 bp, Homo sapiens
  chr19:45626698-45626728
  hypo
ccctgtcttgaagttcgagaaggctgcatt

SEQ ID NO: 16519 - DNA, 30 bp, Homo sapiens
  chr19:45709152-45709182
  hypo
ctcaacatcctcagtcgttagagaaacgca

SEQ ID NO: 16520 - DNA, 131 bp, Homo sapiens
  chr19:45810015-45810146
  hypo
gggcggggatcatgtcgtcaatggactggcctttctccaacttcttctccatttccaccatgagcttcacaccatccaccaccagctgcacctgttctacttcggacgagcccagccgatcagcgttggac

SEQ ID NO: 16521 - DNA, 21 bp, Homo sapiens
  chr19:45835239-45835260
  hypo
acagagcgagactacgtctca

SEQ ID NO: 16522 - DNA, 158 bp, Homo sapiens
  chr19:45997445-45997603
  hypo
gaattctaattggtccgtgctatcgaggcactgtccccttactggctctcgctccagtggcccccactgcttttcttcctcttccagcaatggctcttcgggcccagagttcgaatctcgcgatcgggatggggacggagtaccggcctggggtgtcc

SEQ ID NO: 16523 - DNA, 44 bp, Homo sapiens; identical to SEQ ID NO: 5233
  chr19:46234843-46234887
  hypo

SEQ ID NO: 16524 - DNA, 48 bp, Homo sapiens
  chr19:46321351-46321399
  hypo
ggccagcacctctgacgtgtacacgttccgctccgcaaagcacaggtt

SEQ ID NO: 16525 - DNA, 52 bp, Homo sapiens
  chr19:46327091-46327143
  hypo
cagcaggagcagctccggggagttcatgcccattcctcggatctagaggcag

SEQ ID NO: 16526 - DNA, 80 bp, Homo sapiens
  chr19:46404534-46404614
  hypo
gcacgtcggtcctcccggcggtcttccgacaacacgtagcgctgagggcaggcgcttgggggcggcggctgtgaagaggg

SEQ ID NO: 16527 - DNA, 30 bp, Homo sapiens
  chr19:47200506-47200536
  hypo
aagagtcacgtgaaccgccagactttcctg

SEQ ID NO: 16528 - DNA, 44 bp, Homo sapiens
  chr19:47429440-47429484
  hypo
ctataaaactggagtcggagtgagggaatcgctttcatttctcc

SEQ ID NO: 16529 - DNA, 42 bp, Homo sapiens
  chr19:48003498-48003540
  hypo
tctcagaatcctccccgccccccacaccgctcccttctgcat

SEQ ID NO: 16530 - DNA, 52 bp, Homo sapiens
  chr19:48151322-48151374
  hypo
cgtctgccttctctccgtctccctgttttcctgttaccgtctccccgtccct

SEQ ID NO: 16531 - DNA, 22 bp, Homo sapiens
  chr19:48614830-48614852
  hypo
aagcccagcactaagcgtcatc

SEQ ID NO: 16532 - DNA, 218 bp, Homo sapiens
  chr19:49119132-49119350
  hypo
cttggtgtggctgtgcggggttcctggggccttgccgaaatgccggtacacctctcggcccttgcgaggacctagggaaggggaaggagaaccgggtgagacagggatctggcgcccagcttctggcctcccagatccaggagggtgaaggctgccagtagccacacagctcagtccaaacccgtcgaccacgtatcactcaccggagagcaggacag

SEQ ID NO: 16533 - DNA, 26 bp, Homo sapiens
  chr19:49402376-49402402
  hypo
gaggtagacaccgtctcaaaaaaaaa

SEQ ID NO: 16534 - DNA, 31 bp, Homo sapiens
  chr19:50049718-50049749
  hypo
tgagtagagttgggccgtgtgcggtgactca

SEQ ID NO: 16535 - DNA, 30 bp, Homo sapiens
  chr19:50053089-50053119
  hypo
atccacactgtagcccgtgtcaggacgtca

SEQ ID NO: 16536 - DNA, 75 bp, Homo sapiens
  chr19:50166634-50166709
  hypo
tgagggtccttgctccggtcctctgctaaacgcaacccttctttgcggttgagggcagagcggaaattcctcttc

SEQ ID NO: 16537 - DNA, 30 bp, Homo sapiens
  chr19:50216075-50216105
  hypo
ctatgtttcctcaggcggtggattcgggcc

SEQ ID NO: 16538 - DNA, 136 bp, Homo sapiens
  chr19:50216693-50216829
  hypo
gcagcacattgaggacgcactgctggatgtggcctccctgttccaggcgggacagcattttaagcgccggttcagagggtcagggaaggagaactccaggcacaggtgtggatttctctcccgccagactggggcc

SEQ ID NO: 16539 - DNA, 16 bp, Homo sapiens
  chr19:50320037-50320053
  hypo
ccggccctggtcaggt

SEQ ID NO: 16540 - DNA, 30 bp, Homo sapiens
  chr19:50353152-50353182
  hypo
aacactgatgactcccgaatttctctctcc

SEQ ID NO: 16541 - DNA, 30 bp, Homo sapiens
  chr19:50353514-50353544
  hypo
ctctccccagtggaccgtggggcctgtgag

SEQ ID NO: 16542 - DNA, 90 bp, Homo sapiens
  chr19:50364908-50364998
  hypo
agcagcggcaggggacgcccgcggctcgggcacactggacgtacctgtgggggaaggagctggatgtgcaggccccgcccaccccgccgc

SEQ ID NO: 16543 - DNA, 47 bp, Homo sapiens
  chr19:50938644-50938691
  hypo
tgctcccagccctcccggggctccctggcacccgcaggcagagccca

SEQ ID NO: 16544 - DNA, 35 bp, Homo sapiens
  chr19:51046474-51046509
  hypo
tcatgcaggtggcagcgcggcgggggacagatgac

SEQ ID NO: 16545 - DNA, 23 bp, Homo sapiens
  chr19:52512149-52512172
  hypo
ggttgggaaagaggccgggcgcg

SEQ ID NO: 16546 - DNA, 38 bp, Homo sapiens
  chr19:53028928-53028966
  hypo
ttatttatttagagacggaatctcttctgtcgcccagg

SEQ ID NO: 16547 - DNA, 30 bp, Homo sapiens
  chr19:54033359-54033389
  hypo
aagtgggagcaggcacgtcacatggcaaaa

SEQ ID NO: 16548 - DNA, 16 bp, Homo sapiens
  chr19:55727832-55727848
  hypo
gcgattagatcattga

SEQ ID NO: 16549 - DNA, 151 bp, Homo sapiens
  chr19:58457421-58457572
  hypo
tcttctcttgggagccgtggccactgccaaactacactgtcttttacataccttgccttcatgaccacttactctatcatcatcctcccagtcttggcccactaacagctttacaaccaaaacctggagcttgccccgcctaactgtgacc

SEQ ID NO: 16550 - DNA, 30 bp, Homo sapiens
  chr19:58891154-58891184
  hypo
catggaggttgcacacggcacaatgaggtc

SEQ ID NO: 16551 - DNA, 23 bp, Homo sapiens
  chr19:58964230-58964253
  hypo
gtgggaaagaaattgcgggagcg

SEQ ID NO: 16552 - DNA, 73 bp, Homo sapiens
  chr20:399996-400069
  hypo
gcttcaaggacctcacgctgcagccgcggggccctctggagccaggccccccaaagcccggggtcccccagga

SEQ ID NO: 16553 - DNA, 411 bp, Homo sapiens; identical to SEQ ID NO: 5234
  chr20:401582-401993
  hypo

SEQ ID NO: 16554 - DNA, 43 bp, Homo sapiens; identical to SEQ ID NO: 5235
  chr20:799104-799147
  hypo

SEQ ID NO: 16555 - DNA, 43 bp, Homo sapiens; identical to SEQ ID NO: 5236
  chr20:799687-799730
  hypo

SEQ ID NO: 16556 - DNA, 41 bp, Homo sapiens
  chr20:1323452-1323493
  hypo
caggacacccaaacacgtatgcaatgcgtacactggaagtt

SEQ ID NO: 16557 - DNA, 30 bp, Homo sapiens
  chr20:1692274-1692304
  hypo
aacggcgggaagacccgtgaatgcacttcc

SEQ ID NO: 16558 - DNA, 147 bp, Homo sapiens; identical to SEQ ID NO: 5237
  chr20:2113428-2113575
  hypo

SEQ ID NO: 16559 - DNA, 30 bp, Homo sapiens
  chr20:2444402-2444432
  hypo
ggcccgccaaccccacggactggcccagca

SEQ ID NO: 16560 - DNA, 32 bp, Homo sapiens
  chr20:2645508-2645540
  hypo
aacatagggagacctcgactctacaaaaaatt

SEQ ID NO: 16561 - DNA, 43 bp, Homo sapiens; identical to SEQ ID NO: 1636
  chr20:3027758-3027801
  hypo

SEQ ID NO: 16562 - DNA, 91 bp, Homo sapiens
  chr20:3202418-3202509
  hypo
ggccactgccctcctcgtgcttgtcctctggacccagttacacacctgtcccccctttcctgtggcagggccggatcgtggcacccagagg

SEQ ID NO: 16563 - DNA, 92 bp, Homo sapiens
  chr20:3204883-3204975
  hypo
ctcgaccccactcggcgtgatcgccacagttcagcctgcgggctgcaggcccctcgggaggccctgcttatgccacacgcccttactctgtg

SEQ ID NO: 16564 - DNA, 30 bp, Homo sapiens
  chr20:3763473-3763503
  hypo
ccagggctcggatttcgggagggaaggtgg

SEQ ID NO: 16565 - DNA, 105 bp, Homo sapiens
  chr20:3820924-3821029
  hypo
ccactgcactccagtcgctgcactctcgccaaaaacaaaaacaaataaatatgattgagtattaccataggctctggttcctgccctgagggaaggtgagttaaa

SEQ ID NO: 16566 - DNA, 33 bp, Homo sapiens
  chr20:4690739-4690772
  hypo
agatctaaaactttacgccggatcatgttcctc

SEQ ID NO: 16567 - DNA, 30 bp, Homo sapiens
  chr20:5762556-5762586
  hypo
tttcaacaaccggcacgactgtacaggtgc

SEQ ID NO: 16568 - DNA, 20 bp, Homo sapiens
  chr20:16554697-16554717
  hypo
taagggagttaaaggcgaac

SEQ ID NO: 16569 - DNA, 139 bp, Homo sapiens; identical to SEQ ID NO: 5240
  chr20:16555017-16555156
  hypo

SEQ ID NO: 16570 - DNA, 40 bp, Homo sapiens
  chr20:18233341-18233381
  hypo
ccaggttttgttttccgagtcttggcgtccccagccaaag

SEQ ID NO: 16571 - DNA, 30 bp, Homo sapiens
  chr20:19674013-19674043
  hypo
cgtttgcttcctccacgctgtggatcgcag

SEQ ID NO: 16572 - DNA, 120 bp, Homo sapiens
  chr20:24571035-24571155
  hypo
tgggataagaagcctcgggggtttgagcggaggagaagcccctgtggccacatgctcccgggagccttcagagaacagggcggagggggaggcgcagggcgacgacggcagtggtcaaac

SEQ ID NO: 16573 - DNA, 20 bp, Homo sapiens
  chr20:25230509-25230529
  hypo
agtcttgccctgtagcgtga

SEQ ID NO: 16574 - DNA, 19 bp, Homo sapiens
  chr20:25230769-25230788
  hypo
ccaacgcacccgacccgca

SEQ ID NO: 16575 - DNA, 30 bp, Homo sapiens
  chr20:30101713-30101743
  hypo
aggcgtgagccactgcgcccagcccatttt

SEQ ID NO: 16576 - DNA, 18 bp, Homo sapiens
  chr20:30468303-30468321
  hypo
tttttttttttgagacgg

SEQ ID NO: 16577 - DNA, 153 bp, Homo sapiens; identical to SEQ ID NO: 5243
  chr20:30864866-30865019
  hypo

SEQ ID NO: 16578 - DNA, 165 bp, Homo sapiens
  chr20:31115652-31115817
  hypo
aatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccg

SEQ ID NO: 16579 - DNA, 160 bp, Homo sapiens
  chr20:32242529-32242689
  hypo
tttacagggaatggacggggtgggagccaggtaaagaagttgctgcagtcttccacgccagagaggacggtggccctgacttgggggctggggcgaggcacaatggtggggatggcaggctacagatgaggtgggctcgtgagatcgacagacaaggcag

SEQ ID NO: 16580 - DNA, 152 bp, Homo sapiens
  chr20:32450366-32450518
  hypo
cgagccaccgcgcccggctggcttgtgtttatttaaggaatggaagcgttcactcaagccagacttcaggggcaaatgtacattgggaatctccaagggacatctcccaaactacctgaccagggtgtgggttccgccgaatatcttttggg

SEQ ID NO: 16581 - DNA, 30 bp, Homo sapiens
  chr20:32524318-32524348
  hypo
tgtacagatgagctgcgtgcatttgggaaa

SEQ ID NO: 16582 - DNA, 30 bp, Homo sapiens
  chr20:33134914-33134944
  hypo
gcagggaaggtgcctcgcaggagaggagag

SEQ ID NO: 16583 - DNA, 30 bp, Homo sapiens
  chr20:33547626-33547656
  hypo
ctttattgatctggtcgctaagtgtcaggt

SEQ ID NO: 16584 - DNA, 30 bp, Homo sapiens
  chr20:33866905-33866935
  hypo
ctccctgccagcatccggtacagattgggc

SEQ ID NO: 16585 - DNA, 64 bp, Homo sapiens
  chr20:34148190-34148254
  hypo
ccgctctcagcaccacggagggcctggggtcggggctctggactcagcccgagggcccacaccc

SEQ ID NO: 16586 - DNA, 67 bp, Homo sapiens
  chr20:35089090-35089157
  hypo
tgaggagaggggactcgcggggtagaagccaggaactgggaaggcgaggaggcgtgaaggcaccacc

SEQ ID NO: 16587 - DNA, 34 bp, Homo sapiens
  chr20:35924375-35924409
  hypo
gaactagatgagagccgtacggcgcacagtgtgt

SEQ ID NO: 16588 - DNA, 39 bp, Homo sapiens
  chr20:36151122-36151161
  hypo
caggtgttgggggagcgcaggcagcgagcccccaactga

SEQ ID NO: 16589 - DNA, 30 bp, Homo sapiens
  chr20:36571234-36571264
  hypo
gtcaaagtacaaagacgaatataacaaaca

SEQ ID NO: 16590 - DNA, 102 bp, Homo sapiens; identical to SEQ ID NO: 1637
  chr20:42218592-42218694
  hypo

SEQ ID NO: 16591 - DNA, 128 bp, Homo sapiens
  chr20:43065628-43065756
  hypo
accagcatcatttgccgtaaataagaggtgactgcaaaattagtgaaaagaaaacaatgtttttcagctgcagccaggtggaatcgccccagggaaagctctgctcttgttttcgtattaaaaaggaa

SEQ ID NO: 16592 - DNA, 24 bp, Homo sapiens
  chr20:43952320-43952344
  hypo
gagtttcaccgtgttagccaggat

SEQ ID NO: 16593 - DNA, 32 bp, Homo sapiens
  chr20:44601522-44601554
  hypo
gggcgctgtgagtcacgcctgtaattccaaca

SEQ ID NO: 16594 - DNA, 300 bp, Homo sapiens
  chr20:44601794-44602094
  hypo
gcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaactcctaagcaggctgggcgcgg

SEQ ID NO: 16595 - DNA, 120 bp, Homo sapiens
  chr20:44602334-44602454
  hypo
cctggggaacaacagcggaaactcttgtctcaaacaaacaaacaaaaagtcctaaggagaagacctattaataaggagaaaaggtccgggctcggtgggtcacacctgtaataaccagca

SEQ ID NO: 16596 - DNA, 30 bp, Homo sapiens
  chr20:44756572-44756602
  hypo
gcaaatatttccaaacgttaagaaaatgtt

SEQ ID NO: 16597 - DNA, 217 bp, Homo sapiens
  chr20:45337804-45338021
  hypo
gtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttct

SEQ ID NO: 16598 - DNA, 95 bp, Homo sapiens
  chr20:46013566-46013661
  hypo
cagtactaaagctatagtgttgtgatgagagtccggcgtgctccctgaatgccggtgcccgattcataacctagtgcattcgttcacacattatt

SEQ ID NO: 16599 - DNA, 68 bp, Homo sapiens
  chr20:47247201-47247269
  hypo
gtcctgactcctgagcgccccaccctgcccaagctccctgcagcaggagggcacgtggacatacctgg

SEQ ID NO: 16600 - DNA, 69 bp, Homo sapiens
  chr20:47274233-47274302
  hypo
ccacccacctgcacacgccccaggcaaagccggaaggccccagggctgaatcctcggccagccacaccc

SEQ ID NO: 16601 - DNA, 80 bp, Homo sapiens
  chr20:47296109-47296189
  hypo
aggcctgctctgaggcgaacccagggtggaggtgaacgaggccagctgagtcagagtcacaggggcggagggcccctacc

SEQ ID NO: 16602 - DNA, 184 bp, Homo sapiens
  chr20:47428537-47428721
  hypo
ccccttcctgaaaagcgagatgattggatgagatgatgtctcagtgtcttccagctccaacagccggtttccaggattctagtgctaataatttctttgggctaataaggaccaaagggtcctaaacccaggttttttcagccctcagttactaaattgacaaaagaaccggtagcaatcaaca

SEQ ID NO: 16603 - DNA, 86 bp, Homo sapiens; identical to SEQ ID NO: 5245
  chr20:47905517-47905603
  hypo

SEQ ID NO: 16604 - DNA, 30 bp, Homo sapiens
  chr20:48477511-48477541
  hypo
aaatgggcaggcctgcgtgaagggatcagg

SEQ ID NO: 16605 - DNA, 16 bp, Homo sapiens
  chr20:48720810-48720826
  hypo
ccgtctcaaaaaaaaa

SEQ ID NO: 16606 - DNA, 30 bp, Homo sapiens
  chr20:48771341-48771371
  hypo
ttccatacaggcagccgggcgcggtggctc

SEQ ID NO: 16607 - DNA, 30 bp, Homo sapiens
  chr20:48863456-48863486
  hypo
agggggacctgtgggcggcctctgcctctc

SEQ ID NO: 16608 - DNA, 131 bp, Homo sapiens
  chr20:49047031-49047162
  hypo
ctacagcgcacaacacggcccttgccagaaagaatcaacagggctgtgggcgaggagccctggtctcacgagaggttgcccacccctcacctggtgccccaggaggtgggaggcttcgcgggctccaggtc

SEQ ID NO: 16609 - DNA, 33 bp, Homo sapiens
  chr20:49200517-49200550
  hypo
ctttaggcagcctgccgccgtctctgtcccggt

SEQ ID NO: 16610 - DNA, 249 bp, Homo sapiens
  chr20:49204179-49204428
  hypo
acaaagggtggaggtcggctctgtgccagggctgctaacggtgcccatcccaggtgccccagagttgttctgcctgctgggagagctgggtgtggcctctcgcagattctaagggccccaggcaccccgctgcgctgcacagtttgtgccactttttaccgaacgacagtgtggtttcccgggctgccgcccgcacggcctccaggtcagactggcacaggctggcagtctggtcgatgctttcaatgc

SEQ ID NO: 16611 - DNA, 60 bp, Homo sapiens
  chr20:49218718-49218778
  hypo
gggccacgccaggcccgtcctctctgtccccggttgccccttcctcgtggccgttctggc

SEQ ID NO: 16612 - DNA, 343 bp, Homo sapiens; identical to SEQ ID NO: 1638
  chr20:49261761-49262104
  hypo

SEQ ID NO: 16613 - DNA, 68 bp, Homo sapiens; identical to SEQ ID NO: 5247
  chr20:49286826-49286894
  hypo

SEQ ID NO: 16614 - DNA, 30 bp, Homo sapiens
  chr20:49345697-49345727
  hypo
ggaatgcagggcccacgcaggtgcactggc

SEQ ID NO: 16615 - DNA, 212 bp, Homo sapiens; identical to SEQ ID NO: 1639
  chr20:49346547-49346759
  hypo

SEQ ID NO: 16616 - DNA, 26 bp, Homo sapiens
  chr20:49350870-49350896
  hypo
aactaggtagtgtgccggtccttttt

SEQ ID NO: 16617 - DNA, 24 bp, Homo sapiens
  chr20:49358372-49358396
  hypo
gcgcccggccgcactctgtctttt

SEQ ID NO: 16618 - DNA, 139 bp, Homo sapiens; identical to SEQ ID NO: 5250
  chr20:49377921-49378060
  hypo

SEQ ID NO: 16619 - DNA, 30 bp, Homo sapiens
  chr20:49380822-49380852
  hypo
ttgacattcctcagtcgtagtgccacagtg

SEQ ID NO: 16620 - DNA, 36 bp, Homo sapiens
  chr20:52693155-52693191
  hypo
tttttttttttgagacggagtcttgctctgtcacca

SEQ ID NO: 16621 - DNA, 18 bp, Homo sapiens
  chr20:53052060-53052078
  hypo
aatagctgttaaggccgg

SEQ ID NO: 16622 - DNA, 30 bp, Homo sapiens
  chr20:55693399-55693429
  hypo
tcaccccactacacccgcagcactgcccgc

SEQ ID NO: 16623 - DNA, 26 bp, Homo sapiens
  chr20:55693632-55693658
  hypo
tctcagggccgggcgcggtggctcac

SEQ ID NO: 16624 - DNA, 30 bp, Homo sapiens
  chr20:55925381-55925411
  hypo
agtaagagtagttcacgtatgatttcactt

SEQ ID NO: 16625 - DNA, 222 bp, Homo sapiens
  chr20:55958990-55959212
  hypo
gcttaaaatgtaaatcggctcccgaaaaagaactgacctgcattcttaatcttttattctttttccctcctgactgtggtgcagaggaggcagtatgggaggagacaaagctcaaagaaggcactgacaatccccagcatcctacgggcccgaatccacactgcggattccgtcagctcactggcggcagcactctctggtgtctttttttttttttttttt

SEQ ID NO: 16626 - DNA, 84 bp, Homo sapiens
  chr20:56766160-56766244
  hypo
cccccaacacatgcacgtgccaagaaccagtctggtcagttagaatcctccatcctggccgggcgcggtggctcacgcctgtaa

SEQ ID NO: 16627 - DNA, 30 bp, Homo sapiens
  chr20:57198958-57198988
  hypo
gggtgtgtgccctcccgtgccctctgcctg

SEQ ID NO: 16628 - DNA, 30 bp, Homo sapiens
  chr20:57699792-57699822
  hypo
aggggctggccccttcgagaggctcagtgt

SEQ ID NO: 16629 - DNA, 97 bp, Homo sapiens
  chr20:58507740-58507837
  hypo
aacaaaaaaaaaccacgctgccgtattcgcagatgctcggccagcctggagcccggtccagaaaaggccgcacgtggagccacgtgtcgcgcattga

SEQ ID NO: 16630 - DNA, 236 bp, Homo sapiens
  chr20:58514132-58514368
  hypo
tgcagcgcgtggttgcgacatgtgaggctgtagtctcggtggtcgttgttgtcccagtactcggcacccgccacttggtagcgcaccgcgaagtgcacgcgggagccgagctccagcaggaagggcggtactggaaagccgaaggtgaaaacgtcctccgtgccctcggggcctgcgggcccgcgccaccgcgccaccgcctcgtgggtactgcgccagcccgagaaagtgtagcg

SEQ ID NO: 16631 - DNA, 21 bp, Homo sapiens
  chr20:59185811-59185832
  hypo
cacgcccggccgagtaaaagt

SEQ ID NO: 16632 - DNA, 30 bp, Homo sapiens
  chr20:59910323-59910353
  hypo
tggtccaacggagatcgaaggtcattatat

SEQ ID NO: 16633 - DNA, 35 bp, Homo sapiens
  chr20:60120848-60120883
  hypo
ggggtatgtgggatacggtgcgtgttcacatgtgt

SEQ ID NO: 16634 - DNA, 30 bp, Homo sapiens
  chr20:60202364-60202394
  hypo
tgccagcctgcctgccggcttcaggcccgt

SEQ ID NO: 16635 - DNA, 30 bp, Homo sapiens
  chr20:60202615-60202645
  hypo
gagagctctttgtgtcgaccatgactgctt

SEQ ID NO: 16636 - DNA, 120 bp, Homo sapiens
  chr20:60238291-60238411
  hypo
cagaggagctttcatcgagggcttggcgcccacgacaaatgagtccacgcaggaaaggagtggcacccgcaggaggcctgtgctgcggagctcctgggagggtgacgctggggcaggggc

SEQ ID NO: 16637 - DNA, 103 bp, Homo sapiens
  chr20:60238877-60238980
  hypo
caccagtcactcccacgctgggtcttccagctccctcgaggccgccctggccctccacactcccaccgctggcgccagcatctgtgcccgcggcagtttagag

SEQ ID NO: 16638 - DNA, 30 bp, Homo sapiens
  chr20:60281435-60281465
  hypo
acagaaaactgcagccggcctcatttgccg

SEQ ID NO: 16639 - DNA, 19 bp, Homo sapiens
  chr20:60329650-60329669
  hypo
ggaacaccacacacacggt

SEQ ID NO: 16640 - DNA, 30 bp, Homo sapiens
  chr20:60375036-60375066
  hypo
tcccttcccatgacccgctcggctgcagcg

SEQ ID NO: 16641 - DNA, 150 bp, Homo sapiens
  chr20:60385207-60385357
  hypo
gacctgttctcaagacggagacagagatgggtgagggaggccgggccagccacactaacatcccactggcagaccccgggaaaggccatggccacccacatggatgtgtgggtatggccacatgtggctatccaccgggccagtcggggc

SEQ ID NO: 16642 - DNA, 30 bp, Homo sapiens
  chr20:60428191-60428221
  hypo
gctgggaagaaaacccgggcactgggagtc

SEQ ID NO: 16643 - DNA, 30 bp, Homo sapiens
  chr20:60448710-60448740
  hypo
ctgcccaggtgtgtgcgggggtggcagcct

SEQ ID NO: 16644 - DNA, 157 bp, Homo sapiens; identical to SEQ ID NO: 5251
  chr20:60477380-60477537
  hypo

SEQ ID NO: 16645 - DNA, 30 bp, Homo sapiens
  chr20:60502281-60502311
  hypo
acagtcagaacatgccgccaccaccgccgc

SEQ ID NO: 16646 - DNA, 212 bp, Homo sapiens
  chr20:60502848-60503060
  hypo
gtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatggcgtgtggcagggtgtcggtcaggagccatg

SEQ ID NO: 16647 - DNA, 240 bp, Homo sapiens
  chr20:60773311-60773551
  hypo
tctgaccccatgagccgacctctgactgagggaggccactggcacccagcgggcctgcgtctccttcgcgagctgaattcactcgtctcttagatgttttttctggtgcttcagttcacactaacgttttagaaacactatttgaaaaagccctttgtgcagtcagaagggtgtgtacgcagccccgtgaaagccctggagcactgggaccttttccttgtgctccggagctgttggcag

SEQ ID NO: 16648 - DNA, 155 bp, Homo sapiens
  chr20:60781351-60781506
  hypo
tcatcagtgaacacacgtgccggggacctgtcctggtgccgctaaagaggctgcagagccgcggggtgcggcagtgcttggcgggggcggggtgcagctctgcgtgcatggcgtccacctggggaccgcaggtgtcaagccggggagagccagtg

SEQ ID NO: 16649 - DNA, 35 bp, Homo sapiens
  chr20:60790112-60790147
  hypo
gtgcacagcacatggcgaagcggcccctgcccggg

SEQ ID NO: 16650 - DNA, 40 bp, Homo sapiens
  chr20:60925501-60925541
  hypo
gctcccgcctctgctcggcactggccgtgagaatgggagt

SEQ ID NO: 16651 - DNA, 70 bp, Homo sapiens
  chr20:60925868-60925938
  hypo
aggtgctcctgaggccgggctggggtcccaccctgtgttcccattcccaggaaaacggcccagcgtgtgt

SEQ ID NO: 16652 - DNA, 96 bp, Homo sapiens
  chr20:60953312-60953408
  hypo
caagacaagcctgggcgactcacctggggcaggaatgtggattccatcactccgcagaggctttcaagcaaaacacagcctcgtctctgggcctgt

SEQ ID NO: 16653 - DNA, 50 bp, Homo sapiens
  chr20:60970933-60970983
  hypo
ctctcagggtgcagccggtgccagctgcggccctccgccagctttgggca

SEQ ID NO: 16654 - DNA, 85 bp, Homo sapiens
  chr20:60983881-60983966
  hypo
gggtggagggcaggacgcaggaggcaggaggcagctgtccgtgctggctgcagcgccgggtcctggggatcggctgtgcagtagg

SEQ ID NO: 16655 - DNA, 30 bp, Homo sapiens
  chr20:60984485-60984515
  hypo
tgagcaggtgtcaagcgcagggctctgtct

SEQ ID NO: 16656 - DNA, 471 bp, Homo sapiens
  chr20:61288063-61288534
  hypo
cggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacc

SEQ ID NO: 16657 - DNA, 30 bp, Homo sapiens
  chr20:61294663-61294693
  hypo
aggcattcagagttgcgttcatcggaacca

SEQ ID NO: 16658 - DNA, 30 bp, Homo sapiens
  chr20:61312730-61312760
  hypo
gcgtgtgtattaagccgtgtcacttgtgtg

SEQ ID NO: 16659 - DNA, 52 bp, Homo sapiens
  chr20:61393835-61393887
  hypo
tatctgtgcacttaccgtaggtagggacacgtgtccacgcaccacagacaca

SEQ ID NO: 16660 - DNA, 463 bp, Homo sapiens; identical to SEQ ID NO: 5252
  chr20:61505867-61506330
  hypo

SEQ ID NO: 16661 - DNA, 109 bp, Homo sapiens
  chr20:61570765-61570874
  hypo
cagcaccgccccccccgccccttatttcactaattcatgttttcagctctgagctcaggatctgtaattcagacacctgcttgatttctccagacgcatgtctaatagt

SEQ ID NO: 16662 - DNA, 30 bp, Homo sapiens
  chr20:61695664-61695694
  hypo
ggtcctgcaagagaacgggctccatttgcg

SEQ ID NO: 16663 - DNA, 136 bp, Homo sapiens
  chr20:61725275-61725411
  hypo
aaaaaatgtaaacatcgcaagctgcacccaggtgtgaatctggagggcgcctccttggaaaacttggctggtgaccgcaccctcagttcaagctcaccggccgcccttccctgtgcacacacgtgagctctccagt

SEQ ID NO: 16664 - DNA, 30 bp, Homo sapiens
  chr20:61763598-61763628
  hypo
catgaagcttcccaccgggtaggcactcac

SEQ ID NO: 16665 - DNA, 30 bp, Homo sapiens
  chr20:61838532-61838562
  hypo
cattaaccccgggcacggtgactcatgcct

SEQ ID NO: 16666 - DNA, 466 bp, Homo sapiens
  chr20:61973894-61974360
  hypo
agcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcaggggattcctgggtgccggctctatgcgaatattcttcagtctgtgaaagaaaatgccttgtcatgccgctgaggattcatacgcacgctgtgtaccttaccccgcgaggcaggcaaatgccaagaaatgccagctcggattagcgcagcgggagcgcctgtctgcagac

SEQ ID NO: 16667 - DNA, 115 bp, Homo sapiens
  chr20:61980815-61980930
  hypo
tcagcctgggacctgcggccacatagcaggcttgggaagaggctgctgcagcaggggccacgccctgcaccccaaagcgaagcagcctgaggcctgggcccggctcctggattac

SEQ ID NO: 16668 - DNA, 30 bp, Homo sapiens
  chr20:61982304-61982334
  hypo
ggagtccactgcacccgcccgtcatggaac

SEQ ID NO: 16669 - DNA, 35 bp, Homo sapiens
  chr20:61990913-61990948
  hypo
gagcgatggacaggccgaagcggacgaggaccacg

SEQ ID NO: 16670 - DNA, 30 bp, Homo sapiens
  chr20:62011933-62011963
  hypo
agctgtcctccctgccgcagccggcatgcc

SEQ ID NO: 16671 - DNA, 66 bp, Homo sapiens; identical to SEQ ID NO: 5253
  chr20:62031666-62031732
  hypo

SEQ ID NO: 16672 - DNA, 112 bp, Homo sapiens
  chr20:62031976-62032088
  hypo
agccagaggcaacggcgcaaatggggaagctgcagccaccgtcacggccagaggatggcagactgcaatggcgtggggcgcgggcatggcgggcacacgtgggccgtgtgga

SEQ ID NO: 16673 - DNA, 53 bp, Homo sapiens
  chr20:62033547-62033600
  hypo
agcaggtccaagcctcgtgagccgtccctctcacgccacgtctgccgggcacc

SEQ ID NO: 16674 - DNA, 30 bp, Homo sapiens
  chr20:62038095-62038125
  hypo
gtctgactctccctccgcaatgtagggcct

SEQ ID NO: 16675 - DNA, 41 bp, Homo sapiens
  chr20:62038570-62038611
  hypo
ctgtcgacatgctcccggctgtcttccgggctgtggtacgg

SEQ ID NO: 16676 - DNA, 309 bp, Homo sapiens; identical to SEQ ID NO: 1641
  chr20:62046201-62046510
  hypo

SEQ ID NO: 16677 - DNA, 113 bp, Homo sapiens
  chr20:62053226-62053339
  hypo
cccacccgaccccaacgtagacgcttcctctgactccagcacagccccagtggtccctacgggaaccgagcccccgccagccgggtcgcctgccaccacgtgcctgtgttctg

SEQ ID NO: 16678 - DNA, 38 bp, Homo sapiens
  chr20:62054264-62054302
  hypo
cacctgggacagcaccgaggttccgcccaaatcacagc

SEQ ID NO: 16679 - DNA, 30 bp, Homo sapiens
  chr20:62058730-62058760
  hypo
acccgcgcttgtaggcgtttgccacagccg

SEQ ID NO: 16680 - DNA, 136 bp, Homo sapiens
  chr20:62090500-62090636
  hypo
acctgagggcaggctcggcaaggaaagccaggcacaaaacggcaccacgatgacaactccacttacacgaaacatccgaagcaaacaggccaggcccggcggccacgcctgtactcccagagcttggcgaggccga

SEQ ID NO: 16681 - DNA, 39 bp, Homo sapiens
  chr20:62097848-62097887
  hypo
ccctcctggcctccacgctccgtccggggtgaggccttc

SEQ ID NO: 16682 - DNA, 86 bp, Homo sapiens; identical to SEQ ID NO: 1642
  chr20:62115180-62115266
  hypo

SEQ ID NO: 16683 - DNA, 348 bp, Homo sapiens; identical to SEQ ID NO: 5256
  chr20:62126081-62126429
  hypo

SEQ ID NO: 16684 - DNA, 40 bp, Homo sapiens
  chr20:62153405-62153445
  hypo
aaccagtgagagccccgctctctaccgcccggccccagca

SEQ ID NO: 16685 - DNA, 237 bp, Homo sapiens
  chr20:62165598-62165835
  hypo
tcgttcaggtgcagccggcccccggcacgccgccagatcttgtagtgccgcacagcctgcgtgtcccgcactgggagggagagcgtgagctgtgtggccaccccaactccgacgcctccctgcgtccccagccctgctggccacacctgcgcagagtttctgggtccccacagttgctgttggtgcttcctcagtaccacccctgcctcccctccctcagaacggctccctcctgcc

SEQ ID NO: 16686 - DNA, 30 bp, Homo sapiens
  chr20:62167765-62167795
  hypo
gttgcttgggtcccccgggagctaacccta

SEQ ID NO: 16687 - DNA, 30 bp, Homo sapiens
  chr20:62168240-62168270
  hypo
ctgggcactcctgggcgccagcgcatgggg

SEQ ID NO: 16688 - DNA, 30 bp, Homo sapiens
  chr20:62170163-62170193
  hypo
atgtccaggaagcctcgagtatccctgagt

SEQ ID NO: 16689 - DNA, 336 bp, Homo sapiens
  chr20:62172667-62173003
  hypo
cttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggcggcagacgcagggcccggccctcgggggctgcaggagacagcgcggggtcttttaggg

SEQ ID NO: 16690 - DNA, 32 bp, Homo sapiens
  chr20:62221371-62221403
  hypo
cccgctccctgctgccgcggctgagagacagc

SEQ ID NO: 16691 - DNA, 470 bp, Homo sapiens
  chr20:62320923-62321393
  hypo
ccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaaccc

SEQ ID NO: 16692 - DNA, 30 bp, Homo sapiens
  chr20:62321804-62321834
  hypo
gcagcgctgggtgggcggtgtgggggtggc

SEQ ID NO: 16693 - DNA, 30 bp, Homo sapiens
  chr20:62329526-62329556
  hypo
ctcctgcaaaccccccgagtggggcccaga

SEQ ID NO: 16694 - DNA, 247 bp, Homo sapiens; identical to SEQ ID NO: 5257
  chr20:62383189-62383436
  hypo

SEQ ID NO: 16695 - DNA, 30 bp, Homo sapiens
  chr20:62384067-62384097
  hypo
gcgtgaacttcttcccgcagatctcgcagg

SEQ ID NO: 16696 - DNA, 71 bp, Homo sapiens
  chr20:62400829-62400900
  hypo
catgcggtgtgagcccggtgatgccccaagggtctcgctggaggcaggtgtttgaacgctttgatcagctg

SEQ ID NO: 16697 - DNA, 35 bp, Homo sapiens
  chr20:62481615-62481650
  hypo
cgggatgctgagtcacgctacgtctcctttcctga

SEQ ID NO: 16698 - DNA, 206 bp, Homo sapiens
  chr20:62488224-62488430
  hypo
aaaaaaagaaaagaaaagaagaaaagaaaagcccctagaggccagggtccttgaacaaaagtgcgcgatgccctgtgtctgcagcggggagaggtctggagcccgtgtgtccgacagcagaagtggacacagtggtgccagggcaggaaccctgggggcatttgcaggcctgtgctgcgagactgcagtggcgctcaggacacacc

SEQ ID NO: 16699 - DNA, 144 bp, Homo sapiens
  chr20:62722776-62722920
  hypo
acacctctgaggcttcgtgctctcagcagtggccgggtatggtgggggtgactgagctccaggagcacacagcaggtgctgggccagtgccgtgtcctggacccaagcatcttacccgcttgtttacgacgaagctttgatctg

SEQ ID NO: 16700 - DNA, 36 bp, Homo sapiens
  chr20:62762699-62762735
  hypo
actggagtatctagtcgtgtgcgtgtgtgagtagag

SEQ ID NO: 16701 - DNA, 79 bp, Homo sapiens
  chr21:15694241-15694320
  hypo
gccaccacgcccagcctaggctaattcttacacaagctaattatactgatgatagcttgtatgtcgtggatagtaacga

SEQ ID NO: 16702 - DNA, 30 bp, Homo sapiens
  chr21:20360095-20360125
  hypo
gtttactccggttcccgcacttgtttgcta

SEQ ID NO: 16703 - DNA, 71 bp, Homo sapiens
  chr21:33983236-33983307
  hypo
caggaagtatcatcccgtcaagttcaaaaactatgctgtctaatgcggcagctactcgctccacttggcga

SEQ ID NO: 16704 - DNA, 95 bp, Homo sapiens
  chr21:34459377-34459472
  hypo
tgtgtatcttcttaacgtcattgaattgcacgcttaaacaatggttaagacagtaagctttacttatgaatattttaccgcagcaaaatataatt

SEQ ID NO: 16705 - DNA, 30 bp, Homo sapiens
  chr21:37750050-37750080
  hypo
gcctgtgatctcagacgcttgattcttgct

SEQ ID NO: 16706 - DNA, 108 bp, Homo sapiens
  chr21:37758492-37758600
  hypo
acttccagcatgggacggctgggaggatccacagactggcgtctgccggcgtggacaccaatgtcagggtaaactggggcagagatagacatccgggaacactgcttg

SEQ ID NO: 16707 - DNA, 50 bp, Homo sapiens
  chr21:37775108-37775158
  hypo
actgagtttcactcccgacggatctttgcttctcacgccaggtgtgtttc

SEQ ID NO: 16708 - DNA, 42 bp, Homo sapiens
  chr21:38092179-38092221
  hypo
tgaccgctgtcctcacggcccaccagccgctgcaccaccacc

SEQ ID NO: 16709 - DNA, 63 bp, Homo sapiens
  chr21:38935380-38935443
  hypo
ggagaccatttttcacgcctggccggctctgtgcttaagtggccccatcgcagccagagtagc

SEQ ID NO: 16710 - DNA, 30 bp, Homo sapiens
  chr21:42613756-42613786
  hypo
tctggagaccttcttcgactccctggtgac

SEQ ID NO: 16711 - DNA, 195 bp, Homo sapiens
  chr21:43248726-43248921
  hypo
gtaaataacatctcacgcaggcacgcacgtgtggcctgaacgtcaataaagcgcgggtgacgggcatgagagtcacggggatgcgtggccaggaagaaaacagcacctgtgtgtcatacactgtctaccccaggaactcacgatgcagagacgggaaccccggtgcttgaaaagcagacacggagctcacctttc

SEQ ID NO: 16712 - DNA, 183 bp, Homo sapiens
  chr21:43786558-43786741
  hypo
acaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgag

SEQ ID NO: 16713 - DNA, 30 bp, Homo sapiens
  chr21:44338342-44338372
  hypo
ttttcacctacggcgcgatgggttttatca

SEQ ID NO: 16714 - DNA, 49 bp, Homo sapiens
  chr21:44837100-44837149
  hypo
tgccgagggcaggtgcgtggctgatccctgaccgcgccccacctttcat

SEQ ID NO: 16715 - DNA, 300 bp, Homo sapiens; identical to SEQ ID NO: 5258
  chr21:44866603-44866903
  hypo

SEQ ID NO: 16716 - DNA, 57 bp, Homo sapiens
  chr21:45170351-45170408
  hypo
ccacccgcctgtccccgcctgtcttccaggttactgagtggccggaagatccacagc

SEQ ID NO: 16717 - DNA, 69 bp, Homo sapiens
  chr21:45195259-45195328
  hypo
gaatcttctggcaggcgcagagcaacaggacgtccattttacagacgaggaaaccgagacacagggaag

SEQ ID NO: 16718 - DNA, 30 bp, Homo sapiens
  chr21:45232947-45232977
  hypo
gcaggcacagcagggcgcaccccatgacgc

SEQ ID NO: 16719 - DNA, 30 bp, Homo sapiens
  chr21:45247147-45247177
  hypo
acagaaagaatgagtcgctggaacctggga

SEQ ID NO: 16720 - DNA, 30 bp, Homo sapiens
  chr21:45273840-45273870
  hypo
tttgcatctgtaaggcgtatattaccgtag

SEQ ID NO: 16721 - DNA, 30 bp, Homo sapiens
  chr21:45365737-45365767
  hypo
atgcttgcacaggagcgtggctttgtcaga

SEQ ID NO: 16722 - DNA, 62 bp, Homo sapiens
  chr21:45844751-45844813
  hypo
agccctgcactggatcgtgaggacgctgcgggccagcggcttcagctcggaggcggacgtcc

SEQ ID NO: 16723 - DNA, 132 bp, Homo sapiens
  chr21:45929217-45929349
  hypo
ggaagatcctctccccgatctggaagacctcccagtctgcagcaccgaacgtctaggaccaaaggagagcaggtgcagaggtgtgggggagcgggcgcagaggtgtgggggagcgggcgcagaggtgtgggg

SEQ ID NO: 16724 - DNA, 30 bp, Homo sapiens
  chr21:46015435-46015465
  hypo
gttttctctgtaagacgtgctggagccttc

SEQ ID NO: 16725 - DNA, 222 bp, Homo sapiens; identical to SEQ ID NO: 5259
  chr21:46036605-46036827
  hypo

SEQ ID NO: 16726 - DNA, 30 bp, Homo sapiens
  chr21:46068645-46068675
  hypo
cctcccgatggctcccgaggggaaaggcag

SEQ ID NO: 16727 - DNA, 112 bp, Homo sapiens
  chr21:46256944-46257056
  hypo
tttcaggggcacctccgtgcagtccccggcacccagggtgcagcccccagcacctccgtgtagcccccgacacccagggtgcagcccccggcacctccgtgtagcccccggc

SEQ ID NO: 16728 - DNA, 30 bp, Homo sapiens
  chr21:46257286-46257316
  hypo
tggtagacaggaggccggagaagcccggat

SEQ ID NO: 16729 - DNA, 196 bp, Homo sapiens
  chr21:46308621-46308817
  hypo
acatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggg

SEQ ID NO: 16730 - DNA, 157 bp, Homo sapiens
  chr21:46310607-46310764
  hypo
aagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagt

SEQ ID NO: 16731 - DNA, 30 bp, Homo sapiens
  chr21:46311771-46311801
  hypo
tctctgctctggtcccggcaccggcactca

SEQ ID NO: 16732 - DNA, 349 bp, Homo sapiens; identical to SEQ ID NO: 5260
  chr21:46319156-46319505
  hypo

SEQ ID NO: 16733 - DNA, 30 bp, Homo sapiens
  chr21:46321598-46321628
  hypo
gtgcgtgttcacgaacggcagcacggtctt

SEQ ID NO: 16734 - DNA, 259 bp, Homo sapiens
  chr21:46452280-46452539
  hypo
ctggtcttggggaggcgggctccagctcgaaaggaggcacacaaaactgctgggaaacgggccgggcaggcaggggcggggccgggcgggtgaggacatggcttctgtgcgcacggcccggcgcgatggctggtgtggacccctacctttggaacacgtggggccaggccgagggggttccgccacgtctcctgggcagagcgccagcctcagtcaccgtgtcactgtgtgtccctccacaccccgagtcctggcaaac

SEQ ID NO: 16735 - DNA, 32 bp, Homo sapiens
  chr21:46677808-46677840
  hypo
gtcctcgtgggaaaccgcgggggcacgtgggg

SEQ ID NO: 16736 - DNA, 43 bp, Homo sapiens
  chr21:46844706-46844749
  hypo
ctgggaggcccgtggcgcagccccttcccgcctcctgcccgtc

SEQ ID NO: 16737 - DNA, 34 bp, Homo sapiens
  chr21:46863752-46863786
  hypo
atgatcccctagatgcgtccgagggacactggac

SEQ ID NO: 16738 - DNA, 50 bp, Homo sapiens
  chr21:46908931-46908981
  hypo
aagcgtcctctgctgcgtgcggggccaagggcgcacggggcccaccctgg

SEQ ID NO: 16739 - DNA, 127 bp, Homo sapiens
  chr21:46912135-46912262
  hypo
atcagaaaagcctcccgtaggccgagccacctccgccggcaagcaagggagcgtctagcagaggcaggagcattttaaaacaaaatggaagtaaaaaccatggcccttagggcgtctggagtctgca

SEQ ID NO: 16740 - DNA, 57 bp, Homo sapiens
  chr21:46921503-46921560
  hypo
ccctcacactgcagccgcaggggccttgccctgcacaatccccggtctcccaggtgg

SEQ ID NO: 16741 - DNA, 30 bp, Homo sapiens
  chr21:46925754-46925784
  hypo
aggctctgggctacacgccaggccatgctg

SEQ ID NO: 16742 - DNA, 44 bp, Homo sapiens
  chr21:46926540-46926584
  hypo
cccatgccgccgaaacggcctgtgacatccgtgggagcctccat

SEQ ID NO: 16743 - DNA, 30 bp, Homo sapiens
  chr21:47013235-47013265
  hypo
atcaccccatggccccgtcatttcagcact

SEQ ID NO: 16744 - DNA, 48 bp, Homo sapiens
  chr21:47287102-47287150
  hypo
agggaaggcggcggacggaacaaaacgcgggcacgcaacggctgctgc

SEQ ID NO: 16745 - DNA, 44 bp, Homo sapiens
  chr21:47404135-47404179
  hypo
gcgccaggggccgcccgcctcacgcccgccgtgcctgttcctgg

SEQ ID NO: 16746 - DNA, 30 bp, Homo sapiens
  chr21:47425521-47425551
  hypo
ggctgttctgggggccgctaggggactaag

SEQ ID NO: 16747 - DNA, 30 bp, Homo sapiens
  chr21:47501864-47501894
  hypo
aaccttcacaccacacggaggaacccgcaa

SEQ ID NO: 16748 - DNA, 34 bp, Homo sapiens
  chr21:47503061-47503095
  hypo
gccaccacatctgcacgtgcggggatctaataag

SEQ ID NO: 16749 - DNA, 37 bp, Homo sapiens
  chr21:47531922-47531959
  hypo
tcgtgctggacacctcggagagcgtcaccatgcagtc

SEQ ID NO: 16750 - DNA, 37 bp, Homo sapiens
  chr21:47737928-47737965
  hypo
tcccaagagcttcagcgtcagtcgggtcacttgctct

SEQ ID NO: 16751 - DNA, 215 bp, Homo sapiens; identical to SEQ ID NO: 5261
  chr21:47746178-47746393
  hypo

SEQ ID NO: 16752 - DNA, 16 bp, Homo sapiens
  chr22:18110631-18110647
  hypo
acgaccttgtcaaaac

SEQ ID NO: 16753 - DNA, 30 bp, Homo sapiens
  chr22:18553893-18553923
  hypo
caaactgggagtgtccgcagaaaactgaat

SEQ ID NO: 16754 - DNA, 57 bp, Homo sapiens
  chr22:19117537-19117594
  hypo
catgcactgcagccccgacccacccatacacaggcccttgctcgctggagcagcagc

SEQ ID NO: 16755 - DNA, 15 bp, Homo sapiens
  chr22:20864657-20864672
  hypo
cgagactccatctca

SEQ ID NO: 16756 - DNA, 26 bp, Homo sapiens
  chr22:21214345-21214371
  hypo
aacaattattctggccgagcgcagtg

SEQ ID NO: 16757 - DNA, 250 bp, Homo sapiens
  chr22:22899696-22899946
  hypo
accgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggagga

SEQ ID NO: 16758 - DNA, 42 bp, Homo sapiens
  chr22:24374229-24374271
  hypo
tactgcacaccagccggggcgacaaagcgagactgtctcaaa

SEQ ID NO: 16759 - DNA, 30 bp, Homo sapiens
  chr22:27045927-27045957
  hypo
catgtcgggtgtgtccgacagtctcccaga

SEQ ID NO: 16760 - DNA, 83 bp, Homo sapiens
  chr22:29445929-29446012
  hypo
cagctccctcagcagcgactatgaccccttcatctaccgcagccggagcccctgtcgtgccagtgaggcggggggctcgggca

SEQ ID NO: 16761 - DNA, 30 bp, Homo sapiens
  chr22:29446295-29446325
  hypo
gtgtgcctgctgctgcgagccccagccctc

SEQ ID NO: 16762 - DNA, 18 bp, Homo sapiens
  chr22:29701031-29701049
  hypo
gcccggccgggaatgtta

SEQ ID NO: 16763 - DNA, 38 bp, Homo sapiens
  chr22:29977653-29977691
  hypo
caagggttcttaacaaggctgtccgggatgtgcagcag

SEQ ID NO: 16764 - DNA, 29 bp, Homo sapiens
  chr22:29977934-29977963
  hypo
tagggagtggaagccgtcctcttgtgctg

SEQ ID NO: 16765 - DNA, 27 bp, Homo sapiens
  chr22:29998650-29998677
  hypo
aataataattctaggcggggcgtggtg

SEQ ID NO: 16766 - DNA, 23 bp, Homo sapiens
  chr22:30158368-30158391
  hypo
tgtcaggagctgggccgcacagc

SEQ ID NO: 16767 - DNA, 38 bp, Homo sapiens
  chr22:30783975-30784013
  hypo
atgggcaccataggccgggcgcggtggctcacgcctgt

SEQ ID NO: 16768 - DNA, 35 bp, Homo sapiens
  chr22:32014233-32014268
  hypo
aggtgtccctggggacgccccgggctgtgctccct

SEQ ID NO: 16769 - DNA, 29 bp, Homo sapiens
  chr22:32356777-32356806
  hypo
aaaaactccgtccccgccccccccccccc

SEQ ID NO: 16770 - DNA, 30 bp, Homo sapiens
  chr22:33255298-33255328
  hypo
tactgcagctggtaccgaggatgggccccc

SEQ ID NO: 16771 - DNA, 30 bp, Homo sapiens; identical to SEQ ID NO: 5265
  chr22:35079354-35079384
  hypo

SEQ ID NO: 16772 - DNA, 30 bp, Homo sapiens; identical to SEQ ID NO: 5266
  chr22:35768487-35768517
  hypo

SEQ ID NO: 16773 - DNA, 30 bp, Homo sapiens
  chr22:35822752-35822782
  hypo
cagcctctgccatctcggatttcacctttt

SEQ ID NO: 16774 - DNA, 40 bp, Homo sapiens
  chr22:36585960-36586000
  hypo
cctaaaaaatgtctgcgttttgtcccggcctgtgtctggc

SEQ ID NO: 16775 - DNA, 58 bp, Homo sapiens
  chr22:36684241-36684299
  hypo
tgtagttggctcagtcgggtgccgcccaccctcacctgggccccgcccacccttacct

SEQ ID NO: 16776 - DNA, 30 bp, Homo sapiens
  chr22:36878964-36878994
  hypo
cagcagctgaaagagcgtttttaaaagaac

SEQ ID NO: 16777 - DNA, 57 bp, Homo sapiens
  chr22:36902482-36902539
  hypo
agaggggtaaggcctcgcacccggcccggcggctgggagacacgaggcccagaaaga

SEQ ID NO: 16778 - DNA, 112 bp, Homo sapiens
  chr22:38199743-38199855
  hypo
taagtgaacagtgaccggcctctatgcttagggaataaaagcggggttgtgggagaggggcccagggagcaaacgtcgcagaatctcagcccagggccgctgccaagcggac

SEQ ID NO: 16779 - DNA, 30 bp, Homo sapiens
  chr22:38520276-38520306
  hypo
aggcaggagccactgcgcctactctctgtg

SEQ ID NO: 16780 - DNA, 44 bp, Homo sapiens
  chr22:38578694-38578738
  hypo
ttacaggcgtgagccaccacgcccggctccgaaatttttaacat

SEQ ID NO: 16781 - DNA, 43 bp, Homo sapiens
  chr22:38694550-38694593
  hypo
agatcctccttgttccgacgggagacagcgccctgcctggccc

SEQ ID NO: 16782 - DNA, 30 bp, Homo sapiens
  chr22:39757008-39757038
  hypo
tcgtccttctagccacggttcttcaggtgt

SEQ ID NO: 16783 - DNA, 165 bp, Homo sapiens
  chr22:40018163-40018328
  hypo
cagaactctgcctggcggacagaaggcgcgccaaagacacgtgtgaaatggacacagcaggtgtactgagctgtgtactgtgccaggaccacagagctatacatgctcctgtgccgggcatgaggaggcagggagaatggggctgggggtcgggaggcctccggg

SEQ ID NO: 16784 - DNA, 270 bp, Homo sapiens
  chr22:40042590-40042860
  hypo
gatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggcc

SEQ ID NO: 16785 - DNA, 16 bp, Homo sapiens
  chr22:40991414-40991430
  hypo
gcgcccggccgagaaa

SEQ ID NO: 16786 - DNA, 61 bp, Homo sapiens
  chr22:41634431-41634492
  hypo
tggtgtaggctgagccgtctcagggcgggcaggccagccagggcctcgggggccagcacgc

SEQ ID NO: 16787 - DNA, 30 bp, Homo sapiens
  chr22:41637166-41637196
  hypo
caccagcagctggcccgggagtcagcagtc

SEQ ID NO: 16788 - DNA, 17 bp, Homo sapiens
  chr22:41839926-41839943
  hypo
gccggaaggtttttcag

SEQ ID NO: 16789 - DNA, 37 bp, Homo sapiens
  chr22:42109085-42109122
  hypo
tacatgcgtgagccaccgcgcccggctgggcattaga

SEQ ID NO: 16790 - DNA, 30 bp, Homo sapiens
  chr22:42995705-42995735
  hypo
tgtggtggagaaagccgcctgaggctgcaa

SEQ ID NO: 16791 - DNA, 30 bp, Homo sapiens
  chr22:43012543-43012573
  hypo
agtgtagggcagatgcggaggacaatttta

SEQ ID NO: 16792 - DNA, 30 bp, Homo sapiens
  chr22:43083005-43083035
  hypo
tctcctccaccctcacggcctctgtcttgt

SEQ ID NO: 16793 - DNA, 32 bp, Homo sapiens
  chr22:43434445-43434477
  hypo
gggaacaaccacgctcgcgcagcctgtcccgc

SEQ ID NO: 16794 - DNA, 92 bp, Homo sapiens
  chr22:43524971-43525063
  hypo
ctcacctgtgcccaccgggtgtctttgcctgtgtcccgcagactggcaggcccaggccacgctggcctctctggccacgtcctcagggccac

SEQ ID NO: 16795 - DNA, 30 bp, Homo sapiens
  chr22:43581330-43581360
  hypo
cctttccagggcagccggcctaaggtgagg

SEQ ID NO: 16796 - DNA, 197 bp, Homo sapiens
  chr22:43601102-43601299
  hypo
ggacctcgggaacatcgctttgctgctctgactttcattcttccctgcacagagaggtcacgatgcctcttcccggggctgcgaggaaaatgatctgcactggcgtgagcagagaacctctcctcagcggtgctcagtacaggtttgctgcagggatctaggcagcaaacggggctgtcctccggagcagtctctgg

SEQ ID NO: 16797 - DNA, 140 bp, Homo sapiens
  chr22:44455600-44455740
  hypo
aataaagaaagatgccgtacacattttcctttaaaaagtctcacttggcttgtttgacaggcacagaagatgtgttattaaacacttgcaaagcctgctgtcatttggttttaaacagcactcgtcgtctttggcggggc

SEQ ID NO: 16798 - DNA, 39 bp, Homo sapiens
  chr22:44538737-44538776
  hypo
tgctgcttctgctgacgcaggttccgaagtctcctggtt

SEQ ID NO: 16799 - DNA, 30 bp, Homo sapiens
  chr22:44580569-44580599
  hypo
acagggtccctggcacggcagatgagaccc

SEQ ID NO: 16800 - DNA, 73 bp, Homo sapiens
  chr22:45088693-45088766
  hypo
gcctgcctggcagggcggctgcaaacacgaaggttcggaagtgcacgagctctcagcacggggccaggcacag

SEQ ID NO: 16801 - DNA, 49 bp, Homo sapiens
  chr22:45593666-45593715
  hypo
ttacctgttaaaatccgatgcagcggcaacgtgacgtaggttaagtgtg

SEQ ID NO: 16802 - DNA, 51 bp, Homo sapiens
  chr22:46929253-46929304
  hypo
gaaggcgctgatccccggtcttgaacttgggagaaccgcaggcctgctccc

SEQ ID NO: 16803 - DNA, 41 bp, Homo sapiens
  chr22:46929668-46929709
  hypo
gtcggggtcatgggccgggatgcagccgatcacgccggtgg

SEQ ID NO: 16804 - DNA, 44 bp, Homo sapiens
  chr22:46931911-46931955
  hypo
cgttgatgggcgagtcgcggtcgctggcgcggatggtcagcacc

SEQ ID NO: 16805 - DNA, 74 bp, Homo sapiens; identical to SEQ ID NO: 5268
  chr22:47005080-47005154
  hypo

SEQ ID NO: 16806 - DNA, 30 bp, Homo sapiens
  chr22:47005505-47005535
  hypo
tctttggtgccaggccgtgtgctgggcccc

SEQ ID NO: 16807 - DNA, 30 bp, Homo sapiens
  chr22:47054582-47054612
  hypo
cccagtgccccaccccgggggccagcccgg

SEQ ID NO: 16808 - DNA, 210 bp, Homo sapiens
  chr22:47525714-47525924
  hypo
tgtcagcgtcactgccgctgagtcaccacgtgcactgtgcctgtcatccctttctgggacagcatgtcactttccttggtgtcaccaatcatctcccttaggagtctgtgaaccacccactccctccctccccaccagacaggttaccggagcgggcgtgtctggaggagcaggcagagcaggtgctgtacacctcgtgtcctctgggac

SEQ ID NO: 16809 - DNA, 233 bp, Homo sapiens
  chr22:48931835-48932068
  hypo
gagtgcccgtgttgtcgagcccccgccacagagctgcaccgccgcttggtgccgcatgcagcgagttcccgcatgggttggttttcgtctcctgaaactaatttggcagaagcaagtgtccatatgtaggtgtgggtctctgtcttcatgcgtcccccatgccccgacacacacacacgtttccattaattagcagggacttggaaacctaccgtccccggctcaaggcaaat

SEQ ID NO: 16810 - DNA, 167 bp, Homo sapiens
  chr22:49115643-49115810
  hypo
aacgtatatggccggcgccacatcagctagtattgtaagcagtgacactcttcattttctcagcagaaatgagcccagaaacaaaaaaaaattggtttgaccaaacccacattatttctgtctgcactttgggccacttttgtaatgggagacgtgacacgctgggc

SEQ ID NO: 16811 - DNA, 30 bp, Homo sapiens
  chr22:49117093-49117123
  hypo
gccaccatttcagcccgcccactgccttca

SEQ ID NO: 16812 - DNA, 30 bp, Homo sapiens
  chr22:49387651-49387681
  hypo
tctttctgatcatctcggttccaatcgagg

SEQ ID NO: 16813 - DNA, 30 bp, Homo sapiens
  chr22:49831409-49831439
  hypo
cacggtcttctcgtacgcgtgaggagccag

SEQ ID NO: 16814 - DNA, 30 bp, Homo sapiens
  chr22:49941803-49941833
  hypo
tcccgccgctgtcagcgcacctctgcattg

SEQ ID NO: 16815 - DNA, 40 bp, Homo sapiens
  chr22:49979613-49979653
  hypo
accccatccctgggccggggctgaccggtcatcagcgaaa

SEQ ID NO: 16816 - DNA, 130 bp, Homo sapiens
  chr22:50001685-50001815
  hypo
gcctctcctgggtgccggggattcagctgcgatgaacaggacaaagtccagatctcatgggaccggcatgggggtgatctcagggaggacaacagagaaaatggaagccaagaaccgggaacagggattc

SEQ ID NO: 16817 - DNA, 30 bp, Homo sapiens
  chr22:50002771-50002801
  hypo
ggacagtccctgcttcggctccccaggaac

SEQ ID NO: 16818 - DNA, 78 bp, Homo sapiens
  chr22:50003204-50003282
  hypo
cggttcctccaaacacgagacgcttggaacagggtctctgaggggtggacacaaaacagggaccgcagtctgtgcctc

SEQ ID NO: 16819 - DNA, 30 bp, Homo sapiens
  chr22:50007987-50008017
  hypo
agccccaacgacctgcggcacacggcacac

SEQ ID NO: 16820 - DNA, 30 bp, Homo sapiens
  chr22:50010606-50010636
  hypo
gaaggggcatccctgcgactttccatccac

SEQ ID NO: 16821 - DNA, 30 bp, Homo sapiens
  chr22:50024083-50024113
  hypo
ccccactaccacccccggcaagaccagaaa

SEQ ID NO: 16822 - DNA, 138 bp, Homo sapiens; identical to SEQ ID NO: 5269
  chr22:50149332-50149470
  hypo

SEQ ID NO: 16823 - DNA, 36 bp, Homo sapiens
  chr22:50170666-50170702
  hypo
gtccgggcgactcaccggctgcgatcctggccgcct

SEQ ID NO: 16824 - DNA, 77 bp, Homo sapiens
  chr22:50466962-50467039
  hypo
tgggaatcagggaggcggcaacacctgcgtgccgtcataaagacccccaccatgccctcgtaaagacccccatcaca

SEQ ID NO: 16825 - DNA, 105 bp, Homo sapiens
  chr22:50507059-50507164
  hypo
gggggcgggcatggccgggcactcatgggcatagtcccaagctggttccctgcatgactcctgctgaaacctctgccttttcttttttctttttctttttttttt

SEQ ID NO: 16826 - DNA, 30 bp, Homo sapiens
  chr22:50529568-50529598
  hypo
cgatgcccggggggccggctgtgttacctg

SEQ ID NO: 16827 - DNA, 30 bp, Homo sapiens
  chr22:50686625-50686655
  hypo
ctgcagcctagcacccggccacactgacct

SEQ ID NO: 16828 - DNA, 37 bp, Homo sapiens
  chr22:50695483-50695520
  hypo
ccctgcagcctcccccggggcccgtaccctcagcccc

SEQ ID NO: 16829 - DNA, 410 bp, Homo sapiens; identical to SEQ ID NO: 1644
  chr22:50899279-50899689
  hypo

SEQ ID NO: 16830 - DNA, 38 bp, Homo sapiens
  chrX:20160933-20160971
  hypo
cgcagtcctttcactcgcccagccgggttgggagcctg

SEQ ID NO: 16831 - DNA, 21 bp, Homo sapiens
  chrX:44755607-44755628
  hypo
tcaccgcgcccggccaaaaat

SEQ ID NO: 16832 - DNA, 30 bp, Homo sapiens
  AEKP01139090.1_11256-14570:719-749
  hypo
atggaagatagagaccgaaatttcaggtag

SEQ ID NO: 16833 - DNA, 86 bp, Homo sapiens
  AEKP01153556.1_1-5252:404-490
  hypo
catcaccattatctccaccactgttgctgtgaacgcatactgcactattatcacctgaggtacagtgacaacgttgtgtgatgcta

SEQ ID NO: 16834 - DNA, 126 bp, Homo sapiens
  AEKP01196136.1_22995-25251:484-610
  hypo
aaagaggcagggcaacgcgcactacagtgagggatcttacaggcctgtttttgagggaaaatggtaagtgagctacagcgagcacacgtgtgtagatcccagttacaggtccgtcaagatggctag

SEQ ID NO: 16835 - DNA, 34 bp, Homo sapiens
  NW_001838014.1_249000-295694:4094-4128
  hypo
agccagagccagagccgtgcggagacacggagcc

SEQ ID NO: 16836 - DNA, 37 bp, Homo sapiens
  NW_001841145.1_177495-186900:5222-5259
  hypo
atcaacctgctccctcgtgggtcgactttgcccacac

SEQ ID NO: 16837 - DNA, 30 bp, Homo sapiens
  NW_001841145.1_90215-97412:6862-6892
  hypo
ggcctggatgctgcacgggctcagtgtttc

SEQ ID NO: 16838 - DNA, 30 bp, Homo sapiens; identical to SEQ ID NO: 5271
  chr1:975836-975866
  hyper

SEQ ID NO: 16839 - DNA, 19 bp, Homo sapiens
  chr1:1475537-1475556
  hyper
ggccggggaggggagcgca

SEQ ID NO: 16840 - DNA, 39 bp, Homo sapiens; identical to SEQ ID NO: 5273
  chr1:1535851-1535890
  hyper

SEQ ID NO: 16841 - DNA, 30 bp, Homo sapiens; identical to SEQ ID NO: 5274
  chr1:1567286-1567316
  hyper

SEQ ID NO: 16842 - DNA, 33 bp, Homo sapiens; identical to SEQ ID NO: 5275
  chr1:1567781-1567814
  hyper

SEQ ID NO: 16843 - DNA, 154 bp, Homo sapiens
  chr1:2374994-2375148
  hyper
aaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgg

SEQ ID NO: 16844 - DNA, 62 bp, Homo sapiens
  chr1:2375543-2375605
  hyper
cggtggcacgggcaggggtgcgggcgcgggactgtgggcgggacgggcggagcggtcttgag

SEQ ID NO: 16845 - DNA, 64 bp, Homo sapiens; identical to SEQ ID NO: 5278
  chr1:2560861-2560925
  hyper

SEQ ID NO: 16846 - DNA, 30 bp, Homo sapiens; identical to SEQ ID NO: 5280
  chr1:2985189-2985219
  hyper

SEQ ID NO: 16847 - DNA, 42 bp, Homo sapiens; identical to SEQ ID NO: 5281
  chr1:2987163-2987205
  hyper

SEQ ID NO: 16848 - DNA, 69 bp, Homo sapiens; identical to SEQ ID NO: 5282
  chr1:3087621-3087690
  hyper

SEQ ID NO: 16849 - DNA, 85 bp, Homo sapiens; identical to SEQ ID NO: 5283
  chr1:3310353-3310438
  hyper

SEQ ID NO: 16850 - DNA, 51 bp, Homo sapiens
  chr1:3568226-3568277
  hyper
caagcgcaccgacgcccgcgagctccttccaaacaccgaacgggatccaga

SEQ ID NO: 16851 - DNA, 35 bp, Homo sapiens; identical to SEQ ID NO: 5287
  chr1:3663252-3663287
  hyper

SEQ ID NO: 16852 - DNA, 224 bp, Homo sapiens
  chr1:3663650-3663874
  hyper
gggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccat

SEQ ID NO: 16853 - DNA, 152 bp, Homo sapiens; identical to SEQ ID NO: 5289
  chr1:4712671-4712823
  hyper

SEQ ID NO: 16854 - DNA, 79 bp, Homo sapiens; identical to SEQ ID NO: 5295
  chr1:6208701-6208780
  hyper

SEQ ID NO: 16855 - DNA, 145 bp, Homo sapiens; identical to SEQ ID NO: 5296
  chr1:6241066-6241211
  hyper

SEQ ID NO: 16856 - DNA, 188 bp, Homo sapiens; identical to SEQ ID NO: 5297
  chr1:6301754-6301942
  hyper

SEQ ID NO: 16857 - DNA, 83 bp, Homo sapiens
  chr1:6304118-6304201
  hyper
gggagcttcccagtgcgtcctccctcggtcccctcctcctcaaggtttctagagtccagagggcctcattgacatgtaaacga

SEQ ID NO: 16858 - DNA, 68 bp, Homo sapiens
  chr1:6304242-6304310
  hyper
actgcaacatgggcacggagcctgctgcccggggcagcctccccggcaacttccgaaaggtctggggt

SEQ ID NO: 16859 - DNA, 763 bp, Homo sapiens; identical to SEQ ID NO: 5299
  chr1:6309258-6310021
  hyper

SEQ ID NO: 16860 - DNA, 146 bp, Homo sapiens
  chr1:6480368-6480514
  hyper
cagcaggggacccagcggttacgggagctcccatgagggacagcagcgggagggacttgcacccccagctgctttatcgggtgaagggctgagctggacgggaaatccgagttccggagaaaggtcgtgacttgctccagtcctcg

SEQ ID NO: 16861 - DNA, 54 bp, Homo sapiens
  chr1:6480831-6480885
  hyper
gctgcggcaaactggctggcgtcccccgcccatctgctccgggctcccctcccc

SEQ ID NO: 16862 - DNA, 15 bp, Homo sapiens
  chr1:6500973-6500988
  hyper
ctcactgcgtgcccc

SEQ ID NO: 16863 - DNA, 34 bp, Homo sapiens; identical to SEQ ID NO: 5303
  chr1:6507490-6507524
  hyper

SEQ ID NO: 16864 - DNA, 53 bp, Homo sapiens; identical to SEQ ID NO: 5305
  chr1:6508969-6509022
  hyper

SEQ ID NO: 16865 - DNA, 77 bp, Homo sapiens; identical to SEQ ID NO: 5306
  chr1:8002422-8002499
  hyper

SEQ ID NO: 16866 - DNA, 30 bp, Homo sapiens; identical to SEQ ID NO: 9
  chr1:8277113-8277143
  hyper

SEQ ID NO: 16867 - DNA, 48 bp, Homo sapiens; identical to SEQ ID NO: 5308
  chr1:9243236-9243284
  hyper

SEQ ID NO: 16868 - DNA, 270 bp, Homo sapiens
  chr1:9712291-9712561
  hyper
ggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagat

SEQ ID NO: 16869 - DNA, 78 bp, Homo sapiens; identical to SEQ ID NO: 5311
  chr1:10057431-10057509
  hyper

SEQ ID NO: 16870 - DNA, 38 bp, Homo sapiens
  chr1:10948582-10948620
  hyper
gcttcccgcccggggcggctgagcggtcccggggagag

SEQ ID NO: 16871 - DNA, 61 bp, Homo sapiens; identical to SEQ ID NO: 5314
  chr1:11752522-11752583
  hyper

SEQ ID NO: 16872 - DNA, 40 bp, Homo sapiens; identical to SEQ ID NO: 5315
  chr1:11919143-11919183
  hyper

SEQ ID NO: 16873 - DNA, 13 bp, Homo sapiens
  chr1:11959080-11959093
  hyper
acctggatccgag

SEQ ID NO: 16874 - DNA, 42 bp, Homo sapiens
  chr1:11959196-11959238
  hyper
tgtaggatttgtttcaagggctcagaccggcacagagccccc

SEQ ID NO: 16875 - DNA, 15 bp, Homo sapiens
  chr1:12123787-12123802
  hyper
cgcaagggaggacac

SEQ ID NO: 16876 - DNA, 134 bp, Homo sapiens; identical to SEQ ID NO: 5319
  chr1:13840532-13840666
  hyper

SEQ ID NO: 16877 - DNA, 106 bp, Homo sapiens
  chr1:13910330-13910436
  hyper
gcaaagtttgctgtccggctgcctagggtctgggaagctcgggcaccctccctctccggggctcctgctcccacccctccggcccccccaccgtcgcgctcctcca

SEQ ID NO: 16878 - DNA, 30 bp, Homo sapiens; identical to SEQ ID NO: 5322
  chr1:14219604-14219634
  hyper

SEQ ID NO: 16879 - DNA, 30 bp, Homo sapiens; identical to SEQ ID NO: 5323
  chr1:14924607-14924637
  hyper

SEQ ID NO: 16880 - DNA, 142 bp, Homo sapiens; identical to SEQ ID NO: 5324
  chr1:14925056-14925198
  hyper

SEQ ID NO: 16881 - DNA, 302 bp, Homo sapiens
  chr1:14925199-14925501
  hyper
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatgga

SEQ ID NO: 16882 - DNA, 80 bp, Homo sapiens; identical to SEQ ID NO: 5327
  chr1:16553585-16553665
  hyper

SEQ ID NO: 16883 - DNA, 30 bp, Homo sapiens; identical to SEQ ID NO: 5328
  chr1:16861712-16861742
  hyper

SEQ ID NO: 16884 - DNA, 55 bp, Homo sapiens; identical to SEQ ID NO: 5329
  chr1:18436492-18436547
  hyper

SEQ ID NO: 16885 - DNA, 156 bp, Homo sapiens; identical to SEQ ID NO: 5330
  chr1:18436827-18436983
  hyper

SEQ ID NO: 16886 - DNA, 229 bp, Homo sapiens; identical to SEQ ID NO: 13
  chr1:18437202-18437431
  hyper

SEQ ID NO: 16887 - DNA, 25 bp, Homo sapiens
  chr1:18437432-18437457
  hyper
ggggtctccgggattgcgcgggcgg

SEQ ID NO: 16888 - DNA, 79 bp, Homo sapiens; identical to SEQ ID NO: 5333
  chr1:18437738-18437817
  hyper

SEQ ID NO: 16889 - DNA, 45 bp, Homo sapiens
  chr1:18956811-18956856
  hyper
caagtcaccctaggccggttcccggggagcctcactggaggaatt

SEQ ID NO: 16890 - DNA, 41 bp, Homo sapiens
  chr1:18957246-18957287
  hyper
ccctcctcatgaataaaagaaaagtccgaacctatcagatc

SEQ ID NO: 16891 - DNA, 48 bp, Homo sapiens
  chr1:18957985-18958033
  hyper
ttaaaaaaaagaagacgaagaagacggaaagaaagagatcgcagcagg

SEQ ID NO: 16892 - DNA, 58 bp, Homo sapiens; identical to SEQ ID NO: 5338
  chr1:18958829-18958887
  hyper

SEQ ID NO: 16893 - DNA, 35 bp, Homo sapiens; identical to SEQ ID NO: 5339
  chr1:18959220-18959255
  hyper

SEQ ID NO: 16894 - DNA, 123 bp, Homo sapiens; identical to SEQ ID NO: 5340
  chr1:18959573-18959696
  hyper

SEQ ID NO: 16895 - DNA, 26 bp, Homo sapiens
  chr1:18963135-18963161
  hyper
gcggggctgcgcgcctggtctacccc

SEQ ID NO: 16896 - DNA, 30 bp, Homo sapiens; identical to SEQ ID NO: 5343
  chr1:18963693-18963723
  hyper

SEQ ID NO: 16897 - DNA, 96 bp, Homo sapiens; identical to SEQ ID NO: 5344
  chr1:18964297-18964393
  hyper

SEQ ID NO: 16898 - DNA, 94 bp, Homo sapiens; identical to SEQ ID NO: 5345
  chr1:18968003-18968097
  hyper

SEQ ID NO: 16899 - DNA, 92 bp, Homo sapiens
  chr1:18969533-18969625
  hyper
ctgggagaggaaaagcgtctgcgggtcgctacagcctcgggaggggtgaagggaagttgtgtgcgccccaagtccagctcaaaagaggcccc

SEQ ID NO: 16900 - DNA, 339 bp, Homo sapiens
  chr1:18969819-18970158
  hyper
ggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagat

SEQ ID NO: 16901 - DNA, 30 bp, Homo sapiens; identical to SEQ ID NO: 5347
  chr1:18970361-18970391
  hyper

SEQ ID NO: 16902 - DNA, 64 bp, Homo sapiens; identical to SEQ ID NO: 5348
  chr1:18971750-18971814
  hyper

SEQ ID NO: 16903 - DNA, 29 bp, Homo sapiens
  chr1:19043114-19043143
  hyper
cgtctccctgatcgcgtcataaccctgag

SEQ ID NO: 16904 - DNA, 107 bp, Homo sapiens
  chr1:19043456-19043563
  hyper
gggcgggggttggggcggcggccggagcggggatcgggtctggggggatccgcgcggccgcccctccccgcgctccgccgccgccgccgtcgccgccgcgcctttga

SEQ ID NO: 16905 - DNA, 65 bp, Homo sapiens
  chr1:19043678-19043743
  hyper
gcttaattcccgctgcccgggcctgggatcccgagcagccgcgcgcctggccgccccccggactg

SEQ ID NO: 16906 - DNA, 151 bp, Homo sapiens; identical to SEQ ID NO: 5351
  chr1:19043756-19043907
  hyper

SEQ ID NO: 16907 - DNA, 160 bp, Homo sapiens
  chr1:20618169-20618329
  hyper
atgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagca

SEQ ID NO: 16908 - DNA, 76 bp, Homo sapiens
  chr1:20618369-20618445
  hyper
ctggaagttccaccataacgtctgcggcagccccaacagttccaccccatgctcccgccgccggcaccacagcagc

SEQ ID NO: 16909 - DNA, 72 bp, Homo sapiens; identical to SEQ ID NO: 5353
  chr1:20669776-20669848
  hyper

SEQ ID NO: 16910 - DNA, 40 bp, Homo sapiens; identical to SEQ ID NO: 5354
  chr1:20692819-20692859
  hyper

SEQ ID NO: 16911 - DNA, 55 bp, Homo sapiens; identical to SEQ ID NO: 5355
  chr1:20810635-20810690
  hyper

SEQ ID NO: 16912 - DNA, 92 bp, Homo sapiens; identical to SEQ ID NO: 5356
  chr1:20878524-20878616
  hyper

SEQ ID NO: 16913 - DNA, 124 bp, Homo sapiens; identical to SEQ ID NO: 5357
  chr1:20878905-20879029
  hyper

SEQ ID NO: 16914 - DNA, 5 bp, Homo sapiens
  chr1:20879030-20879035
  hyper
acgcc

SEQ ID NO: 16915 - DNA, 148 bp, Homo sapiens
  chr1:20879289-20879437
  hyper
catctgcgaagctagccctgcctggcactgggcatctccaggcaacgactgtccccggccctgcccagcttctcgcgactccagggcggtggacttctgcgcgccttccctcccccggtctcccgacaggacgccggtgagctccctg

SEQ ID NO: 16916 - DNA, 100 bp, Homo sapiens
  chr1:20879462-20879562
  hyper
cgcgatgctgccctggagacgtaacaaattcgtgctggtggaggacgaggccaagtgcaaggcgaagagcctgagtccggggctcgcctacacgtcgctg

SEQ ID NO: 16917 - DNA, 225 bp, Homo sapiens
  chr1:20879957-20880182
  hyper
ccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcct

SEQ ID NO: 16918 - DNA, 43 bp, Homo sapiens
  chr1:21044161-21044204
  hyper
cggcagcgcacgacaaccttcaccgcctcggaggccatggcgc

SEQ ID NO: 16919 - DNA, 102 bp, Homo sapiens; identical to SEQ ID NO: 5363
  chr1:21754482-21754584
  hyper

SEQ ID NO: 16920 - DNA, 42 bp, Homo sapiens; identical to SEQ ID NO: 5364
  chr1:21835408-21835450
  hyper

SEQ ID NO: 16921 - DNA, 50 bp, Homo sapiens; identical to SEQ ID NO: 5365
  chr1:21836105-21836155
  hyper

SEQ ID NO: 16922 - DNA, 70 bp, Homo sapiens
  chr1:22140683-22140753
  hyper
aagggattgtagatttgaattaaattaaattaaatcatttaatccttacaatcattctgagattgattaa

SEQ ID NO: 16923 - DNA, 118 bp, Homo sapiens
  chr1:22141184-22141302
  hyper
ggtccccactgtgcggcctgaacatcccggtgcctgtggcatcctccggaccctttctaggcctgcgcctggtcacgagaggccgccagccccgcgtggacttcgtgggcgaagtcac

SEQ ID NO: 16924 - DNA, 30 bp, Homo sapiens; identical to SEQ ID NO: 5368
  chr1:22933907-22933937
  hyper

SEQ ID NO: 16925 - DNA, 120 bp, Homo sapiens
  chr1:23748862-23748982
  hyper
gtatgtagctgtgaccgtaggcacttggttgcatgtttgaagttgcttctgttagtgcatgctcagaggatgtgacaaagccttaagtggctgagacttcagcaaccggcagtaaacccc

SEQ ID NO: 16926 - DNA, 47 bp, Homo sapiens
  chr1:23749070-23749117
  hyper
tcccagagcaggccccacctttctcggccagacgcccagagctccat

SEQ ID NO: 16927 - DNA, 342 bp, Homo sapiens
  chr1:25256012-25256354
  hyper
ctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaata

SEQ ID NO: 16928 - DNA, 441 bp, Homo sapiens
  chr1:25256383-25256824
  hyper
caggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctgg

SEQ ID NO: 16929 - DNA, 106 bp, Homo sapiens; identical to SEQ ID NO: 5372
  chr1:26372988-26373094
  hyper

SEQ ID NO: 16930 - DNA, 282 bp, Homo sapiens
  chr1:26551804-26552086
  hyper
caaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagctt

SEQ ID NO: 16931 - DNA, 309 bp, Homo sapiens; identical to SEQ ID NO: 5374
  chr1:26735645-26735954
  hyper

SEQ ID NO: 16932 - DNA, 337 bp, Homo sapiens
  chr1:26737246-26737583
  hyper
cgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggc

SEQ ID NO: 16933 - DNA, 33 bp, Homo sapiens
  chr1:26737613-26737646
  hyper
aggagaggcttgtcccgccgtgagtctctggga

SEQ ID NO: 16934 - DNA, 82 bp, Homo sapiens; identical to SEQ ID NO: 5376
  chr1:26738220-26738302
  hyper

SEQ ID NO: 16935 - DNA, 138 bp, Homo sapiens; identical to SEQ ID NO: 5377
  chr1:28199339-28199477
  hyper

SEQ ID NO: 16936 - DNA, 52 bp, Homo sapiens; identical to SEQ ID NO: 5378
  chr1:29138840-29138892
  hyper

SEQ ID NO: 16937 - DNA, 164 bp, Homo sapiens; identical to SEQ ID NO: 5379
  chr1:29448530-29448694
  hyper

SEQ ID NO: 16938 - DNA, 6 bp, Homo sapiens
  chr1:29586066-29586072
  hyper
cctctt

SEQ ID NO: 16939 - DNA, 108 bp, Homo sapiens; identical to SEQ ID NO: 5382
  chr1:30559030-30559138
  hyper

SEQ ID NO: 16940 - DNA, 213 bp, Homo sapiens
  chr1:32180184-32180397
  hyper
actcctaatccttcccggctgtggctgctaccgcttgccccgccggcaccgccctgccaagggcgcagagtcgggccagcagagccggagtgatgccgggccatcgaggcgtcctcagcccccgaggtgggaggtggtgggggggcggggaggagaagaagaaggctctcccgacacggtgactcaggcctccttgacccgctcctgggtggg

SEQ ID NO: 16941 - DNA, 228 bp, Homo sapiens; identical to SEQ ID NO: 5385
  chr1:32180905-32181133
  hyper

SEQ ID NO: 16942 - DNA, 15 bp, Homo sapiens
  chr1:32237531-32237546
  hyper
cccaccgccggaagc

SEQ ID NO: 16943 - DNA, 139 bp, Homo sapiens
  chr1:32238507-32238646
  hyper
agggaccccgggcccgccgccagccctgggcacacccgccccttcctccagcggccccgctcgctgacccacgggcactcgatgggcactcgggaggcaatggccggagaggatgggcagttagcgggagggactgagt

SEQ ID NO: 16944 - DNA, 42 bp, Homo sapiens
  chr1:32410234-32410276
  hyper
ctagagcttcccctgcgtccgcctttgggggaggggagggag

SEQ ID NO: 16945 - DNA, 58 bp, Homo sapiens
  chr1:32410306-32410364
  hyper
gtcgctcggggcgtgggtccgcgcgcggaggggctcgctgtcccggtgccagcgggag

SEQ ID NO: 16946 - DNA, 16 bp, Homo sapiens
  chr1:32827808-32827824
  hyper
ggcctctggccatggc

SEQ ID NO: 16947 - DNA, 240 bp, Homo sapiens; identical to SEQ ID NO: 5390
  chr1:32930682-32930922
  hyper

SEQ ID NO: 16948 - DNA, 35 bp, Homo sapiens; identical to SEQ ID NO: 5391
  chr1:33351678-33351713
  hyper

SEQ ID NO: 16949 - DNA, 30 bp, Homo sapiens; identical to SEQ ID NO: 5392
  chr1:33772555-33772585
  hyper

SEQ ID NO: 16950 - DNA, 121 bp, Homo sapiens
  chr1:34628827-34628948
  hyper
cagcgattcccccaccgcccatgtggcaagtctgggtgaccagcagcgtcggtatgcacagcctcccagtgggtgtgggtgtgcgagaggccagagctcccaggcgcgcgcaccgcgggcg

SEQ ID NO: 16951 - DNA, 491 bp, Homo sapiens
  chr1:34628978-34629469
  hyper
ttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggg

SEQ ID NO: 16952 - DNA, 84 bp, Homo sapiens
  chr1:34629728-34629812
  hyper
tggcgcggagtgagcaccgaggggaatgtggcagcgcgaagcctggcggcggcactccctcccccgcctcgggctacaaccccc

SEQ ID NO: 16953 - DNA, 303 bp, Homo sapiens
  chr1:34630245-34630548
  hyper
cccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccag

SEQ ID NO: 16954 - DNA, 224 bp, Homo sapiens
  chr1:34630635-34630859
  hyper
gccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggaga

SEQ ID NO: 16955 - DNA, 8 bp, Homo sapiens
  chr1:34630978-34630986
  hyper
ccaaatgc

SEQ ID NO: 16956 - DNA, 30 bp, Homo sapiens; identical to SEQ ID NO: 5395
  chr1:34631535-34631565
  hyper

SEQ ID NO: 16957 - DNA, 192 bp, Homo sapiens; identical to SEQ ID NO: 5396
  chr1:34632140-34632332
  hyper

SEQ ID NO: 16958 - DNA, 21 bp, Homo sapiens
  chr1:34642862-34642883
  hyper
gctctgcgaggggctccctgg

SEQ ID NO: 16959 - DNA, 59 bp, Homo sapiens
  chr1:35258578-35258637
  hyper
cccccgccgctcgtgcggtccagcagggctcccgcgggcgtcactccggccatcgtccc

SEQ ID NO: 16960 - DNA, 39 bp, Homo sapiens
  chr1:35351039-35351078
  hyper
cagggtcagagccctcgtgggcgcctccccgttccatac

SEQ ID NO: 16961 - DNA, 100 bp, Homo sapiens
  chr1:35351659-35351759
  hyper
aaggtgtactcacaggagccgggcctccctgagacagcggcaggggtagcgaggaggggcaggcagtcgtcgtcttgagagcagccggcctggatggccc

SEQ ID NO: 16962 - DNA, 60 bp, Homo sapiens; identical to SEQ ID NO: 5400
  chr1:35390613-35390673
  hyper

SEQ ID NO: 16963 - DNA, 1 bp, Homo sapiens
  chr1:35395525-35395526
  hyper
c

SEQ ID NO: 16964 - DNA, 36 bp, Homo sapiens; identical to SEQ ID NO: 5403
  chr1:35395964-35396000
  hyper

SEQ ID NO: 16965 - DNA, 130 bp, Homo sapiens
  chr1:36042549-36042679
  hyper
ggaccccagcgccagcgggaccccagcgccagcgggaccccagcgccagcgggaccccagcgccagcgggaccccagcgccagcgggaccccagcgccagcgggtctgtggcccagtggagcgagtggag

SEQ ID NO: 16966 - DNA, 30 bp, Homo sapiens; identical to SEQ ID NO: 5405
  chr1:36549840-36549870
  hyper

SEQ ID NO: 16967 - DNA, 39 bp, Homo sapiens
  chr1:37498753-37498792
  hyper
aacaaagttaaagaccggagtaagagtctccggcgagaa

SEQ ID NO: 16968 - DNA, 2 bp, Homo sapiens
  chr1:37500153-37500155
  hyper
cc

SEQ ID NO: 16969 - DNA, 105 bp, Homo sapiens
  chr1:38219795-38219900
  hyper
accctgccctcaccaccacctggatcaggccttccttcttggccactcccaccccccaccctccgcagtgcagcctggaggggggactcacgggtgcaggaagcc

SEQ ID NO: 16970 - DNA, 156 bp, Homo sapiens
  chr1:38230623-38230779
  hyper
tcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagcc

SEQ ID NO: 16971 - DNA, 91 bp, Homo sapiens
  chr1:38510087-38510178
  hyper
aggagggcagggccccgcggggagcaggggccgcgctatgcggcggtcggtctgcagcagggcagaagccccttcccgtctgggtgtgtgg

SEQ ID NO: 16972 - DNA, 32 bp, Homo sapiens
  chr1:38510217-38510249
  hyper
ggctcggatgaaacgaaacgaaaaatgaacac

SEQ ID NO: 16973 - DNA, 254 bp, Homo sapiens
  chr1:38510309-38510563
  hyper
gtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggag

SEQ ID NO: 16974 - DNA, 110 bp, Homo sapiens
  chr1:38510624-38510734
  hyper
ccacgcggggagaggggatggagaactctcctcgcttcgtcctctctcccggggaatccctaaccccgcactgcgttacctgtcgctttggggaggccgctgccgggatc

SEQ ID NO: 16975 - DNA, 81 bp, Homo sapiens
  chr1:38510773-38510854
  hyper
cgaggggatgggggcagagagcaggcggcgggcaggatgcccggggtgagttggcgagttccggatcttcgctcctctctc

SEQ ID NO: 16976 - DNA, 218 bp, Homo sapiens
  chr1:38511119-38511337
  hyper
cggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcact

SEQ ID NO: 16977 - DNA, 266 bp, Homo sapiens
  chr1:38511824-38512090
  hyper
ctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgc

SEQ ID NO: 16978 - DNA, 64 bp, Homo sapiens; identical to SEQ ID NO: 5421
  chr1:39044122-39044186
  hyper

SEQ ID NO: 16979 - DNA, 98 bp, Homo sapiens
  chr1:39269643-39269741
  hyper
ccgactagcattgatcgctttttgatcttaaaagaaatactttttaattcgaaagttaatagaaatgcggagtcaggggcaggcctcggcggcgtccg

SEQ ID NO: 16980 - DNA, 165 bp, Homo sapiens; identical to SEQ ID NO: 5423
  chr1:40105139-40105304
  hyper

SEQ ID NO: 16981 - DNA, 79 bp, Homo sapiens; identical to SEQ ID NO: 5424
  chr1:40105538-40105617
  hyper

SEQ ID NO: 16982 - DNA, 58 bp, Homo sapiens
  chr1:40237083-40237141
  hyper
caacagggagggggccggctccgccctgggctgggggcccccgagtcagtcctccgtg

SEQ ID NO: 16983 - DNA, 173 bp, Homo sapiens; identical to SEQ ID NO: 5426
  chr1:40781428-40781601
  hyper

SEQ ID NO: 16984 - DNA, 91 bp, Homo sapiens; identical to SEQ ID NO: 5427
  chr1:41267904-41267995
  hyper

SEQ ID NO: 16985 - DNA, 133 bp, Homo sapiens
  chr1:41284463-41284596
  hyper
tgtggcctgcgggggttggagccctagcaggaggcgaggtctaagcgggtggggcgaagtggattctgaattaggtaggggcgggcctaggagtccggaccggatcagggggcggggccggagaggcggggct

SEQ ID NO: 16986 - DNA, 30 bp, Homo sapiens; identical to SEQ ID NO: 5429
  chr1:41327007-41327037
  hyper

SEQ ID NO: 16987 - DNA, 9 bp, Homo sapiens
  chr1:41350136-41350145
  hyper
cgcgctcac

SEQ ID NO: 16988 - DNA, 105 bp, Homo sapiens
  chr1:41847478-41847583
  hyper
gcagctgcaggcgcccgagcgaagcccggacgacagctccccgagtgcgcccgccccggggccggtgcctgccgcagccaagtgggccgccagccccgcctcgca

SEQ ID NO: 16989 - DNA, 190 bp, Homo sapiens
  chr1:41847702-41847892
  hyper
tcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcc

SEQ ID NO: 16990 - DNA, 11 bp, Homo sapiens
  chr1:43533901-43533912
  hyper
ggtgtgcgccc

SEQ ID NO: 16991 - DNA, 30 bp, Homo sapiens; identical to SEQ ID NO: 5433
  chr1:43534162-43534192
  hyper

SEQ ID NO: 16992 - DNA, 84 bp, Homo sapiens
  chr1:44873706-44873790
  hyper
cccagagtattctatatacaaaggcaaccgagagccggagggagaggtcgggccaaagagtagtgggctcggctccgcgttggg

SEQ ID NO: 16993 - DNA, 91 bp, Homo sapiens; identical to SEQ ID NO: 5441
  chr1:45250257-45250348
  hyper

SEQ ID NO: 16994 - DNA, 32 bp, Homo sapiens; identical to SEQ ID NO: 5442
  chr1:45252161-45252193
  hyper

SEQ ID NO: 16995 - DNA, 112 bp, Homo sapiens
  chr1:46632764-46632876
  hyper
gctgcgggactctagcggggaaggcacccccaattctgggccctggcgaccttgggtcagggccaggaaaggcacttccagccaagcgctggcgccgggtgcgcctcgcttt

SEQ ID NO: 16996 - DNA, 22 bp, Homo sapiens
  chr1:46632923-46632945
  hyper
gcagccgcgagaaggctagctg

SEQ ID NO: 16997 - DNA, 137 bp, Homo sapiens; identical to SEQ ID NO: 1694
  chr1:46914285-46914422
  hyper

SEQ ID NO: 16998 - DNA, 11 bp, Homo sapiens
  chr1:46951196-46951207
  hyper
gtagccgtcgg

SEQ ID NO: 16999 - DNA, 67 bp, Homo sapiens
  chr1:46956387-46956454
  hyper
ttgagggtggttcggcgctcagccagcctctgccctcgaagacgcggccttggtctaggaaccttca

SEQ ID NO: 17000 - DNA, 13 bp, Homo sapiens
  chr1:46956603-46956616
  hyper
agtcaaagggttg

SEQ ID NO: 17001 - DNA, 139 bp, Homo sapiens
  chr1:46956684-46956823
  hyper
cgacaggccaggggccctgatggactgtgcagggtcccgggcaccaccggctgaactttctggcggtcacaaattcccggaacctgcgcaggggcttcgttggcactggtggttcacttaaggagcttgagggaaacct

SEQ ID NO: 17002 - DNA, 326 bp, Homo sapiens; identical to SEQ ID NO: 36
  chr1:47009560-47009886
  hyper

SEQ ID NO: 17003 - DNA, 19 bp, Homo sapiens
  chr1:47009910-47009929
  hyper
cgcctcccgccacccggaa

SEQ ID NO: 17004 - DNA, 28 bp, Homo sapiens
  chr1:47010104-47010132
  hyper
cgtccgcactttccgagagccaggcacg

SEQ ID NO: 17005 - DNA, 30 bp, Homo sapiens; identical to SEQ ID NO: 5456
  chr1:47695896-47695926
  hyper

SEQ ID NO: 17006 - DNA, 201 bp, Homo sapiens
  chr1:47696620-47696821
  hyper
cgaatgtccccacccgaggctcgaggcctggtgaatgtgcccattgtcctttcggggcctctcccttggagcccggcggccgcacccacgaaactgaccagaaatggatgaagccggagtgcagcgggaaccgaagcccgcagctaccggctcgaaggcgccggcctcggcgagcgctgctcagcttcaagcctggaggag

SEQ ID NO: 17007 - DNA, 15 bp, Homo sapiens
  chr1:47697341-47697356
  hyper
tgctgagaacaccaa

SEQ ID NO: 17008 - DNA, 222 bp, Homo sapiens
  chr1:47697510-47697732
  hyper
tgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggag

SEQ ID NO: 17009 - DNA, 12 bp, Homo sapiens
  chr1:47882051-47882063
  hyper
tcgcgccgtcgg

SEQ ID NO: 17010 - DNA, 143 bp, Homo sapiens
  chr1:47909575-47909718
  hyper
ttgctcttgccacagcgggcgcgtcttcgtggttacaaagcgctttttccctgatgacttttttccccttttcaaaaacacttctttctccccccttcaactagcaaccctccccaggcccacccctcctccctctccgctcc

SEQ ID NO: 17011 - DNA, 21 bp, Homo sapiens
  chr1:48059057-48059078
  hyper
gggctagggggaggccgggcg

SEQ ID NO: 17012 - DNA, 36 bp, Homo sapiens
  chr1:48059243-48059279
  hyper
ggtggggctcagtctgtctctcgttttctctccctg

SEQ ID NO: 17013 - DNA, 52 bp, Homo sapiens; identical to SEQ ID NO: 5468
  chr1:48191010-48191062
  hyper

SEQ ID NO: 17014 - DNA, 79 bp, Homo sapiens; identical to SEQ ID NO: 5469
  chr1:48462159-48462238
  hyper

SEQ ID NO: 17015 - DNA, 1 bp, Homo sapiens
  chr1:49242343-49242344
  hyper
g

SEQ ID NO: 17016 - DNA, 64 bp, Homo sapiens; identical to SEQ ID NO: 5472
  chr1:49242884-49242948
  hyper

SEQ ID NO: 17017 - DNA, 166 bp, Homo sapiens
  chr1:50513745-50513911
  hyper
gagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacgg

SEQ ID NO: 17018 - DNA, 34 bp, Homo sapiens; identical to SEQ ID NO: 5474
  chr1:50514141-50514175
  hyper

SEQ ID NO: 17019 - DNA, 626 bp, Homo sapiens
  chr1:50798652-50799278
  hyper
aaaggccagctggggcgccagacgactcgccctgccccgtcgacgccccagacggtgttgccgacctccgccccgcagcgctggtgtgggcgcggccggacctcactcagcctgcactgccccgcgccgctcgccgcgtccacactgtccttgggaggacgcgcggggaagccgcgcacgatgcggcagcgccccctgccgggctccgggcgctccgctcccagccggctcggcgagtgctccgggaaaggggtccggaccccacacgcactgggttccaggacaggctctcgctcgggctgggccgactctggcccgcctaggccccgggcacgctgcagtgaaggcggtaccctcaccacagtcacagaacgtgtcggctgcccgcgcgtcctcccaaggacagtggacgggagctggggctggagagggtaacgacctgcccaaggtcacacagcaccgcagtggcacagccaggactggcacccacacctcccgcggaaccttgcaggggcccaaaccacctgggttctagagctccttgaactggcctcttgggctttagggaagagctggggacgagggaatggggtggggccacaccacattagcacggacccttgggt

SEQ ID NO: 17020 - DNA, 120 bp, Homo sapiens
  chr1:50799400-50799520
  hyper
agccgcggctgccccctactggcggaaggaagagtcgccgctccggggcccttggcggccgccgctcttcgcgcctccttggcctggctgccacccttccaccctcgggggagaccccgc

SEQ ID NO: 17021 - DNA, 84 bp, Homo sapiens
  chr1:50886104-50886188
  hyper
aaaccagggagggtgcggaagaaactagaaggagggagggcgcagcaagcggttgtccagagggcgttaggaacgcgagaaggg

SEQ ID NO: 17022 - DNA, 30 bp, Homo sapiens; identical to SEQ ID NO: 5489
  chr1:50888238-50888268
  hyper

SEQ ID NO: 17023 - DNA, 34 bp, Homo sapiens
  chr1:50888675-50888709
  hyper
ctctcccagacccttcgggcgtccctaaggccca

SEQ ID NO: 17024 - DNA, 310 bp, Homo sapiens
  chr1:50889510-50889820
  hyper
gcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtg

SEQ ID NO: 17025 - DNA, 256 bp, Homo sapiens
  chr1:50892351-50892607
  hyper
gaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccagggg

SEQ ID NO: 17026 - DNA, 140 bp, Homo sapiens
  chr1:53098702-53098842
  hyper
tcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcaga

SEQ ID NO: 17027 - DNA, 299 bp, Homo sapiens
  chr1:53099067-53099366
  hyper
caggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcaggtaccgtccctggccctca

SEQ ID NO: 17028 - DNA, 52 bp, Homo sapiens; identical to SEQ ID NO: 5503
  chr1:53168843-53168895
  hyper

SEQ ID NO: 17029 - DNA, 9 bp, Homo sapiens
  chr1:53308559-53308568
  hyper
ttcatttct

SEQ ID NO: 17030 - DNA, 27 bp, Homo sapiens
  chr1:53309248-53309275
  hyper
cccagcctttgccgaatgcctgttact

SEQ ID NO: 17031 - DNA, 30 bp, Homo sapiens; identical to SEQ ID NO: 5506
  chr1:53527576-53527606
  hyper

SEQ ID NO: 17032 - DNA, 92 bp, Homo sapiens; identical to SEQ ID NO: 5507
  chr1:53527939-53528031
  hyper

SEQ ID NO: 17033 - DNA, 119 bp, Homo sapiens
  chr1:53528255-53528374
  hyper
gaaagaatctgagggcggttgggggcgggggctggagtgggaggacgccggcgggcgacagggaatgtggggggcaggtggaactgcgtaggggcggggacccctgtcatgagagcctg

SEQ ID NO: 17034 - DNA, 135 bp, Homo sapiens; identical to SEQ ID NO: 5510
  chr1:55462748-55462883
  hyper

SEQ ID NO: 17035 - DNA, 30 bp, Homo sapiens; identical to SEQ ID NO: 5511
  chr1:57111203-57111233
  hyper

SEQ ID NO: 17036 - DNA, 40 bp, Homo sapiens
  chr1:57888327-57888367
  hyper
ctctcccagcctaagcggaagtgccccagcagacccccaa

SEQ ID NO: 17037 - DNA, 207 bp, Homo sapiens
  chr1:57888780-57888987
  hyper
gcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagag

SEQ ID NO: 17038 - DNA, 16 bp, Homo sapiens
  chr1:57889087-57889103
  hyper
tcgaagccgaatctca

SEQ ID NO: 17039 - DNA, 280 bp, Homo sapiens
  chr1:57889654-57889934
  hyper
tccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccgggg

SEQ ID NO: 17040 - DNA, 64 bp, Homo sapiens
  chr1:57890367-57890431
  hyper
gcaggagggggcgctcgctcccagccgccagtgcaggttcggcggctcctgttttgactgaggt

SEQ ID NO: 17041 - DNA, 400 bp, Homo sapiens; identical to SEQ ID NO: 5521
  chr1:59042095-59042495
  hyper

SEQ ID NO: 17042 - DNA, 30 bp, Homo sapiens; identical to SEQ ID NO: 5522
  chr1:62784565-62784595
  hyper

SEQ ID NO: 17043 - DNA, 256 bp, Homo sapiens; identical to SEQ ID NO: 5523
  chr1:62784890-62785146
  hyper

SEQ ID NO: 17044 - DNA, 32 bp, Homo sapiens; identical to SEQ ID NO: 5525
  chr1:63784373-63784405
  hyper

SEQ ID NO: 17045 - DNA, 306 bp, Homo sapiens; identical to SEQ ID NO: 56
  chr1:63784987-63785293
  hyper

SEQ ID NO: 17046 - DNA, 102 bp, Homo sapiens; identical to SEQ ID NO: 1737
  chr1:63786656-63786758
  hyper

SEQ ID NO: 17047 - DNA, 42 bp, Homo sapiens
  chr1:63787568-63787610
  hyper
atacaggaaaacacgcccgcatcaagccgggaaagagcaggt

SEQ ID NO: 17048 - DNA, 64 bp, Homo sapiens
  chr1:63788359-63788423
  hyper
cctggaccgctcctgcgccccacgccagggccagaggccgaggaaggcgggctaagtgaggggg

SEQ ID NO: 17049 - DNA, 117 bp, Homo sapiens
  chr1:63788557-63788674
  hyper
gagtgtgagctgagcccagcgggccccaagccacctgcggccccctcccctctccctgccccccatctttcgggggcactcaaaccctcttcccctgagctccgtggcagcccccga

SEQ ID NO: 17050 - DNA, 106 bp, Homo sapiens
  chr1:65731231-65731337
  hyper
gggggaagagagaaacgaatttaaataaaaactcaaaaaaggaaagggctaaccgaaaaatgagccaaccaaattttaagttcaacaacaagcattctggaggatt

SEQ ID NO: 17051 - DNA, 60 bp, Homo sapiens
  chr1:65731446-65731506
  hyper
ggggagcccttccttcctattgcgctggtcgtgctcctggcccgcgtgcccaggaagggc

SEQ ID NO: 17052 - DNA, 125 bp, Homo sapiens
  chr1:65991321-65991446
  hyper
acctccccacgcactcggctgccctcctcctctcctgagagttgccccgcaccttgggcgaggagttcggagcggccccatcgcagagcccacggccagccgagcgcgcgcgacgcaggtgcccg

SEQ ID NO: 17053 - DNA, 139 bp, Homo sapiens; identical to SEQ ID NO: 5545
  chr1:66259292-66259431
  hyper

SEQ ID NO: 17054 - DNA, 43 bp, Homo sapiens; identical to SEQ ID NO: 5547
  chr1:66999572-66999615
  hyper

SEQ ID NO: 17055 - DNA, 99 bp, Homo sapiens
  chr1:67217965-67218064
  hyper
agttcccctccagctcgccgccaacccaggacgcagcccggctcagagtgacccccagtgggcagtgaagatgagatcctctacatccttagggcagct

SEQ ID NO: 17056 - DNA, 39 bp, Homo sapiens; identical to SEQ ID NO: 5550
  chr1:70033537-70033576
  hyper

SEQ ID NO: 17057 - DNA, 470 bp, Homo sapiens
  chr1:70033989-70034459
  hyper
cggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgc

SEQ ID NO: 17058 - DNA, 48 bp, Homo sapiens; identical to SEQ ID NO: 5554
  chr1:71513699-71513747
  hyper

SEQ ID NO: 17059 - DNA, 76 bp, Homo sapiens; identical to SEQ ID NO: 5555
  chr1:72747951-72748027
  hyper

SEQ ID NO: 17060 - DNA, 158 bp, Homo sapiens; identical to SEQ ID NO: 5556
  chr1:72750097-72750255
  hyper

SEQ ID NO: 17061 - DNA, 30 bp, Homo sapiens; identical to SEQ ID NO: 5557
  chr1:72750522-72750552
  hyper

SEQ ID NO: 17062 - DNA, 30 bp, Homo sapiens; identical to SEQ ID NO: 5558
  chr1:75595334-75595364
  hyper

SEQ ID NO: 17063 - DNA, 22 bp, Homo sapiens
  chr1:75600203-75600225
  hyper
cttttattagtggatcggggcg

SEQ ID NO: 17064 - DNA, 77 bp, Homo sapiens
  chr1:75600848-75600925
  hyper
acctaaaatgccaaaagaaaaccgcagggcacaaaacgagtcacgcggtttgtctgagtagactggggaagctgaca

SEQ ID NO: 17065 - DNA, 107 bp, Homo sapiens
  chr1:75603052-75603159
  hyper
tgaaggttgtaggcttttgcagaaaatcagcccagtttagggcaactcatgcggtgggataaagtgagaagaaatcccagactcttctatgtcgttgcaaaacagct

SEQ ID NO: 17066 - DNA, 206 bp, Homo sapiens
  chr1:76080278-76080484
  hyper
gaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcct

SEQ ID NO: 17067 - DNA, 190 bp, Homo sapiens
  chr1:76080768-76080958
  hyper
aagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggag

SEQ ID NO: 17068 - DNA, 169 bp, Homo sapiens
  chr1:76082209-76082378
  hyper
accagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 17069 - DNA, 30 bp, Homo sapiens; identical to SEQ ID NO: 5573
  chr1:76540210-76540240
  hyper

SEQ ID NO: 17070 - DNA, 30 bp, Homo sapiens; identical to SEQ ID NO: 5576
  chr1:77333003-77333033
  hyper

SEQ ID NO: 17071 - DNA, 54 bp, Homo sapiens; identical to SEQ ID NO: 5580
  chr1:77334828-77334882
  hyper

SEQ ID NO: 17072 - DNA, 59 bp, Homo sapiens
  chr1:77747307-77747366
  hyper
agttcctcggagacccggaggtaaccgtgtatgtgcgtgcgagtgtgtctgtgtgcgta

SEQ ID NO: 17073 - DNA, 273 bp, Homo sapiens
  chr1:77747453-77747726
  hyper
tgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcc

SEQ ID NO: 17074 - DNA, 318 bp, Homo sapiens; identical to SEQ ID NO: 5583
  chr1:77748403-77748721
  hyper

SEQ ID NO: 17075 - DNA, 178 bp, Homo sapiens; identical to SEQ ID NO: 5584
  chr1:78354744-78354922
  hyper

SEQ ID NO: 17076 - DNA, 13 bp, Homo sapiens
  chr1:78511453-78511466
  hyper
attgttctgtagc

SEQ ID NO: 17077 - DNA, 61 bp, Homo sapiens
  chr1:78957231-78957292
  hyper
cacgtcctcactccccgtgcccgggatgagggagaaaacagccctttggcgtttgagcaat

SEQ ID NO: 17078 - DNA, 30 bp, Homo sapiens; identical to SEQ ID NO: 5588
  chr1:82267630-82267660
  hyper

SEQ ID NO: 17079 - DNA, 49 bp, Homo sapiens; identical to SEQ ID NO: 5589
  chr1:82267942-82267991
  hyper

SEQ ID NO: 17080 - DNA, 30 bp, Homo sapiens; identical to SEQ ID NO: 5590
  chr1:82268226-82268256
  hyper

SEQ ID NO: 17081 - DNA, 132 bp, Homo sapiens; identical to SEQ ID NO: 5591
  chr1:85358461-85358593
  hyper

SEQ ID NO: 17082 - DNA, 59 bp, Homo sapiens; identical to SEQ ID NO: 5593
  chr1:85359218-85359277
  hyper

SEQ ID NO: 17083 - DNA, 69 bp, Homo sapiens; identical to SEQ ID NO: 5594
  chr1:85463878-85463947
  hyper

SEQ ID NO: 17084 - DNA, 80 bp, Homo sapiens
  chr1:86621580-86621660
  hyper
tagcgtcacagcaatcgccaggctggacgccctgagaagcacctcggggaagcaggacctcgacagggccctgcgggagg

SEQ ID NO: 17085 - DNA, 18 bp, Homo sapiens
  chr1:87617807-87617825
  hyper
tctcgggaggggaaggcg

SEQ ID NO: 17086 - DNA, 147 bp, Homo sapiens; identical to SEQ ID NO: 5599
  chr1:91176423-91176570
  hyper

SEQ ID NO: 17087 - DNA, 45 bp, Homo sapiens; identical to SEQ ID NO: 5600
  chr1:91176908-91176953
  hyper

SEQ ID NO: 17088 - DNA, 101 bp, Homo sapiens
  chr1:91177840-91177941
  hyper
ggattgcagtgccttcgctgcaatgttttcaccgggggtgtggggtgcctgggatggggctggacaatggattaagggctggctgtcccccaggccctagg

SEQ ID NO: 17089 - DNA, 50 bp, Homo sapiens
  chr1:91178207-91178257
  hyper
ccagcagctgtgggcatggtccaggcaccaagacccggccccttctctgg

SEQ ID NO: 17090 - DNA, 125 bp, Homo sapiens
  chr1:91181807-91181932
  hyper
catcccttttatcaacgaaaagtatttcctgtcggatgccctccgccgcccctcaacccccagtagattaaaattaaataaaacaaaggaaggagctggatggccgtgaaggttgtggggtagaa

SEQ ID NO: 17091 - DNA, 18 bp, Homo sapiens
  chr1:91182320-91182338
  hyper
aattaaaaaagaagacgt

SEQ ID NO: 17092 - DNA, 30 bp, Homo sapiens; identical to SEQ ID NO: 5605
  chr1:91183775-91183805
  hyper

SEQ ID NO: 17093 - DNA, 139 bp, Homo sapiens; identical to SEQ ID NO: 1759
  chr1:91184274-91184413
  hyper

SEQ ID NO: 17094 - DNA, 9 bp, Homo sapiens
  chr1:91184414-91184423
  hyper
cccctgccg

SEQ ID NO: 17095 - DNA, 30 bp, Homo sapiens; identical to SEQ ID NO: 5608
  chr1:91184823-91184853
  hyper

SEQ ID NO: 17096 - DNA, 81 bp, Homo sapiens
  chr1:91189383-91189464
  hyper
agagctcccgcaaagcggggggatgtgacctgtgggcccccagcaggggtaggaggcagttcagcccgagagggggcgctc

SEQ ID NO: 17097 - DNA, 26 bp, Homo sapiens
  chr1:91190380-91190406
  hyper
cacattaaaaccgtagtgtgtcccta

SEQ ID NO: 17098 - DNA, 228 bp, Homo sapiens
  chr1:91191310-91191538
  hyper
agctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctg

SEQ ID NO: 17099 - DNA, 54 bp, Homo sapiens; identical to SEQ ID NO: 74
  chr1:91192681-91192735
  hyper

SEQ ID NO: 17100 - DNA, 71 bp, Homo sapiens; identical to SEQ ID NO: 5620
  chr1:91194749-91194820
  hyper

SEQ ID NO: 17101 - DNA, 19 bp, Homo sapiens
  chr1:91316313-91316332
  hyper
tcctcgggctttagttcag

SEQ ID NO: 17102 - DNA, 73 bp, Homo sapiens
  chr1:91316682-91316755
  hyper
tcgcctggctgcgccgtcccggcgggccggccctctccacgccctctcctggggtttgcggtgggcacagctc

SEQ ID NO: 17103 - DNA, 39 bp, Homo sapiens; identical to SEQ ID NO: 5626
  chr1:92495704-92495743
  hyper

SEQ ID NO: 17104 - DNA, 24 bp, Homo sapiens
  chr1:92948817-92948841
  hyper
cagcagcaaaagggacgttggggc

SEQ ID NO: 17105 - DNA, 280 bp, Homo sapiens
  chr1:92948976-92949256
  hyper
ggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacg

SEQ ID NO: 17106 - DNA, 41 bp, Homo sapiens; identical to SEQ ID NO: 5629
  chr1:92949786-92949827
  hyper

SEQ ID NO: 17107 - DNA, 75 bp, Homo sapiens; identical to SEQ ID NO: 5630
  chr1:92950099-92950174
  hyper

SEQ ID NO: 17108 - DNA, 182 bp, Homo sapiens; identical to SEQ ID NO: 5631
  chr1:92950668-92950850
  hyper

SEQ ID NO: 17109 - DNA, 215 bp, Homo sapiens; identical to SEQ ID NO: 5632
  chr1:92951530-92951745
  hyper

SEQ ID NO: 17110 - DNA, 30 bp, Homo sapiens
  chr1:98510761-98510791
  hyper
acctgagaggggggacgtgccttgcgtttg

SEQ ID NO: 17111 - DNA, 269 bp, Homo sapiens
  chr1:98511359-98511628
  hyper
ggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgc

SEQ ID NO: 17112 - DNA, 16 bp, Homo sapiens
  chr1:98515071-98515087
  hyper
gggaagggacctcggc

SEQ ID NO: 17113 - DNA, 54 bp, Homo sapiens
  chr1:98515088-98515142
  hyper
cctcgcgctggctgtgccccagtgccttcgcgtggtggcggcttgctcatgctt

SEQ ID NO: 17114 - DNA, 30 bp, Homo sapiens; identical to SEQ ID NO: 5639
  chr1:99469618-99469648
  hyper

SEQ ID NO: 17115 - DNA, 44 bp, Homo sapiens; identical to SEQ ID NO: 5640
  chr1:99469930-99469974
  hyper

SEQ ID NO: 17116 - DNA, 255 bp, Homo sapiens; identical to SEQ ID NO: 5641
  chr1:99470275-99470530
  hyper

SEQ ID NO: 17117 - DNA, 36 bp, Homo sapiens; identical to SEQ ID NO: 5642
  chr1:99470582-99470618
  hyper

SEQ ID NO: 17118 - DNA, 166 bp, Homo sapiens; identical to SEQ ID NO: 5643
  chr1:99470619-99470785
  hyper

SEQ ID NO: 17119 - DNA, 80 bp, Homo sapiens
  chr1:101004737-101004817
  hyper
cggctgcgccgccgacctcagcgtctgcgccctctggatgccgcaggaggcggtgctcgggctcctgcccaccggctctg

SEQ ID NO: 17120 - DNA, 216 bp, Homo sapiens
  chr1:101005144-101005360
  hyper
tgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggc

SEQ ID NO: 17121 - DNA, 49 bp, Homo sapiens
  chr1:101005675-101005724
  hyper
aacctagccggggcccgagggaagcggagatccccggcttccgacgtcc

SEQ ID NO: 17122 - DNA, 142 bp, Homo sapiens
  chr1:101702616-101702758
  hyper
ccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaa

SEQ ID NO: 17123 - DNA, 30 bp, Homo sapiens; identical to SEQ ID NO: 5648
  chr1:101703188-101703218
  hyper

SEQ ID NO: 17124 - DNA, 13 bp, Homo sapiens
  chr1:101703599-101703612
  hyper
gaaagaaaaggca

SEQ ID NO: 17125 - DNA, 226 bp, Homo sapiens; identical to SEQ ID NO: 5650
  chr1:101775150-101775376
  hyper

SEQ ID NO: 17126 - DNA, 60 bp, Homo sapiens; identical to SEQ ID NO: 5651
  chr1:103572677-103572737
  hyper

SEQ ID NO: 17127 - DNA, 281 bp, Homo sapiens; identical to SEQ ID NO: 5652
  chr1:103573722-103574003
  hyper

SEQ ID NO: 17128 - DNA, 77 bp, Homo sapiens
  chr1:107682658-107682735
  hyper
cttctgtggaggagccgggggggatggggagtagagggagggggccctgttgcctcagcgccccgaggtcgtggagc

SEQ ID NO: 17129 - DNA, 268 bp, Homo sapiens
  chr1:107683171-107683439
  hyper
ttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctc

SEQ ID NO: 17130 - DNA, 258 bp, Homo sapiens
  chr1:107683517-107683775
  hyper
gctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggc

SEQ ID NO: 17131 - DNA, 13 bp, Homo sapiens
  chr1:107683776-107683789
  hyper
gggagtggcgggc

SEQ ID NO: 17132 - DNA, 436 bp, Homo sapiens
  chr1:108506627-108507063
  hyper
cttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctc

SEQ ID NO: 17133 - DNA, 172 bp, Homo sapiens
  chr1:108507148-108507320
  hyper
cgaagtggtcccaaagcagaaggctgggaagcagggcaagctcagcgcacctagacgtttgcatttacacaaagaaattagccgcatgattaatgggagctgccggctggaggcggggcgcccgtgccggcctcctcacctgggacatctgcggcctcaggttgatctcctt

SEQ ID NO: 17134 - DNA, 110 bp, Homo sapiens
  chr1:108507497-108507607
  hyper
cggctccgggacgcggctgggccggggcgggcggcaaggatgcggccgccgccgccgccgccgcggttcctccgcgccccgccgacgccaacagccgccggccctttccc

SEQ ID NO: 17135 - DNA, 60 bp, Homo sapiens
  chr1:108507657-108507717
  hyper
cgctaggctcggctccggtcccggcccgggtgcgccgcgacccggccgccgctgcagcga

SEQ ID NO: 17136 - DNA, 242 bp, Homo sapiens
  chr1:108507810-108508052
  hyper
ccagcacgccggccggtctcgctgcggtccgcaagtccccagacgcgcgggtgggagcgcgccggcggccggggctggggtctgtggccgagggcggggcgcgggggaggggccggcggaggggggcggcggccagaaaggggatcccgcgcccccgcctgcagccttgcggggctcacgcagcccccggcgtcctggggtcttctctcggggcggcttcccggctttgcggggagtgtggc

SEQ ID NO: 17137 - DNA, 537 bp, Homo sapiens
  chr1:109203672-109204209
  hyper
gcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcgg

SEQ ID NO: 17138 - DNA, 66 bp, Homo sapiens; identical to SEQ ID NO: 5664
  chr1:109656914-109656980
  hyper

SEQ ID NO: 17139 - DNA, 97 bp, Homo sapiens; identical to SEQ ID NO: 5665
  chr1:110009644-110009741
  hyper

SEQ ID NO: 17140 - DNA, 42 bp, Homo sapiens; identical to SEQ ID NO: 5666
  chr1:110283094-110283136
  hyper

SEQ ID NO: 17141 - DNA, 1 bp, Homo sapiens
  chr1:110613458-110613459
  hyper
g

SEQ ID NO: 17142 - DNA, 35 bp, Homo sapiens
  chr1:110627578-110627613
  hyper
ttctaacaccgcgtgatcaccgacaacttttgcag

SEQ ID NO: 17143 - DNA, 54 bp, Homo sapiens
  chr1:110673233-110673287
  hyper
ggcctaaaatgagggaagatgaggaaatgggggtggggacgatggagaggatgg

SEQ ID NO: 17144 - DNA, 71 bp, Homo sapiens
  chr1:110692902-110692973
  hyper
gggcagaagccctggcgagggctccagggtctgcatcccctgaccaggggcctcaagaagctaagccccct

SEQ ID NO: 17145 - DNA, 52 bp, Homo sapiens
  chr1:110694117-110694169
  hyper
aggggacgtgcgtgtggtgcccatctggagggggcgccgtcctggcgggtcg

SEQ ID NO: 17146 - DNA, 244 bp, Homo sapiens
  chr1:111097952-111098196
  hyper
ataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgc

SEQ ID NO: 17147 - DNA, 51 bp, Homo sapiens; identical to SEQ ID NO: 5679
  chr1:111149588-111149639
  hyper

SEQ ID NO: 17148 - DNA, 29 bp, Homo sapiens
  chr1:111216734-111216763
  hyper
ccggcccggagctctcggggtactcgaag

SEQ ID NO: 17149 - DNA, 34 bp, Homo sapiens
  chr1:111217982-111218016
  hyper
cacacccctaggtacagcccggggagggcaggcg

SEQ ID NO: 17150 - DNA, 96 bp, Homo sapiens
  chr1:111506212-111506308
  hyper
ccgtggggaggattcgaaaccggtacttaccaacgcgaggcgttgcctgaattttcctctgcgggtttcaggaagaccctccgtaggttatttgac

SEQ ID NO: 17151 - DNA, 18 bp, Homo sapiens
  chr1:112283344-112283362
  hyper
agcactttgagaggccga

SEQ ID NO: 17152 - DNA, 36 bp, Homo sapiens; identical to SEQ ID NO: 5687
  chr1:112531573-112531609
  hyper

SEQ ID NO: 17153 - DNA, 110 bp, Homo sapiens
  chr1:114695329-114695439
  hyper
gagacgccgcagctgcgcgccagggtccagcccggcggggatcgggctcgggactcacccgctccggcgagctcgactcagctcgggctcccgcctcggctaggcagccg

SEQ ID NO: 17154 - DNA, 166 bp, Homo sapiens
  chr1:114695943-114696109
  hyper
ccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctccca

SEQ ID NO: 17155 - DNA, 56 bp, Homo sapiens
  chr1:115880128-115880184
  hyper
agggctgaaccttggcgacctctacctgaggttgtccaacgcggctccgtggaggg

SEQ ID NO: 17156 - DNA, 7 bp, Homo sapiens
  chr1:115880395-115880402
  hyper
ccgcggt

SEQ ID NO: 17157 - DNA, 117 bp, Homo sapiens; identical to SEQ ID NO: 5695
  chr1:115880678-115880795
  hyper

SEQ ID NO: 17158 - DNA, 90 bp, Homo sapiens
  chr1:116371049-116371139
  hyper
ggcgtcctgagagtgcgtgcgtgagcgagcgagcggcttatcctagactgaagacccagggaaacagatctgtgtggaggatgtttctgt

SEQ ID NO: 17159 - DNA, 93 bp, Homo sapiens; identical to SEQ ID NO: 5698
  chr1:116371436-116371529
  hyper

SEQ ID NO: 17160 - DNA, 70 bp, Homo sapiens; identical to SEQ ID NO: 5699
  chr1:116380312-116380382
  hyper

SEQ ID NO: 17161 - DNA, 75 bp, Homo sapiens; identical to SEQ ID NO: 5701
  chr1:116381534-116381609
  hyper

SEQ ID NO: 17162 - DNA, 35 bp, Homo sapiens; identical to SEQ ID NO: 5702
  chr1:116381836-116381871
  hyper

SEQ ID NO: 17163 - DNA, 20 bp, Homo sapiens
  chr1:116382478-116382498
  hyper
ctctacggcaaaataaaaac

SEQ ID NO: 17164 - DNA, 180 bp, Homo sapiens; identical to SEQ ID NO: 5704
  chr1:116711112-116711292
  hyper

SEQ ID NO: 17165 - DNA, 15 bp, Homo sapiens
  chr1:119521978-119521993
  hyper
cgtcacgatcccaca

SEQ ID NO: 17166 - DNA, 30 bp, Homo sapiens; identical to SEQ ID NO: 5708
  chr1:119528125-119528155
  hyper

SEQ ID NO: 17167 - DNA, 32 bp, Homo sapiens; identical to SEQ ID NO: 5710
  chr1:119529378-119529410
  hyper

SEQ ID NO: 17168 - DNA, 95 bp, Homo sapiens
  chr1:119530005-119530100
  hyper
cgacgaaaatgcaaggctcagtccagccccaaaaattggttccggtgaatttagggaggctcagggcatttgcgcgaagaaacagaaacctatgt

SEQ ID NO: 17169 - DNA, 8 bp, Homo sapiens
  chr1:119531021-119531029
  hyper
gaacaaga

SEQ ID NO: 17170 - DNA, 45 bp, Homo sapiens; identical to SEQ ID NO: 5716
  chr1:119535667-119535712
  hyper

SEQ ID NO: 17171 - DNA, 28 bp, Homo sapiens
  chr1:119550278-119550306
  hyper
tcttgttctttgacggggtggccctgtg

SEQ ID NO: 17172 - DNA, 29 bp, Homo sapiens
  chr1:119551269-119551298
  hyper
aaggaaaacttctgcgacttcaagaacgt

SEQ ID NO: 17173 - DNA, 15 bp, Homo sapiens
  chr1:147775398-147775413
  hyper
ggatgctgggtctga

SEQ ID NO: 17174 - DNA, 102 bp, Homo sapiens; identical to SEQ ID NO: 5723
  chr1:147775495-147775597
  hyper

SEQ ID NO: 17175 - DNA, 76 bp, Homo sapiens; identical to SEQ ID NO: 5724
  chr1:150185869-150185945
  hyper

SEQ ID NO: 17176 - DNA, 30 bp, Homo sapiens; identical to SEQ ID NO: 5725
  chr1:151689335-151689365
  hyper

SEQ ID NO: 17177 - DNA, 55 bp, Homo sapiens
  chr1:151694351-151694406
  hyper
acacatccgaccttagtaaaggcccctcatcctgaacaagcggcagaatgatatt

SEQ ID NO: 17178 - DNA, 30 bp, Homo sapiens; identical to SEQ ID NO: 5727
  chr1:152083749-152083779
  hyper

SEQ ID NO: 17179 - DNA, 92 bp, Homo sapiens; identical to SEQ ID NO: 5728
  chr1:152084671-152084763
  hyper

SEQ ID NO: 17180 - DNA, 340 bp, Homo sapiens
  chr1:152085058-152085398
  hyper
ttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgctt

SEQ ID NO: 17181 - DNA, 129 bp, Homo sapiens; identical to SEQ ID NO: 5730
  chr1:152487828-152487957
  hyper

SEQ ID NO: 17182 - DNA, 38 bp, Homo sapiens; identical to SEQ ID NO: 5731
  chr1:153438417-153438455
  hyper

SEQ ID NO: 17183 - DNA, 67 bp, Homo sapiens
  chr1:153651898-153651965
  hyper
gtgggagcacaaccccgctgtgttcctgggccccggctgcgtgtacgccgccgccccagtggggcgc

SEQ ID NO: 17184 - DNA, 15 bp, Homo sapiens
  chr1:154474763-154474778
  hyper
tgctctttcctcctg

SEQ ID NO: 17185 - DNA, 81 bp, Homo sapiens; identical to SEQ ID NO: 95
  chr1:154474987-154475068
  hyper

SEQ ID NO: 17186 - DNA, 13 bp, Homo sapiens
  chr1:154475531-154475544
  hyper
ggatgccaggcga

SEQ ID NO: 17187 - DNA, 18 bp, Homo sapiens
  chr1:155043657-155043675
  hyper
ccacgggagccgggctgg

SEQ ID NO: 17188 - DNA, 248 bp, Homo sapiens
  chr1:156215359-156215607
  hyper
agttgagtgcggcggcaggcacaaagaactggtgcaggtggccgtgcagccaggaggccggcatggagtaggcggcataggggaaggcgcagcctgcggtgaggtgggggcgtgcagctgaggcctgaggggcgcgcccctatgtcccgcgtcccacccctcgccccgctccgggacgcccagaccccgcgctcccgcgcctgtccggctcacccagactgtagaggctgagcgcgccgtagtcgagg

SEQ ID NO: 17189 - DNA, 128 bp, Homo sapiens
  chr1:156357865-156357993
  hyper
ttctccggaagcagccgctgttctggcttggcgcaagtgcgtgtggacgacagcaggatttcctgcccagggacatctggataagaggcccaaggtccccaggagcccccaggtgcttctgccctgtg

SEQ ID NO: 17190 - DNA, 19 bp, Homo sapiens
  chr1:156358508-156358527
  hyper
gaggcggccactgcatagg

SEQ ID NO: 17191 - DNA, 151 bp, Homo sapiens
  chr1:156390698-156390849
  hyper
tgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaa

SEQ ID NO: 17192 - DNA, 59 bp, Homo sapiens; identical to SEQ ID NO: 5740
  chr1:156391157-156391216
  hyper

SEQ ID NO: 17193 - DNA, 91 bp, Homo sapiens; identical to SEQ ID NO: 5741
  chr1:156391242-156391333
  hyper

SEQ ID NO: 17194 - DNA, 48 bp, Homo sapiens; identical to SEQ ID NO: 1821
  chr1:156405367-156405415
  hyper

SEQ ID NO: 17195 - DNA, 30 bp, Homo sapiens; identical to SEQ ID NO: 5745
  chr1:156468873-156468903
  hyper

SEQ ID NO: 17196 - DNA, 170 bp, Homo sapiens; identical to SEQ ID NO: 5746
  chr1:156594433-156594603
  hyper

SEQ ID NO: 17197 - DNA, 51 bp, Homo sapiens
  chr1:156594923-156594974
  hyper
gctgtctgaagcccacgcggcgtgccggcgacgcggcgccgtggtggccaa

SEQ ID NO: 17198 - DNA, 32 bp, Homo sapiens
  chr1:156595021-156595053
  hyper
gcgacggcggctggctggctgacggcagtgtg

SEQ ID NO: 17199 - DNA, 104 bp, Homo sapiens; identical to SEQ ID NO: 5748
  chr1:156595080-156595184
  hyper

SEQ ID NO: 17200 - DNA, 114 bp, Homo sapiens
  chr1:156611775-156611889
  hyper
gaaggcagcgggtcccgtgaccgtcccgagagccccgcgctcccgaccagggggcgggggcggccccggggagggcggggcaggggcggggggaagaaagggggttttgtgctg

SEQ ID NO: 17201 - DNA, 30 bp, Homo sapiens; identical to SEQ ID NO: 5751
  chr1:156626475-156626505
  hyper

SEQ ID NO: 17202 - DNA, 41 bp, Homo sapiens
  chr1:156626850-156626891
  hyper
cagcatcagcacacccgaggaacaggacttcatcaacagtg

SEQ ID NO: 17203 - DNA, 39 bp, Homo sapiens; identical to SEQ ID NO: 5753
  chr1:156646736-156646775
  hyper

SEQ ID NO: 17204 - DNA, 94 bp, Homo sapiens
  chr1:156815146-156815240
  hyper
gccctagtcctgctcacctttgggggctcttgttgatggacgtcaccttccaaggggatctggggaggccaggagtagccctatcaggcctgtc

SEQ ID NO: 17205 - DNA, 422 bp, Homo sapiens; identical to SEQ ID NO: 5757
  chr1:156818607-156819029
  hyper

SEQ ID NO: 17206 - DNA, 46 bp, Homo sapiens
  chr1:156863061-156863107
  hyper
cggtgcccgggaggggtcttaataagatcacggttgctgggcagca

SEQ ID NO: 17207 - DNA, 155 bp, Homo sapiens
  chr1:156863331-156863486
  hyper
cacccagaatacagttttccctcccgggcgcctggatctcccctcccccggctcctgtttccttgtcaaaacttcctgccttggcgagggcccgagttcccacccccttcctgccccccgcccctcggcgcccctcccggccctgcgatcagcag

SEQ ID NO: 17208 - DNA, 22 bp, Homo sapiens
  chr1:156863640-156863662
  hyper
cgcgccccctggcaggggaggc

SEQ ID NO: 17209 - DNA, 17 bp, Homo sapiens
  chr1:156893962-156893979
  hyper
ggccaaatggagggacg

SEQ ID NO: 17210 - DNA, 40 bp, Homo sapiens; identical to SEQ ID NO: 5761
  chr1:156894252-156894292
  hyper

SEQ ID NO: 17211 - DNA, 54 bp, Homo sapiens; identical to SEQ ID NO: 5762
  chr1:157963737-157963791
  hyper

SEQ ID NO: 17212 - DNA, 401 bp, Homo sapiens; identical to SEQ ID NO: 5763
  chr1:158083182-158083583
  hyper

SEQ ID NO: 17213 - DNA, 44 bp, Homo sapiens; identical to SEQ ID NO: 1828
  chr1:158150605-158150649
  hyper

SEQ ID NO: 17214 - DNA, 147 bp, Homo sapiens; identical to SEQ ID NO: 1829
  chr1:158150650-158150797
  hyper

SEQ ID NO: 17215 - DNA, 104 bp, Homo sapiens; identical to SEQ ID NO: 1830
  chr1:158150798-158150902
  hyper

SEQ ID NO: 17216 - DNA, 15 bp, Homo sapiens
  chr1:159158333-159158348
  hyper
ctggcgaagttcacc

SEQ ID NO: 17217 - DNA, 30 bp, Homo sapiens; identical to SEQ ID NO: 5769
  chr1:161068529-161068559
  hyper

SEQ ID NO: 17218 - DNA, 51 bp, Homo sapiens
  chr1:161276026-161276077
  hyper
cttccccttggccctcccacccactggagtagtctccgcccagatggggga

SEQ ID NO: 17219 - DNA, 49 bp, Homo sapiens; identical to SEQ ID NO: 5771
  chr1:161409851-161409900
  hyper

SEQ ID NO: 17220 - DNA, 152 bp, Homo sapiens; identical to SEQ ID NO: 5772
  chr1:161494827-161494979
  hyper

SEQ ID NO: 17221 - DNA, 30 bp, Homo sapiens; identical to SEQ ID NO: 5773
  chr1:161591710-161591740
  hyper

SEQ ID NO: 17222 - DNA, 16 bp, Homo sapiens
  chr1:164290599-164290615
  hyper
gccagctccgggggcc

SEQ ID NO: 17223 - DNA, 30 bp, Homo sapiens; identical to SEQ ID NO: 5776
  chr1:165204427-165204457
  hyper

SEQ ID NO: 17224 - DNA, 58 bp, Homo sapiens; identical to SEQ ID NO: 5777
  chr1:165204838-165204896
  hyper

SEQ ID NO: 17225 - DNA, 30 bp, Homo sapiens; identical to SEQ ID NO: 5778
  chr1:165321661-165321691
  hyper

SEQ ID NO: 17226 - DNA, 66 bp, Homo sapiens; identical to SEQ ID NO: 5781
  chr1:165324832-165324898
  hyper

SEQ ID NO: 17227 - DNA, 180 bp, Homo sapiens
  chr1:165325716-165325896
  hyper
cgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggc

SEQ ID NO: 17228 - DNA, 254 bp, Homo sapiens
  chr1:165325950-165326204
  hyper
ctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcacc

SEQ ID NO: 17229 - DNA, 39 bp, Homo sapiens; identical to SEQ ID NO: 5785
  chr1:165414376-165414415
  hyper

SEQ ID NO: 17230 - DNA, 4 bp, Homo sapiens
  chr1:166134243-166134247
  hyper
taaa

SEQ ID NO: 17231 - DNA, 54 bp, Homo sapiens
  chr1:166134306-166134360
  hyper
ggcgatccttggtcttcaccgcagcagccaagcccggcgcgcaccaaccggcgc

SEQ ID NO: 17232 - DNA, 80 bp, Homo sapiens
  chr1:166134648-166134728
  hyper
ggttccagacggaaacgcctccgggctccctggcccgggggacaagggttcgaaacttcaacagtcgcgagggcaaggac

SEQ ID NO: 17233 - DNA, 95 bp, Homo sapiens
  chr1:166134796-166134891
  hyper
acgcgcggcacagcccatgcgcccccggcactccactccactcctctatggtttcccccaaactcttcccggggagccccacaaagcacagacgg

SEQ ID NO: 17234 - DNA, 260 bp, Homo sapiens
  chr1:166134933-166135193
  hyper
cgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtcc

SEQ ID NO: 17235 - DNA, 297 bp, Homo sapiens
  chr1:166135281-166135578
  hyper
caccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcg

SEQ ID NO: 17236 - DNA, 286 bp, Homo sapiens
  chr1:167599330-167599616
  hyper
tgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcc

SEQ ID NO: 17237 - DNA, 8 bp, Homo sapiens
  chr1:167599844-167599852
  hyper
ggtcccac

SEQ ID NO: 17238 - DNA, 19 bp, Homo sapiens
  chr1:169396357-169396376
  hyper
agactcggtggacctcgga

SEQ ID NO: 17239 - DNA, 130 bp, Homo sapiens; identical to SEQ ID NO: 5799
  chr1:170631315-170631445
  hyper

SEQ ID NO: 17240 - DNA, 91 bp, Homo sapiens; identical to SEQ ID NO: 5800
  chr1:170633906-170633997
  hyper

SEQ ID NO: 17241 - DNA, 30 bp, Homo sapiens; identical to SEQ ID NO: 5801
  chr1:170634253-170634283
  hyper

SEQ ID NO: 17242 - DNA, 126 bp, Homo sapiens; identical to SEQ ID NO: 5804
  chr1:171811091-171811217
  hyper

SEQ ID NO: 17243 - DNA, 30 bp, Homo sapiens; identical to SEQ ID NO: 5806
  chr1:177133445-177133475
  hyper

SEQ ID NO: 17244 - DNA, 99 bp, Homo sapiens
  chr1:177133814-177133913
  hyper
tgagccccggccgccttcctcctagcgctgcgatggtgggggaggaagcgagcggggagggagcgagggagcgagcgcgggaggcgggggaggttaggg

SEQ ID NO: 17245 - DNA, 375 bp, Homo sapiens
  chr1:177150803-177151178
  hyper
tatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggg

SEQ ID NO: 17246 - DNA, 167 bp, Homo sapiens
  chr1:179544800-179544967
  hyper
cgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggac

SEQ ID NO: 17247 - DNA, 57 bp, Homo sapiens
  chr1:179545098-179545155
  hyper
ggggaccctaaagaccgtcgggtgggggctgagggcgaggggcgggacaccggggcc

SEQ ID NO: 17248 - DNA, 30 bp, Homo sapiens; identical to SEQ ID NO: 5812
  chr1:179712006-179712036
  hyper

SEQ ID NO: 17249 - DNA, 247 bp, Homo sapiens
  chr1:180198209-180198456
  hyper
tgtatttctgccagaaactcgcgttgaggagaatttgttttaagcgtttctctacctgtccatgcatctcgtaaatacagtaagcatggcaagccctttcgctggttaaccccggcgtccgtgtgctcactgccgccctgcacgcacgaggtcgcggatggttcaaagcacccgcggtggcagccggagaggcagagcgggctctagggacctaagacagggccgagctggacgactggtggcaggg

SEQ ID NO: 17250 - DNA, 158 bp, Homo sapiens; identical to SEQ ID NO: 5816
  chr1:180202237-180202395
  hyper

SEQ ID NO: 17251 - DNA, 141 bp, Homo sapiens
  chr1:180203016-180203157
  hyper
aaggtattttattttgtgtttggtagggtcggggtaaaggttttccctgggacttcctctcctggggctcctccggggtgcgtggggtaatgtcccagcgcaggtcgagttgcagatccgagtccccggggttgttgactg

SEQ ID NO: 17252 - DNA, 48 bp, Homo sapiens
  chr1:180203365-180203413
  hyper
gattctatcatattccgaacattccgatatagcagctgtaggcaccat

SEQ ID NO: 17253 - DNA, 30 bp, Homo sapiens; identical to SEQ ID NO: 5822
  chr1:180205341-180205371
  hyper

SEQ ID NO: 17254 - DNA, 33 bp, Homo sapiens; identical to SEQ ID NO: 5823
  chr1:180206330-180206363
  hyper

SEQ ID NO: 17255 - DNA, 118 bp, Homo sapiens; identical to SEQ ID NO: 5824
  chr1:180881433-180881551
  hyper

SEQ ID NO: 17256 - DNA, 30 bp, Homo sapiens; identical to SEQ ID NO: 5825
  chr1:180882303-180882333
  hyper

SEQ ID NO: 17257 - DNA, 201 bp, Homo sapiens; identical to SEQ ID NO: 5826
  chr1:181287452-181287653
  hyper

SEQ ID NO: 17258 - DNA, 14 bp, Homo sapiens
  chr1:181288188-181288202
  hyper
gcagaggactgagg

SEQ ID NO: 17259 - DNA, 26 bp, Homo sapiens
  chr1:181451381-181451407
  hyper
gacaccttactagggcggcggcgggc

SEQ ID NO: 17260 - DNA, 239 bp, Homo sapiens
  chr1:181452120-181452359
  hyper
gtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 17261 - DNA, 180 bp, Homo sapiens
  chr1:181452691-181452871
  hyper
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgttta

SEQ ID NO: 17262 - DNA, 34 bp, Homo sapiens; identical to SEQ ID NO: 5830
  chr1:181454728-181454762
  hyper

SEQ ID NO: 17263 - DNA, 206 bp, Homo sapiens
  chr1:181454977-181455183
  hyper
cctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgt

SEQ ID NO: 17264 - DNA, 11 bp, Homo sapiens
  chr1:181455263-181455274
  hyper
tgtgagtctta

SEQ ID NO: 17265 - DNA, 43 bp, Homo sapiens
  chr1:183386107-183386150
  hyper
tcagggcctcccacacgctctctcatccatcccagcccactcg

SEQ ID NO: 17266 - DNA, 15 bp, Homo sapiens
  chr1:183386288-183386303
  hyper
cgagcagctgcgaag

SEQ ID NO: 17267 - DNA, 37 bp, Homo sapiens
  chr1:183386626-183386663
  hyper
agcctccgcccggccccctccccgtcctaggcagcgg

SEQ ID NO: 17268 - DNA, 281 bp, Homo sapiens
  chr1:183387319-183387600
  hyper
aacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgt

SEQ ID NO: 17269 - DNA, 66 bp, Homo sapiens
  chr1:183774363-183774429
  hyper
cagacattgcgttggcctccgagcagggcgcatcatgcagcgttcgcgcaccggagagaaaactga

SEQ ID NO: 17270 - DNA, 39 bp, Homo sapiens; identical to SEQ ID NO: 5837
  chr1:184006034-184006073
  hyper

SEQ ID NO: 17271 - DNA, 138 bp, Homo sapiens; identical to SEQ ID NO: 5838
  chr1:184006332-184006470
  hyper

SEQ ID NO: 17272 - DNA, 147 bp, Homo sapiens; identical to SEQ ID NO: 5839
  chr1:190444251-190444398
  hyper

SEQ ID NO: 17273 - DNA, 71 bp, Homo sapiens; identical to SEQ ID NO: 5842
  chr1:190445481-190445552
  hyper

SEQ ID NO: 17274 - DNA, 195 bp, Homo sapiens
  chr1:190447519-190447714
  hyper
tgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatctt

SEQ ID NO: 17275 - DNA, 35 bp, Homo sapiens
  chr1:196578066-196578101
  hyper
agcatagcacagtgacggcacgggggtgccttggg

SEQ ID NO: 17276 - DNA, 68 bp, Homo sapiens
  chr1:197880156-197880224
  hyper
cgggcgtccccccacaccccccccccactgcgccctggacccacgccacgcaccgccaaggagtagct

SEQ ID NO: 17277 - DNA, 111 bp, Homo sapiens; identical to SEQ ID NO: 5847
  chr1:197880543-197880654
  hyper

SEQ ID NO: 17278 - DNA, 90 bp, Homo sapiens; identical to SEQ ID NO: 5848
  chr1:197881455-197881545
  hyper

SEQ ID NO: 17279 - DNA, 7 bp, Homo sapiens
  chr1:197882201-197882208
  hyper
ctccctt

SEQ ID NO: 17280 - DNA, 60 bp, Homo sapiens; identical to SEQ ID NO: 5850
  chr1:197885234-197885294
  hyper

SEQ ID NO: 17281 - DNA, 145 bp, Homo sapiens
  chr1:197886907-197887052
  hyper
cttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatc

SEQ ID NO: 17282 - DNA, 311 bp, Homo sapiens
  chr1:197887741-197888052
  hyper
gggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattacttatctaagcgcttccctttccagattactaacggggggggggggggactacagaagtctccggaaattatttcggccaaacatagctgtgtagatcctttggtaccacagtaggacttgtagcccaaactaatcaggagactgctctagcccttatca

SEQ ID NO: 17283 - DNA, 81 bp, Homo sapiens; identical to SEQ ID NO: 5857
  chr1:197889549-197889630
  hyper

SEQ ID NO: 17284 - DNA, 55 bp, Homo sapiens; identical to SEQ ID NO: 5858
  chr1:197890716-197890771
  hyper

SEQ ID NO: 17285 - DNA, 181 bp, Homo sapiens; identical to SEQ ID NO: 5859
  chr1:199998199-199998380
  hyper

SEQ ID NO: 17286 - DNA, 30 bp, Homo sapiens; identical to SEQ ID NO: 5860
  chr1:199998758-199998788
  hyper

SEQ ID NO: 17287 - DNA, 42 bp, Homo sapiens; identical to SEQ ID NO: 5864
  chr1:201252751-201252793
  hyper

SEQ ID NO: 17288 - DNA, 22 bp, Homo sapiens
  chr1:201437642-201437664
  hyper
tcttccagggggcagcggaagt

SEQ ID NO: 17289 - DNA, 105 bp, Homo sapiens; identical to SEQ ID NO: 5866
  chr1:201437682-201437787
  hyper

SEQ ID NO: 17290 - DNA, 42 bp, Homo sapiens; identical to SEQ ID NO: 5867
  chr1:202678998-202679040
  hyper

SEQ ID NO: 17291 - DNA, 33 bp, Homo sapiens; identical to SEQ ID NO: 5869
  chr1:202679642-202679675
  hyper

SEQ ID NO: 17292 - DNA, 136 bp, Homo sapiens; identical to SEQ ID NO: 5870
  chr1:202996095-202996231
  hyper

SEQ ID NO: 17293 - DNA, 212 bp, Homo sapiens
  chr1:204653807-204654019
  hyper
gagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgcc

SEQ ID NO: 17294 - DNA, 104 bp, Homo sapiens; identical to SEQ ID NO: 5872
  chr1:204797791-204797895
  hyper

SEQ ID NO: 17295 - DNA, 91 bp, Homo sapiens; identical to SEQ ID NO: 5873
  chr1:204798150-204798241
  hyper

SEQ ID NO: 17296 - DNA, 60 bp, Homo sapiens
  chr1:205312536-205312596
  hyper
gcagccggggcaaggcggtccactggtcggcctccggggagtagacctcgaagcagtcca

SEQ ID NO: 17297 - DNA, 416 bp, Homo sapiens; identical to SEQ ID NO: 5875
  chr1:205399689-205400105
  hyper

SEQ ID NO: 17298 - DNA, 54 bp, Homo sapiens
  chr1:205424957-205425011
  hyper
ccctcagccgcactcgggcccccaacccggccaaggggtcgccaactcgcggca

SEQ ID NO: 17299 - DNA, 115 bp, Homo sapiens
  chr1:207669381-207669496
  hyper
ggtgggctctgccagcgaaactcgttagaaacaatgcaaatggggagtaaacatgacctcgcccatgaaggggaagctgtggtcaaaagcattttgtcccggaaccccgcagccc

SEQ ID NO: 17300 - DNA, 115 bp, Homo sapiens
  chr1:208084174-208084289
  hyper
agctcccaggtgaggcgctggccccggggggaagcagctgtgggcggcagtgcgtgggttgggcaggggtcccttccctccgtgagactctgctctgctgttcagcctcccagaa

SEQ ID NO: 17301 - DNA, 39 bp, Homo sapiens; identical to SEQ ID NO: 5880
  chr1:209381523-209381562
  hyper

SEQ ID NO: 17302 - DNA, 31 bp, Homo sapiens
  chr1:210111357-210111388
  hyper
aggttggggtgggggcggggtggcgtcacgt

SEQ ID NO: 17303 - DNA, 30 bp, Homo sapiens; identical to SEQ ID NO: 5884
  chr1:211306755-211306785
  hyper

SEQ ID NO: 17304 - DNA, 30 bp, Homo sapiens; identical to SEQ ID NO: 5885
  chr1:211307339-211307369
  hyper

SEQ ID NO: 17305 - DNA, 110 bp, Homo sapiens; identical to SEQ ID NO: 5886
  chr1:213124513-213124623
  hyper

SEQ ID NO: 17306 - DNA, 75 bp, Homo sapiens
  chr1:213124910-213124985
  hyper
ccgctgcccccaccccaaaggcgccaaaggcacccggtcccggagcagccacgcgcggcccgtgagcctcgccac

SEQ ID NO: 17307 - DNA, 53 bp, Homo sapiens; identical to SEQ ID NO: 5888
  chr1:214155985-214156038
  hyper

SEQ ID NO: 17308 - DNA, 11 bp, Homo sapiens
  chr1:214158827-214158838
  hyper
gctcctatttc

SEQ ID NO: 17309 - DNA, 30 bp, Homo sapiens; identical to SEQ ID NO: 5892
  chr1:214160288-214160318
  hyper

SEQ ID NO: 17310 - DNA, 136 bp, Homo sapiens; identical to SEQ ID NO: 5893
  chr1:214162493-214162629
  hyper

SEQ ID NO: 17311 - DNA, 21 bp, Homo sapiens
  chr1:214360654-214360675
  hyper
agctaattgcctaatcggagt

SEQ ID NO: 17312 - DNA, 54 bp, Homo sapiens
  chr1:214360968-214361022
  hyper
gctcagaacacaccgagatcctttagaaataaatgtaatcgagactaatctgga

SEQ ID NO: 17313 - DNA, 41 bp, Homo sapiens; identical to SEQ ID NO: 5897
  chr1:214387716-214387757
  hyper

SEQ ID NO: 17314 - DNA, 34 bp, Homo sapiens
  chr1:215255060-215255094
  hyper
tcatcaggggattcccgctgagaaagtgggaagg

SEQ ID NO: 17315 - DNA, 71 bp, Homo sapiens
  chr1:215255799-215255870
  hyper
agataggatgcagcgcagtgtgatgtggatgccagacagcgagagtgaggattttgcggggtggggatggg

SEQ ID NO: 17316 - DNA, 315 bp, Homo sapiens; identical to SEQ ID NO: 5899
  chr1:215256457-215256772
  hyper

SEQ ID NO: 17317 - DNA, 42 bp, Homo sapiens; identical to SEQ ID NO: 5900
  chr1:216896512-216896554
  hyper

SEQ ID NO: 17318 - DNA, 87 bp, Homo sapiens; identical to SEQ ID NO: 5901
  chr1:216896887-216896974
  hyper

SEQ ID NO: 17319 - DNA, 75 bp, Homo sapiens; identical to SEQ ID NO: 5903
  chr1:217308622-217308697
  hyper

SEQ ID NO: 17320 - DNA, 48 bp, Homo sapiens; identical to SEQ ID NO: 5905
  chr1:217309258-217309306
  hyper

SEQ ID NO: 17321 - DNA, 66 bp, Homo sapiens; identical to SEQ ID NO: 5907
  chr1:217311944-217312010
  hyper

SEQ ID NO: 17322 - DNA, 17 bp, Homo sapiens
  chr1:217313025-217313042
  hyper
cccctctgcaattgccg

SEQ ID NO: 17323 - DNA, 30 bp, Homo sapiens; identical to SEQ ID NO: 5910
  chr1:218337322-218337352
  hyper

SEQ ID NO: 17324 - DNA, 30 bp, Homo sapiens; identical to SEQ ID NO: 5911
  chr1:218337823-218337853
  hyper

SEQ ID NO: 17325 - DNA, 96 bp, Homo sapiens; identical to SEQ ID NO: 5912
  chr1:218338074-218338170
  hyper

SEQ ID NO: 17326 - DNA, 28 bp, Homo sapiens
  chr1:220101117-220101145
  hyper
tccaaaggatgcaaccgaaaggcacctg

SEQ ID NO: 17327 - DNA, 224 bp, Homo sapiens
  chr1:220101385-220101609
  hyper
tgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtag

SEQ ID NO: 17328 - DNA, 200 bp, Homo sapiens; identical to SEQ ID NO: 5917
  chr1:220702265-220702465
  hyper

SEQ ID NO: 17329 - DNA, 145 bp, Homo sapiens; identical to SEQ ID NO: 5918
  chr1:220921624-220921769
  hyper

SEQ ID NO: 17330 - DNA, 13 bp, Homo sapiens
  chr1:221052025-221052038
  hyper
ggaaaggtttggc

SEQ ID NO: 17331 - DNA, 227 bp, Homo sapiens
  chr1:221052492-221052719
  hyper
tagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccg

SEQ ID NO: 17332 - DNA, 208 bp, Homo sapiens
  chr1:221053402-221053610
  hyper
ggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacag

SEQ ID NO: 17333 - DNA, 48 bp, Homo sapiens
  chr1:223302777-223302825
  hyper
ggaaggccctgctcccgaccgacccggagcgcgctgctgccctctacc

SEQ ID NO: 17334 - DNA, 8 bp, Homo sapiens
  chr1:223302890-223302898
  hyper
cagcaccc

SEQ ID NO: 17335 - DNA, 73 bp, Homo sapiens; identical to SEQ ID NO: 5923
  chr1:223538158-223538231
  hyper

SEQ ID NO: 17336 - DNA, 13 bp, Homo sapiens
  chr1:224528801-224528814
  hyper
gctccacctcctc

SEQ ID NO: 17337 - DNA, 30 bp, Homo sapiens; identical to SEQ ID NO: 5927
  chr1:224803373-224803403
  hyper

SEQ ID NO: 17338 - DNA, 95 bp, Homo sapiens
  chr1:224804002-224804097
  hyper
caccgctacagttctcgcagtggcaaaggcggcggcggcggcggcggcagcggcagcagcaggtggagcgagctacagcgtttggcctgaaaccc

SEQ ID NO: 17339 - DNA, 206 bp, Homo sapiens
  chr1:224804910-224805116
  hyper
tgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgc

SEQ ID NO: 17340 - DNA, 18 bp, Homo sapiens
  chr1:224805848-224805866
  hyper
cgccggtcctctcaaaga

SEQ ID NO: 17341 - DNA, 100 bp, Homo sapiens; identical to SEQ ID NO: 5933
  chr1:225117280-225117380
  hyper

SEQ ID NO: 17342 - DNA, 41 bp, Homo sapiens; identical to SEQ ID NO: 5934
  chr1:226411183-226411224
  hyper

SEQ ID NO: 17343 - DNA, 168 bp, Homo sapiens
  chr1:226411273-226411441
  hyper
tctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgta

SEQ ID NO: 17344 - DNA, 111 bp, Homo sapiens
  chr1:226411832-226411943
  hyper
gtctggactgcgggctcctgaggccacacccgggacgttgcaggcacggtgcttcccctgaggctctgcgtactagactgaaatagggggtgatatcggcacctgctgcat

SEQ ID NO: 17345 - DNA, 106 bp, Homo sapiens; identical to SEQ ID NO: 5937
  chr1:226737012-226737118
  hyper

SEQ ID NO: 17346 - DNA, 167 bp, Homo sapiens
  chr1:226924900-226925067
  hyper
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcg

SEQ ID NO: 17347 - DNA, 349 bp, Homo sapiens
  chr1:226925195-226925544
  hyper
cgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcg

SEQ ID NO: 17348 - DNA, 131 bp, Homo sapiens; identical to SEQ ID NO: 5939
  chr1:227730464-227730595
  hyper

SEQ ID NO: 17349 - DNA, 33 bp, Homo sapiens; identical to SEQ ID NO: 5940
  chr1:228074787-228074820
  hyper

SEQ ID NO: 17350 - DNA, 87 bp, Homo sapiens; identical to SEQ ID NO: 5941
  chr1:228194270-228194357
  hyper

SEQ ID NO: 17351 - DNA, 428 bp, Homo sapiens
  chr1:228194949-228195377
  hyper
agcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctc

SEQ ID NO: 17352 - DNA, 154 bp, Homo sapiens
  chr1:228196349-228196503
  hyper
agggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggc

SEQ ID NO: 17353 - DNA, 71 bp, Homo sapiens; identical to SEQ ID NO: 5943
  chr1:228225753-228225824
  hyper

SEQ ID NO: 17354 - DNA, 61 bp, Homo sapiens
  chr1:228463250-228463311
  hyper
gcttaaagtcgcacccgggagggtgcgcagctgcggcccgcgtgtggccagggccgcgctg

SEQ ID NO: 17355 - DNA, 63 bp, Homo sapiens; identical to SEQ ID NO: 5945
  chr1:228603691-228603754
  hyper

SEQ ID NO: 17356 - DNA, 55 bp, Homo sapiens
  chr1:228604254-228604309
  hyper
cccgcacagcgcctagtgcacctggccgagcgctcgctgccgggaaaggctgggt

SEQ ID NO: 17357 - DNA, 65 bp, Homo sapiens; identical to SEQ ID NO: 5947
  chr1:228604515-228604580
  hyper

SEQ ID NO: 17358 - DNA, 107 bp, Homo sapiens; identical to SEQ ID NO: 125
  chr1:228633813-228633920
  hyper

SEQ ID NO: 17359 - DNA, 29 bp, Homo sapiens
  chr1:228633921-228633950
  hyper
gcttctctgcagctgtacaccctgcactg

SEQ ID NO: 17360 - DNA, 7 bp, Homo sapiens
  chr1:228633983-228633990
  hyper
cgcaggt

SEQ ID NO: 17361 - DNA, 48 bp, Homo sapiens
  chr1:228645092-228645140
  hyper
ccatcaaaggggccccgggggcggcgggcggcctcacttgcccttggc

SEQ ID NO: 17362 - DNA, 172 bp, Homo sapiens
  chr1:228645734-228645906
  hyper
gaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaagg

SEQ ID NO: 17363 - DNA, 121 bp, Homo sapiens
  chr1:228646238-228646359
  hyper
ggctcttttcagagccacccacacgatcaagaaagggtttcgaacacggtgaagggttatgtaacctaatgtgtctccatgcaccctagcggttgccgggtgcggccgaatctgagccgtg

SEQ ID NO: 17364 - DNA, 74 bp, Homo sapiens; identical to SEQ ID NO: 5954
  chr1:228647217-228647291
  hyper

SEQ ID NO: 17365 - DNA, 253 bp, Homo sapiens
  chr1:228651626-228651879
  hyper
acacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaa

SEQ ID NO: 17366 - DNA, 25 bp, Homo sapiens
  chr1:229542813-229542838
  hyper
catgctgaggttggtcgcttgtttc

SEQ ID NO: 17367 - DNA, 124 bp, Homo sapiens; identical to SEQ ID NO: 132
  chr1:229543220-229543344
  hyper

SEQ ID NO: 17368 - DNA, 30 bp, Homo sapiens; identical to SEQ ID NO: 5960
  chr1:229566702-229566732
  hyper

SEQ ID NO: 17369 - DNA, 146 bp, Homo sapiens
  chr1:229568204-229568350
  hyper
ggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggcca

SEQ ID NO: 17370 - DNA, 46 bp, Homo sapiens; identical to SEQ ID NO: 5964
  chr1:229570083-229570129
  hyper

SEQ ID NO: 17371 - DNA, 33 bp, Homo sapiens; identical to SEQ ID NO: 5965
  chr1:229570479-229570512
  hyper

SEQ ID NO: 17372 - DNA, 30 bp, Homo sapiens; identical to SEQ ID NO: 5966
  chr1:230561556-230561586
  hyper

SEQ ID NO: 17373 - DNA, 15 bp, Homo sapiens
  chr1:231296817-231296832
  hyper
cgctacgactccggt

SEQ ID NO: 17374 - DNA, 59 bp, Homo sapiens; identical to SEQ ID NO: 1894
  chr1:231297044-231297103
  hyper

SEQ ID NO: 17375 - DNA, 364 bp, Homo sapiens; identical to SEQ ID NO: 5970
  chr1:231298191-231298555
  hyper

SEQ ID NO: 17376 - DNA, 30 bp, Homo sapiens; identical to SEQ ID NO: 5971
  chr1:231299494-231299524
  hyper

SEQ ID NO: 17377 - DNA, 213 bp, Homo sapiens; identical to SEQ ID NO: 1897
  chr1:234041148-234041361
  hyper

SEQ ID NO: 17378 - DNA, 5 bp, Homo sapiens
  chr1:234349983-234349988
  hyper
aagta

SEQ ID NO: 17379 - DNA, 93 bp, Homo sapiens
  chr1:234350100-234350193
  hyper
gaggccgggactgagaggggcgagccgctggtgctccccggcggcagagggccgcgtcggccacgggcccgggagagacgcgctccagccggc

SEQ ID NO: 17380 - DNA, 279 bp, Homo sapiens; identical to SEQ ID NO: 5978
  chr1:235812015-235812294
  hyper

SEQ ID NO: 17381 - DNA, 47 bp, Homo sapiens; identical to SEQ ID NO: 5979
  chr1:235812947-235812994
  hyper

SEQ ID NO: 17382 - DNA, 114 bp, Homo sapiens
  chr1:235813667-235813781
  hyper
ggaggggtctggggacggggccgcggtcagcgcgggctccccgaagcctcaggtaccgccctcgctcggggtgagctccagcgcctgggccgttggggcgcgggccgcttccca

SEQ ID NO: 17383 - DNA, 112 bp, Homo sapiens
  chr1:236228096-236228208
  hyper
gcgcccccggcccgccgcgccctgcagcccctcgcccgccctcccggggctcactcacgtagactgcgtcgatgtcggatctgtcgtagaagcggagcgccccactcagctc

SEQ ID NO: 17384 - DNA, 31 bp, Homo sapiens; identical to SEQ ID NO: 5986
  chr1:236558486-236558517
  hyper

SEQ ID NO: 17385 - DNA, 5 bp, Homo sapiens
  chr1:236558547-236558552
  hyper
cgccc

SEQ ID NO: 17386 - DNA, 42 bp, Homo sapiens; identical to SEQ ID NO: 5988
  chr1:236558782-236558824
  hyper

SEQ ID NO: 17387 - DNA, 49 bp, Homo sapiens
  chr1:236559127-236559176
  hyper
ctcccagtccagccccgcgagcggctgctgaccgcccctcccgcgctcg

SEQ ID NO: 17388 - DNA, 97 bp, Homo sapiens
  chr1:236559271-236559368
  hyper
agacacgtcctgcaaacctctggcagaaatgggcgcaagggggtggatttcgttttcgcctcccgggctttttctttctccccgctcacatgccttc

SEQ ID NO: 17389 - DNA, 52 bp, Homo sapiens; identical to SEQ ID NO: 5994
  chr1:240161034-240161086
  hyper

SEQ ID NO: 17390 - DNA, 84 bp, Homo sapiens
  chr1:240254860-240254944
  hyper
gcttcagtttttctccgtgtaaaaatttcttcttttttatttaacttttctcttggcaggtccagcagctttgaagatcagagt

SEQ ID NO: 17391 - DNA, 350 bp, Homo sapiens
  chr1:240255011-240255361
  hyper
tccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgg

SEQ ID NO: 17392 - DNA, 319 bp, Homo sapiens
  chr1:240255500-240255819
  hyper
atgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcgga

SEQ ID NO: 17393 - DNA, 26 bp, Homo sapiens
  chr1:240775287-240775313
  hyper
ttggtctcccgccgccgctttcagtt

SEQ ID NO: 17394 - DNA, 47 bp, Homo sapiens
  chr1:240775378-240775425
  hyper
cgagagcgcgccccgcgccgcgcggtcccaggctggctgctcctgca

SEQ ID NO: 17395 - DNA, 57 bp, Homo sapiens; identical to SEQ ID NO: 6001
  chr1:241520455-241520512
  hyper

SEQ ID NO: 17396 - DNA, 80 bp, Homo sapiens
  chr1:241587113-241587193
  hyper
gtcctgagcggccgctgccatcgcgccggctgcagcggaaaggtacaagcggtggcggcaggagccgctgtgggagcagc

SEQ ID NO: 17397 - DNA, 41 bp, Homo sapiens
  chr1:241587546-241587587
  hyper
tgccgcacttgcacacggagtgtggggggccaggcctggga

SEQ ID NO: 17398 - DNA, 81 bp, Homo sapiens
  chr1:241587797-241587878
  hyper
gggcccgcaatctactccggaggctttcccactgggcagggtcgctagcagggtgagagaaagccccgggccatccccgag

SEQ ID NO: 17399 - DNA, 90 bp, Homo sapiens
  chr1:242688094-242688184
  hyper
ggtgcagtgaggagccgccgccgcccctcccgccgcgcccaggcccgggcggccgcgctcccgctccgcacccgcctttcccgagcaggc

SEQ ID NO: 17400 - DNA, 119 bp, Homo sapiens; identical to SEQ ID NO: 1915
  chr1:242688277-242688396
  hyper

SEQ ID NO: 17401 - DNA, 30 bp, Homo sapiens; identical to SEQ ID NO: 6009
  chr1:243053994-243054024
  hyper

SEQ ID NO: 17402 - DNA, 30 bp, Homo sapiens; identical to SEQ ID NO: 6010
  chr1:244014641-244014671
  hyper

SEQ ID NO: 17403 - DNA, 202 bp, Homo sapiens
  chr1:244080470-244080672
  hyper
aacagcagcctgatccgtcttgcttttcccttttctccatgcagccagcacttttccttctcactctccccgcacgcccacgcccacccgcttctgcaccgagaacctcgaggcgcgcacgcacgtggaggtgacgccaagcccagcggcgaggtcggggctgggggtggggggagccggcgtcccgcgggcccccgaggcc

SEQ ID NO: 17404 - DNA, 93 bp, Homo sapiens
  chr1:244080702-244080795
  hyper
agctgaatgcagccgaggggcgagcgcgcgggctcgcacggattagccgtgctttcccatgagccacaaaagaatgcccgaatctgggacatc

SEQ ID NO: 17405 - DNA, 44 bp, Homo sapiens; identical to SEQ ID NO: 6012
  chr1:244893555-244893599
  hyper

SEQ ID NO: 17406 - DNA, 32 bp, Homo sapiens; identical to SEQ ID NO: 6013
  chr1:247171029-247171061
  hyper

SEQ ID NO: 17407 - DNA, 52 bp, Homo sapiens; identical to SEQ ID NO: 6014
  chr1:247171365-247171417
  hyper

SEQ ID NO: 17408 - DNA, 23 bp, Homo sapiens
  chr1:247274349-247274372
  hyper
cggggccgcgagcaagcctccga

SEQ ID NO: 17409 - DNA, 30 bp, Homo sapiens; identical to SEQ ID NO: 6018
  chr2:287500-287530
  hyper

SEQ ID NO: 17410 - DNA, 61 bp, Homo sapiens
  chr2:288470-288531
  hyper
tccacctcccggccatggcgccctcccgcacctgcccggcgccacccgggagccacctgcg

SEQ ID NO: 17411 - DNA, 61 bp, Homo sapiens; identical to SEQ ID NO: 6020
  chr2:288738-288799
  hyper

SEQ ID NO: 17412 - DNA, 30 bp, Homo sapiens; identical to SEQ ID NO: 6021
  chr2:289223-289253
  hyper

SEQ ID NO: 17413 - DNA, 235 bp, Homo sapiens; identical to SEQ ID NO: 6022
  chr2:290038-290273
  hyper

SEQ ID NO: 17414 - DNA, 68 bp, Homo sapiens
  chr2:945845-945913
  hyper
cccgagctttgggggcgggaagggagggtggaaggaggaggggagcggggttggggaaagttggagct

SEQ ID NO: 17415 - DNA, 10 bp, Homo sapiens
  chr2:946000-946010
  hyper
ggacgcggcc

SEQ ID NO: 17416 - DNA, 197 bp, Homo sapiens
  chr2:946011-946208
  hyper
gctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgccc

SEQ ID NO: 17417 - DNA, 115 bp, Homo sapiens; identical to SEQ ID NO: 1922
  chr2:946289-946404
  hyper

SEQ ID NO: 17418 - DNA, 18 bp, Homo sapiens
  chr2:947159-947177
  hyper
cttcgggcgcccaggcca

SEQ ID NO: 17419 - DNA, 47 bp, Homo sapiens
  chr2:1746567-1746614
  hyper
aggaggagaggaactcgggcccccgccccgccccagggcctccagga

SEQ ID NO: 17420 - DNA, 43 bp, Homo sapiens; identical to SEQ ID NO: 6031
  chr2:5831358-5831401
  hyper

SEQ ID NO: 17421 - DNA, 229 bp, Homo sapiens
  chr2:5831819-5832048
  hyper
aaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagc

SEQ ID NO: 17422 - DNA, 116 bp, Homo sapiens; identical to SEQ ID NO: 1925
  chr2:5832731-5832847
  hyper

SEQ ID NO: 17423 - DNA, 51 bp, Homo sapiens
  chr2:5836497-5836548
  hyper
agggggcgcggggcgcggcgggacccaggctacgagcgggagggaggcggg

SEQ ID NO: 17424 - DNA, 54 bp, Homo sapiens
  chr2:5837414-5837468
  hyper
ctgagatgattgaccgaggtttggccttccatttttactgagatttggcgagac

SEQ ID NO: 17425 - DNA, 24 bp, Homo sapiens
  chr2:5866074-5866098
  hyper
ctgggggcagcagagcgacgtgcc

SEQ ID NO: 17426 - DNA, 53 bp, Homo sapiens; identical to SEQ ID NO: 6042
  chr2:7058223-7058276
  hyper

SEQ ID NO: 17427 - DNA, 30 bp, Homo sapiens; identical to SEQ ID NO: 6043
  chr2:7571320-7571350
  hyper

SEQ ID NO: 17428 - DNA, 37 bp, Homo sapiens
  chr2:10182790-10182827
  hyper
agagacgcgagcaaccgaaatatagggagaaaaaaaa

SEQ ID NO: 17429 - DNA, 92 bp, Homo sapiens
  chr2:10182904-10182996
  hyper
tgggaagaatgggcgggtttcagcgggcgccttctgggtgactgcccgtttcggcttcccctgaccccgtaacagagcggaagaggcccaga

SEQ ID NO: 17430 - DNA, 118 bp, Homo sapiens; identical to SEQ ID NO: 6046
  chr2:10220823-10220941
  hyper

SEQ ID NO: 17431 - DNA, 15 bp, Homo sapiens
  chr2:10220958-10220973
  hyper
cgacctttcagtgtc

SEQ ID NO: 17432 - DNA, 25 bp, Homo sapiens
  chr2:10688849-10688874
  hyper
tctgctgggatgacccggtcctgtt

SEQ ID NO: 17433 - DNA, 30 bp, Homo sapiens; identical to SEQ ID NO: 6049
  chr2:11052420-11052450
  hyper

SEQ ID NO: 17434 - DNA, 157 bp, Homo sapiens; identical to SEQ ID NO: 6050
  chr2:11622808-11622965
  hyper

SEQ ID NO: 17435 - DNA, 12 bp, Homo sapiens
  chr2:12858618-12858630
  hyper
gaaatacttatt

SEQ ID NO: 17436 - DNA, 30 bp, Homo sapiens; identical to SEQ ID NO: 6052
  chr2:14773957-14773987
  hyper

SEQ ID NO: 17437 - DNA, 516 bp, Homo sapiens; identical to SEQ ID NO: 6053
  chr2:16082386-16082902
  hyper

SEQ ID NO: 17438 - DNA, 71 bp, Homo sapiens; identical to SEQ ID NO: 6054
  chr2:17720246-17720317
  hyper

SEQ ID NO: 17439 - DNA, 56 bp, Homo sapiens; identical to SEQ ID NO: 6055
  chr2:17721623-17721679
  hyper

SEQ ID NO: 17440 - DNA, 74 bp, Homo sapiens; identical to SEQ ID NO: 6056
  chr2:17721750-17721824
  hyper

SEQ ID NO: 17441 - DNA, 126 bp, Homo sapiens; identical to SEQ ID NO: 6057
  chr2:18011883-18012009
  hyper

SEQ ID NO: 17442 - DNA, 86 bp, Homo sapiens
  chr2:18058949-18059035
  hyper
ccagggaacactgggcgccttagcttggagcagctggctccgaggaattgttccacgtctgcacaacttaaaaatctgcagtttgg

SEQ ID NO: 17443 - DNA, 448 bp, Homo sapiens
  chr2:18059085-18059533
  hyper
cctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccg

SEQ ID NO: 17444 - DNA, 30 bp, Homo sapiens; identical to SEQ ID NO: 6059
  chr2:18060088-18060118
  hyper

SEQ ID NO: 17445 - DNA, 43 bp, Homo sapiens; identical to SEQ ID NO: 6060
  chr2:19551406-19551449
  hyper

SEQ ID NO: 17446 - DNA, 23 bp, Homo sapiens
  chr2:19558809-19558832
  hyper
cggcttgggtttcaacgcacttt

SEQ ID NO: 17447 - DNA, 72 bp, Homo sapiens
  chr2:19558893-19558965
  hyper
gtggagcagctcctggctatccaagcgtgctcggggccagggtgttaacccaggcagcgctggttaattcct

SEQ ID NO: 17448 - DNA, 153 bp, Homo sapiens
  chr2:20865927-20866080
  hyper
gcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttc

SEQ ID NO: 17449 - DNA, 65 bp, Homo sapiens; identical to SEQ ID NO: 6068
  chr2:21022991-21023056
  hyper

SEQ ID NO: 17450 - DNA, 41 bp, Homo sapiens; identical to SEQ ID NO: 6069
  chr2:23609527-23609568
  hyper

SEQ ID NO: 17451 - DNA, 16 bp, Homo sapiens
  chr2:24232773-24232789
  hyper
gtcctgagggcctgcc

SEQ ID NO: 17452 - DNA, 89 bp, Homo sapiens; identical to SEQ ID NO: 6071
  chr2:24233349-24233438
  hyper

SEQ ID NO: 17453 - DNA, 30 bp, Homo sapiens; identical to SEQ ID NO: 6072
  chr2:24273201-24273231
  hyper

SEQ ID NO: 17454 - DNA, 42 bp, Homo sapiens; identical to SEQ ID NO: 6073
  chr2:25354748-25354790
  hyper

SEQ ID NO: 17455 - DNA, 472 bp, Homo sapiens
  chr2:25391212-25391684
  hyper
cagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaa

SEQ ID NO: 17456 - DNA, 9 bp, Homo sapiens
  chr2:25391725-25391734
  hyper
ggaggctta

SEQ ID NO: 17457 - DNA, 99 bp, Homo sapiens
  chr2:26401931-26402030
  hyper
gtggagggaggaggacggcgactcgcgccgggtggggctgaaggcactgcggggtgactcggtctccaggctgcggcgctctgctccgggagtcaggga

SEQ ID NO: 17458 - DNA, 120 bp, Homo sapiens
  chr2:26402060-26402180
  hyper
cccagcccccgcccctggccctgcgggaggggccaggcgtcttccctgagcatggtgccacttccccagtgttggccttgtttcctgctcagcatttggcagatgcgcctctggcccaac

SEQ ID NO: 17459 - DNA, 68 bp, Homo sapiens
  chr2:26915695-26915763
  hyper
ggcgcgggccgggggcgccggggggccggcggcggcccgggcgggacgatgaagcggcagaacgtgcg

SEQ ID NO: 17460 - DNA, 716 bp, Homo sapiens
  chr2:27070414-27071130
  hyper
tgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtga

SEQ ID NO: 17461 - DNA, 97 bp, Homo sapiens; identical to SEQ ID NO: 6083
  chr2:27071758-27071855
  hyper

SEQ ID NO: 17462 - DNA, 26 bp, Homo sapiens
  chr2:27072989-27073015
  hyper
ttgcggagaagcgggtggaaatgatc

SEQ ID NO: 17463 - DNA, 30 bp, Homo sapiens; identical to SEQ ID NO: 6085
  chr2:27473328-27473358
  hyper

SEQ ID NO: 17464 - DNA, 159 bp, Homo sapiens; identical to SEQ ID NO: 6086
  chr2:27484899-27485058
  hyper

SEQ ID NO: 17465 - DNA, 86 bp, Homo sapiens; identical to SEQ ID NO: 6087
  chr2:27938325-27938411
  hyper

SEQ ID NO: 17466 - DNA, 121 bp, Homo sapiens
  chr2:29338969-29339090
  hyper
cagtgggtcttcaaagctaaaccaaatggctgtccttgcagtccttggctacctgagatcccttaattctgaaccatccgcacctgggaggggaagttgaaaggagcgctggagctgagcc

SEQ ID NO: 17467 - DNA, 28 bp, Homo sapiens
  chr2:30143276-30143304
  hyper
gccagccttcagctccgaggaggatggt

SEQ ID NO: 17468 - DNA, 168 bp, Homo sapiens
  chr2:30144411-30144579
  hyper
gctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctc

SEQ ID NO: 17469 - DNA, 122 bp, Homo sapiens
  chr2:30453941-30454063
  hyper
acagccagtggatgggaaggagggcgctggcgccgggcggctggggtggaggagtggcgggtgccctaccccggcgcagagcagccgccgagctgtcatgtcccgagcggcccccgcgccct

SEQ ID NO: 17470 - DNA, 97 bp, Homo sapiens
  chr2:31360209-31360306
  hyper
ccgccaataccaaggcgtctgtttttacaggctctttcgtggtgttctgggcacattcaacttccaatgcagctgagagggtcgggaacagttagag

SEQ ID NO: 17471 - DNA, 148 bp, Homo sapiens
  chr2:31360831-31360979
  hyper
tctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcg

SEQ ID NO: 17472 - DNA, 73 bp, Homo sapiens; identical to SEQ ID NO: 6099
  chr2:31361425-31361498
  hyper

SEQ ID NO: 17473 - DNA, 18 bp, Homo sapiens
  chr2:31457039-31457057
  hyper
ccgcgggctgggcagcgt

SEQ ID NO: 17474 - DNA, 45 bp, Homo sapiens; identical to SEQ ID NO: 6101
  chr2:37571852-37571897
  hyper

SEQ ID NO: 17475 - DNA, 99 bp, Homo sapiens; identical to SEQ ID NO: 6102
  chr2:38301762-38301861
  hyper

SEQ ID NO: 17476 - DNA, 47 bp, Homo sapiens; identical to SEQ ID NO: 6104
  chr2:38755384-38755431
  hyper

SEQ ID NO: 17477 - DNA, 18 bp, Homo sapiens
  chr2:39187200-39187218
  hyper
ggagccgctgggcaacgt

SEQ ID NO: 17478 - DNA, 30 bp, Homo sapiens
  chr2:39893060-39893090
  hyper
tgtgtctggcggcggcgcgcgagcccaccg

SEQ ID NO: 17479 - DNA, 340 bp, Homo sapiens
  chr2:39893501-39893841
  hyper
ctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcct

SEQ ID NO: 17480 - DNA, 106 bp, Homo sapiens
  chr2:40678497-40678603
  hyper
cacctccctcctctccgcagtccgtggtgaatgagcacccaacgcccgctggaaaacagggggctcggaaatgtggccttggggaaagaccccagggattaccgga

SEQ ID NO: 17481 - DNA, 54 bp, Homo sapiens
  chr2:42329377-42329431
  hyper
gtctgcagatggggccggccaccacgtgctctctgagttctctttccaagtaca

SEQ ID NO: 17482 - DNA, 86 bp, Homo sapiens; identical to SEQ ID NO: 6114
  chr2:42329751-42329837
  hyper

SEQ ID NO: 17483 - DNA, 73 bp, Homo sapiens; identical to SEQ ID NO: 6116
  chr2:42720975-42721048
  hyper

SEQ ID NO: 17484 - DNA, 212 bp, Homo sapiens; identical to SEQ ID NO: 6118
  chr2:43020113-43020325
  hyper

SEQ ID NO: 17485 - DNA, 30 bp, Homo sapiens; identical to SEQ ID NO: 6119
  chr2:43451091-43451121
  hyper

SEQ ID NO: 17486 - DNA, 48 bp, Homo sapiens
  chr2:45028940-45028988
  hyper
tccttttaattgtgacggtgcggccgcttgggcgtgatcccttggctg

SEQ ID NO: 17487 - DNA, 214 bp, Homo sapiens; identical to SEQ ID NO: 6129
  chr2:45159704-45159918
  hyper

SEQ ID NO: 17488 - DNA, 30 bp, Homo sapiens; identical to SEQ ID NO: 6132
  chr2:45160939-45160969
  hyper

SEQ ID NO: 17489 - DNA, 34 bp, Homo sapiens; identical to SEQ ID NO: 6133
  chr2:45161221-45161255
  hyper

SEQ ID NO: 17490 - DNA, 49 bp, Homo sapiens
  chr2:45162112-45162161
  hyper
tgctgcgcgttctttctccctccccctctcagggcgccagggcccagac

SEQ ID NO: 17491 - DNA, 25 bp, Homo sapiens
  chr2:45162913-45162938
  hyper
tcctgccagccgtgtggctcttaaa

SEQ ID NO: 17492 - DNA, 205 bp, Homo sapiens; identical to SEQ ID NO: 6137
  chr2:45164939-45165144
  hyper

SEQ ID NO: 17493 - DNA, 61 bp, Homo sapiens; identical to SEQ ID NO: 6139
  chr2:45168959-45169020
  hyper

SEQ ID NO: 17494 - DNA, 88 bp, Homo sapiens; identical to SEQ ID NO: 6140
  chr2:45169316-45169404
  hyper

SEQ ID NO: 17495 - DNA, 94 bp, Homo sapiens
  chr2:45170029-45170123
  hyper
gccgcggcggccaagaacaggttagtggcggggcccgcggcctggctacagcctcagaggcctgggaaggggagaggggttgagatggggctag

SEQ ID NO: 17496 - DNA, 61 bp, Homo sapiens
  chr2:45171324-45171385
  hyper
gtatgcagttctacccggagactggccgggcggtggggaacccgcagctcccggtgtgtgt

SEQ ID NO: 17497 - DNA, 17 bp, Homo sapiens
  chr2:45171862-45171879
  hyper
ctcggtaacctccagcg

SEQ ID NO: 17498 - DNA, 233 bp, Homo sapiens
  chr2:45176768-45177001
  hyper
attcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacg

SEQ ID NO: 17499 - DNA, 258 bp, Homo sapiens
  chr2:45179362-45179620
  hyper
tccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccg

SEQ ID NO: 17500 - DNA, 289 bp, Homo sapiens
  chr2:45179650-45179939
  hyper
ttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgt

SEQ ID NO: 17501 - DNA, 15 bp, Homo sapiens
  chr2:45231136-45231151
  hyper
attctgattttatcc

SEQ ID NO: 17502 - DNA, 76 bp, Homo sapiens; identical to SEQ ID NO: 6149
  chr2:45231244-45231320
  hyper

SEQ ID NO: 17503 - DNA, 13 bp, Homo sapiens
  chr2:45233586-45233599
  hyper
ggttgtggctgtt

SEQ ID NO: 17504 - DNA, 65 bp, Homo sapiens
  chr2:45235529-45235594
  hyper
gaaaggcctaagcatcgtccaagtcaggccgggctgccgctgggctgtggccgggcctgggggcc

SEQ ID NO: 17505 - DNA, 38 bp, Homo sapiens; identical to SEQ ID NO: 6153
  chr2:45236204-45236242
  hyper

SEQ ID NO: 17506 - DNA, 64 bp, Homo sapiens; identical to SEQ ID NO: 6154
  chr2:45236460-45236524
  hyper

SEQ ID NO: 17507 - DNA, 11 bp, Homo sapiens
  chr2:45237662-45237673
  hyper
gtggtggggct

SEQ ID NO: 17508 - DNA, 352 bp, Homo sapiens
  chr2:45240784-45241136
  hyper
ggcgctgggctccgggcggtcgcactcttggaaccgcgcgaaccgcggcgtcgcccgcgccgcacgtggctggggcagtcacaggccccgagagctggagcaacggggtcaccgccacccctctgccctccaggccttcaccttgagacccacgcggcagcctggagggcccacaagagcaaacggtttagaggccgcgggctcacgagggatcttgttcaaacgaaaagaacgagcacaggggctcggggccagcctggaggccggcacagaggcgagtcggcccgggtggcgccgggaccaggcgggatttggggcgggtatccgggcccgggcgctggcagcctccctg

SEQ ID NO: 17509 - DNA, 215 bp, Homo sapiens; identical to SEQ ID NO: 1964
  chr2:45241232-45241447
  hyper

SEQ ID NO: 17510 - DNA, 30 bp, Homo sapiens; identical to SEQ ID NO: 6160
  chr2:45241753-45241783
  hyper

SEQ ID NO: 17511 - DNA, 155 bp, Homo sapiens
  chr2:45396160-45396315
  hyper
gctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaa

SEQ ID NO: 17512 - DNA, 16 bp, Homo sapiens
  chr2:45396672-45396688
  hyper
ccgccaccctctgggc

SEQ ID NO: 17513 - DNA, 33 bp, Homo sapiens; identical to SEQ ID NO: 6164
  chr2:45397223-45397256
  hyper

SEQ ID NO: 17514 - DNA, 278 bp, Homo sapiens
  chr2:47796765-47797043
  hyper
cggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggca

SEQ ID NO: 17515 - DNA, 145 bp, Homo sapiens
  chr2:47797818-47797963
  hyper
gcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatc

SEQ ID NO: 17516 - DNA, 216 bp, Homo sapiens
  chr2:47797964-47798180
  hyper
gcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtgg

SEQ ID NO: 17517 - DNA, 291 bp, Homo sapiens
  chr2:47798663-47798954
  hyper
caggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcgggga

SEQ ID NO: 17518 - DNA, 56 bp, Homo sapiens; identical to SEQ ID NO: 1968
  chr2:47799123-47799179
  hyper

SEQ ID NO: 17519 - DNA, 88 bp, Homo sapiens
  chr2:50573507-50573595
  hyper
ccttctggcaactgacgcccccttcccgcggggcccagccgcgcgaccagggctggtcctttagtaggtgtccacatctctctcccag

SEQ ID NO: 17520 - DNA, 71 bp, Homo sapiens; identical to SEQ ID NO: 6177
  chr2:56149951-56150022
  hyper

SEQ ID NO: 17521 - DNA, 128 bp, Homo sapiens; identical to SEQ ID NO: 6178
  chr2:56150227-56150355
  hyper

SEQ ID NO: 17522 - DNA, 33 bp, Homo sapiens
  chr2:56411733-56411766
  hyper
cttgcacctgccaccccgcggataccatgtcga

SEQ ID NO: 17523 - DNA, 34 bp, Homo sapiens; identical to SEQ ID NO: 6181
  chr2:58655503-58655537
  hyper

SEQ ID NO: 17524 - DNA, 51 bp, Homo sapiens
  chr2:58655998-58656049
  hyper
gcgcgccactcagcccgggaggtggggccgggcagtgaccccgcgcgaagt

SEQ ID NO: 17525 - DNA, 72 bp, Homo sapiens
  chr2:58656125-58656197
  hyper
gtaccctctctttatcctaccctccattccccgacccttttctccctctcttctccccgttcttttctactc

SEQ ID NO: 17526 - DNA, 59 bp, Homo sapiens
  chr2:60797078-60797137
  hyper
cttgtgtagagcctccggtgccctccacctaaccctgccccaatgcctcgggtcttttt

SEQ ID NO: 17527 - DNA, 61 bp, Homo sapiens
  chr2:60797281-60797342
  hyper
ctggagtttttttttttttttttttttagttcggttcagaagcaaacgctacctagtttct

SEQ ID NO: 17528 - DNA, 276 bp, Homo sapiens; identical to SEQ ID NO: 6184
  chr2:60962755-60963031
  hyper

SEQ ID NO: 17529 - DNA, 26 bp, Homo sapiens
  chr2:62798386-62798412
  hyper
cgtgactcacccgtgtccctcgctct

SEQ ID NO: 17530 - DNA, 147 bp, Homo sapiens; identical to SEQ ID NO: 165
  chr2:63275877-63276024
  hyper

SEQ ID NO: 17531 - DNA, 67 bp, Homo sapiens; identical to SEQ ID NO: 6187
  chr2:63276425-63276492
  hyper

SEQ ID NO: 17532 - DNA, 231 bp, Homo sapiens
  chr2:63278731-63278962
  hyper
agtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggcccc

SEQ ID NO: 17533 - DNA, 30 bp, Homo sapiens
  chr2:63278992-63279022
  hyper
cctgagagtggcaccccgggttcccggcag

SEQ ID NO: 17534 - DNA, 25 bp, Homo sapiens
  chr2:63284752-63284777
  hyper
tttttagtgcaccttcgttctccga

SEQ ID NO: 17535 - DNA, 32 bp, Homo sapiens
  chr2:63284811-63284843
  hyper
tttggctttggccgcttcgtccagtaggtggg

SEQ ID NO: 17536 - DNA, 163 bp, Homo sapiens; identical to SEQ ID NO: 6195
  chr2:64836470-64836633
  hyper

SEQ ID NO: 17537 - DNA, 20 bp, Homo sapiens
  chr2:66653914-66653934
  hyper
atcctgccgggacccccacc

SEQ ID NO: 17538 - DNA, 176 bp, Homo sapiens; identical to SEQ ID NO: 6198
  chr2:66659986-66660162
  hyper

SEQ ID NO: 17539 - DNA, 47 bp, Homo sapiens
  chr2:66660603-66660650
  hyper
ataattgattttccccgcagccaatgcgcggcggcctgggcgggggc

SEQ ID NO: 17540 - DNA, 66 bp, Homo sapiens; identical to SEQ ID NO: 6200
  chr2:66802875-66802941
  hyper

SEQ ID NO: 17541 - DNA, 30 bp, Homo sapiens
  chr2:66809361-66809391
  hyper
ctgccgcatgtagggcgatcttcattaact

SEQ ID NO: 17542 - DNA, 75 bp, Homo sapiens
  chr2:68546249-68546324
  hyper
cgcgaggccagaggcccttgagaggctcgggctgtcctgggggcctcagtcctctgcctgtaccccatgggggac

SEQ ID NO: 17543 - DNA, 21 bp, Homo sapiens
  chr2:68546892-68546913
  hyper
tgtttacgcaccacaatcccc

SEQ ID NO: 17544 - DNA, 67 bp, Homo sapiens; identical to SEQ ID NO: 6205
  chr2:68870366-68870433
  hyper

SEQ ID NO: 17545 - DNA, 121 bp, Homo sapiens; identical to SEQ ID NO: 6206
  chr2:68870917-68871038
  hyper

SEQ ID NO: 17546 - DNA, 105 bp, Homo sapiens; identical to SEQ ID NO: 6207
  chr2:69240500-69240605
  hyper

SEQ ID NO: 17547 - DNA, 64 bp, Homo sapiens; identical to SEQ ID NO: 6208
  chr2:69533671-69533735
  hyper

SEQ ID NO: 17548 - DNA, 338 bp, Homo sapiens
  chr2:71503452-71503790
  hyper
ggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctg

SEQ ID NO: 17549 - DNA, 280 bp, Homo sapiens
  chr2:71503823-71504103
  hyper
ccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagc

SEQ ID NO: 17550 - DNA, 160 bp, Homo sapiens
  chr2:71504148-71504308
  hyper
ggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtc

SEQ ID NO: 17551 - DNA, 146 bp, Homo sapiens; identical to SEQ ID NO: 6210
  chr2:71681047-71681193
  hyper

SEQ ID NO: 17552 - DNA, 30 bp, Homo sapiens; identical to SEQ ID NO: 6211
  chr2:71694331-71694361
  hyper

SEQ ID NO: 17553 - DNA, 127 bp, Homo sapiens; identical to SEQ ID NO: 6212
  chr2:72374563-72374690
  hyper

SEQ ID NO: 17554 - DNA, 58 bp, Homo sapiens; identical to SEQ ID NO: 6214
  chr2:73142033-73142091
  hyper

SEQ ID NO: 17555 - DNA, 30 bp, Homo sapiens; identical to SEQ ID NO: 6215
  chr2:73143902-73143932
  hyper

SEQ ID NO: 17556 - DNA, 85 bp, Homo sapiens
  chr2:73145555-73145640
  hyper
gatgcgggggaggctcgggggcgcgcggggctgtttagaagttactgccgggaaggctgcaggtccgcggaggtagattcccagg

SEQ ID NO: 17557 - DNA, 30 bp, Homo sapiens; identical to SEQ ID NO: 6217
  chr2:73146224-73146254
  hyper

SEQ ID NO: 17558 - DNA, 53 bp, Homo sapiens; identical to SEQ ID NO: 6222
  chr2:73152398-73152451
  hyper

SEQ ID NO: 17559 - DNA, 36 bp, Homo sapiens; identical to SEQ ID NO: 6224
  chr2:73152959-73152995
  hyper

SEQ ID NO: 17560 - DNA, 13 bp, Homo sapiens
  chr2:73430743-73430756
  hyper
tgcatgcaatgct

SEQ ID NO: 17561 - DNA, 32 bp, Homo sapiens; identical to SEQ ID NO: 6228
  chr2:73512107-73512139
  hyper

SEQ ID NO: 17562 - DNA, 187 bp, Homo sapiens
  chr2:73518261-73518448
  hyper
ggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgctt

SEQ ID NO: 17563 - DNA, 73 bp, Homo sapiens
  chr2:73518919-73518992
  hyper
gcggccgcgggcagaagcagcgcgtgctgcatttgccgccgcggcgccccttgcgtcgcgccttggcctgggg

SEQ ID NO: 17564 - DNA, 59 bp, Homo sapiens; identical to SEQ ID NO: 6230
  chr2:73519211-73519270
  hyper

SEQ ID NO: 17565 - DNA, 56 bp, Homo sapiens
  chr2:73519523-73519579
  hyper
ctcatacaggcactgcgagggggcacccgcgcaaggcgaggcctcccagaacgcct

SEQ ID NO: 17566 - DNA, 151 bp, Homo sapiens; identical to SEQ ID NO: 6232
  chr2:73520242-73520393
  hyper

SEQ ID NO: 17567 - DNA, 44 bp, Homo sapiens; identical to SEQ ID NO: 6233
  chr2:74726199-74726243
  hyper

SEQ ID NO: 17568 - DNA, 89 bp, Homo sapiens
  chr2:74741387-74741476
  hyper
ccatgctcgggcccctcccgcgctgagcctggctcctaacaccctggccccctgtccccctccccgcacatctccgccagccagccttc

SEQ ID NO: 17569 - DNA, 60 bp, Homo sapiens
  chr2:74741775-74741835
  hyper
gggatgctgctgtttcggggaccccggcgccctgccttggccagccccgcgggcccctga

SEQ ID NO: 17570 - DNA, 6 bp, Homo sapiens
  chr2:74743766-74743772
  hyper
cgaagc

SEQ ID NO: 17571 - DNA, 8 bp, Homo sapiens
  chr2:74782073-74782081
  hyper
tgctttgc

SEQ ID NO: 17572 - DNA, 67 bp, Homo sapiens; identical to SEQ ID NO: 6243
  chr2:75426808-75426875
  hyper

SEQ ID NO: 17573 - DNA, 116 bp, Homo sapiens
  chr2:75427814-75427930
  hyper
ctgcaggcagagttccgcggaaaactgaaccccgggagtcctcaggggcccatctaccccggtgcaccgccccctcctttcactgcggggactcggagctgtgggactggagcgcg

SEQ ID NO: 17574 - DNA, 264 bp, Homo sapiens; identical to SEQ ID NO: 6245
  chr2:75787807-75788071
  hyper

SEQ ID NO: 17575 - DNA, 136 bp, Homo sapiens; identical to SEQ ID NO: 6246
  chr2:79740169-79740305
  hyper

SEQ ID NO: 17576 - DNA, 233 bp, Homo sapiens
  chr2:80530022-80530255
  hyper
ttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgc

SEQ ID NO: 17577 - DNA, 66 bp, Homo sapiens; identical to SEQ ID NO: 2000
  chr2:80530256-80530322
  hyper

SEQ ID NO: 17578 - DNA, 15 bp, Homo sapiens
  chr2:80530572-80530587
  hyper
ctggttggaactcag

SEQ ID NO: 17579 - DNA, 39 bp, Homo sapiens; identical to SEQ ID NO: 6250
  chr2:80531574-80531613
  hyper

SEQ ID NO: 17580 - DNA, 192 bp, Homo sapiens; identical to SEQ ID NO: 6251
  chr2:80531821-80532013
  hyper

SEQ ID NO: 17581 - DNA, 14 bp, Homo sapiens
  chr2:80549571-80549585
  hyper
cacaattcgggccc

SEQ ID NO: 17582 - DNA, 15 bp, Homo sapiens
  chr2:85361295-85361310
  hyper
cgcacccttgccctc

SEQ ID NO: 17583 - DNA, 144 bp, Homo sapiens
  chr2:87016636-87016780
  hyper
gcctcagatctcggtttcccaccacttggacagcccttgactctacctacagtatcagggctgtccctggcatgggctctccccgcggtgcgtgccgcccccgccccgggcccccgcacgcctcacctgcgccccccgccgctg

SEQ ID NO: 17584 - DNA, 67 bp, Homo sapiens
  chr2:87017729-87017796
  hyper
tcagctccactgtctcgcccaggttccaggtccgatccagcggcgacacccggaactggctcggcct

SEQ ID NO: 17585 - DNA, 302 bp, Homo sapiens; identical to SEQ ID NO: 6258
  chr2:87088727-87089029
  hyper

SEQ ID NO: 17586 - DNA, 16 bp, Homo sapiens
  chr2:88751800-88751816
  hyper
ggggcggcggcggcgg

SEQ ID NO: 17587 - DNA, 113 bp, Homo sapiens
  chr2:88751942-88752055
  hyper
gtaaggcgccctggctgccgggggggcgcccggggcggcggcggtggcggcgggcgggggcaggccgggctgcgaatacactccgaagttgtcgccgcagtagagggccatgt

SEQ ID NO: 17588 - DNA, 155 bp, Homo sapiens
  chr2:88752285-88752440
  hyper
ggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagc

SEQ ID NO: 17589 - DNA, 200 bp, Homo sapiens
  chr2:89065278-89065478
  hyper
gctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacgg

SEQ ID NO: 17590 - DNA, 146 bp, Homo sapiens; identical to SEQ ID NO: 6265
  chr2:91635198-91635344
  hyper

SEQ ID NO: 17591 - DNA, 30 bp, Homo sapiens; identical to SEQ ID NO: 6266
  chr2:95664061-95664091
  hyper

SEQ ID NO: 17592 - DNA, 10 bp, Homo sapiens
  chr2:95691026-95691036
  hyper
ggtcgcgcac

SEQ ID NO: 17593 - DNA, 231 bp, Homo sapiens
  chr2:95691269-95691500
  hyper
cacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggc

SEQ ID NO: 17594 - DNA, 29 bp, Homo sapiens
  chr2:95691501-95691530
  hyper
ctcgtcccgtcccaaggccgacgccagca

SEQ ID NO: 17595 - DNA, 59 bp, Homo sapiens; identical to SEQ ID NO: 6271
  chr2:96012452-96012511
  hyper

SEQ ID NO: 17596 - DNA, 44 bp, Homo sapiens; identical to SEQ ID NO: 6272
  chr2:96781940-96781984
  hyper

SEQ ID NO: 17597 - DNA, 137 bp, Homo sapiens; identical to SEQ ID NO: 6273
  chr2:96782022-96782159
  hyper

SEQ ID NO: 17598 - DNA, 15 bp, Homo sapiens
  chr2:97193049-97193064
  hyper
cggcagcagagcctg

SEQ ID NO: 17599 - DNA, 11 bp, Homo sapiens
  chr2:97193626-97193637
  hyper
aatcgccgtta

SEQ ID NO: 17600 - DNA, 227 bp, Homo sapiens
  chr2:98963599-98963826
  hyper
caacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagc

SEQ ID NO: 17601 - DNA, 73 bp, Homo sapiens
  chr2:98964645-98964718
  hyper
gcctcggttcagccacagagaggggcctcctcctgtgtagatgcccggaggggaggagcggtggttcttgggg

SEQ ID NO: 17602 - DNA, 136 bp, Homo sapiens; identical to SEQ ID NO: 6283
  chr2:100720916-100721052
  hyper

SEQ ID NO: 17603 - DNA, 7 bp, Homo sapiens
  chr2:100939155-100939162
  hyper
tagcttc

SEQ ID NO: 17604 - DNA, 170 bp, Homo sapiens; identical to SEQ ID NO: 6289
  chr2:101034025-101034195
  hyper

SEQ ID NO: 17605 - DNA, 30 bp, Homo sapiens; identical to SEQ ID NO: 6290
  chr2:102090404-102090434
  hyper

SEQ ID NO: 17606 - DNA, 53 bp, Homo sapiens; identical to SEQ ID NO: 6291
  chr2:102090961-102091014
  hyper

SEQ ID NO: 17607 - DNA, 107 bp, Homo sapiens
  chr2:105458974-105459081
  hyper
aaagagggagatgcccgtgtagagaaccgaggaggggggctggggtagaataatcagctctaaggttgcagatttagatctcaaggctgaaaaggataagcttccac

SEQ ID NO: 17608 - DNA, 6 bp, Homo sapiens
  chr2:105459902-105459908
  hyper
cggcag

SEQ ID NO: 17609 - DNA, 21 bp, Homo sapiens
  chr2:105461166-105461187
  hyper
ccggtgggcagccctcgaccc

SEQ ID NO: 17610 - DNA, 31 bp, Homo sapiens
  chr2:105461243-105461274
  hyper
ggggttaaccaggcaccgacctgaggcgccc

SEQ ID NO: 17611 - DNA, 9 bp, Homo sapiens
  chr2:105461555-105461564
  hyper
cgcccgccg

SEQ ID NO: 17612 - DNA, 30 bp, Homo sapiens; identical to SEQ ID NO: 6299
  chr2:105468569-105468599
  hyper

SEQ ID NO: 17613 - DNA, 123 bp, Homo sapiens
  chr2:105468908-105469031
  hyper
cggagcgcaccggcggccgctcctcggctgcgtcctgggctgccgctcgggctcgggactgccagatgcaggctctggctgggggcggcgggcgcaagcgggcgcacccgcagctaggggtgc

SEQ ID NO: 17614 - DNA, 259 bp, Homo sapiens
  chr2:105470091-105470350
  hyper
ggggtgagcaacccgacgcgtactaggtggggtgggcaggttgctatttttcatgtttcccccttcgttttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgaggggg

SEQ ID NO: 17615 - DNA, 167 bp, Homo sapiens; identical to SEQ ID NO: 6304
  chr2:105471573-105471740
  hyper

SEQ ID NO: 17616 - DNA, 174 bp, Homo sapiens
  chr2:105472057-105472231
  hyper
cggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcgg

SEQ ID NO: 17617 - DNA, 403 bp, Homo sapiens
  chr2:105472845-105473248
  hyper
accacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaa

SEQ ID NO: 17618 - DNA, 215 bp, Homo sapiens; identical to SEQ ID NO: 6307
  chr2:105473599-105473814
  hyper

SEQ ID NO: 17619 - DNA, 13 bp, Homo sapiens
  chr2:105479089-105479102
  hyper
gccagactgtggc

SEQ ID NO: 17620 - DNA, 156 bp, Homo sapiens
  chr2:105488281-105488437
  hyper
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacc

SEQ ID NO: 17621 - DNA, 736 bp, Homo sapiens
  chr2:105488496-105489232
  hyper
catcgcgctccccacccccgaacacacacacacagacacacacacacacacactcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaa

SEQ ID NO: 17622 - DNA, 36 bp, Homo sapiens
  chr2:105760945-105760981
  hyper
gaggccacgcggggacggaggaggcagagaggacgg

SEQ ID NO: 17623 - DNA, 47 bp, Homo sapiens
  chr2:105761037-105761084
  hyper
caaccaccaccaccatcaccatcactgactgtcgcccatcccagctc

SEQ ID NO: 17624 - DNA, 95 bp, Homo sapiens; identical to SEQ ID NO: 6312
  chr2:106014945-106015040
  hyper

SEQ ID NO: 17625 - DNA, 11 bp, Homo sapiens
  chr2:107103854-107103865
  hyper
cggggccaggt

SEQ ID NO: 17626 - DNA, 138 bp, Homo sapiens
  chr2:107103928-107104066
  hyper
aggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttgg

SEQ ID NO: 17627 - DNA, 43 bp, Homo sapiens; identical to SEQ ID NO: 2030
  chr2:107502865-107502908
  hyper

SEQ ID NO: 17628 - DNA, 214 bp, Homo sapiens
  chr2:107503670-107503884
  hyper
gcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccc

SEQ ID NO: 17629 - DNA, 73 bp, Homo sapiens; identical to SEQ ID NO: 6317
  chr2:108603211-108603284
  hyper

SEQ ID NO: 17630 - DNA, 51 bp, Homo sapiens
  chr2:109648222-109648273
  hyper
cacaggcgggataaagctgccccactttgcccccagcgaagagaaccctcc

SEQ ID NO: 17631 - DNA, 30 bp, Homo sapiens; identical to SEQ ID NO: 6319
  chr2:109744973-109745003
  hyper

SEQ ID NO: 17632 - DNA, 45 bp, Homo sapiens; identical to SEQ ID NO: 6320
  chr2:109745234-109745279
  hyper

SEQ ID NO: 17633 - DNA, 300 bp, Homo sapiens; identical to SEQ ID NO: 6321
  chr2:109745500-109745800
  hyper

SEQ ID NO: 17634 - DNA, 96 bp, Homo sapiens; identical to SEQ ID NO: 6324
  chr2:111490570-111490666
  hyper

SEQ ID NO: 17635 - DNA, 77 bp, Homo sapiens; identical to SEQ ID NO: 6326
  chr2:112656725-112656802
  hyper

SEQ ID NO: 17636 - DNA, 24 bp, Homo sapiens
  chr2:114256954-114256978
  hyper
acgaggaggaggaggcgagccaga

SEQ ID NO: 17637 - DNA, 51 bp, Homo sapiens
  chr2:114257137-114257188
  hyper
cccggcagccggcaaagcccccctactcgtacatcgcgctcatcaccatgg

SEQ ID NO: 17638 - DNA, 54 bp, Homo sapiens; identical to SEQ ID NO: 6329
  chr2:114260999-114261053
  hyper

SEQ ID NO: 17639 - DNA, 20 bp, Homo sapiens
  chr2:114261280-114261300
  hyper
agcccaggcacccctcgact

SEQ ID NO: 17640 - DNA, 6 bp, Homo sapiens
  chr2:114261458-114261464
  hyper
tgcccg

SEQ ID NO: 17641 - DNA, 48 bp, Homo sapiens
  chr2:119068049-119068097
  hyper
ccccccaccggccccctcccgggctcccctccccggtaaacagaaaag

SEQ ID NO: 17642 - DNA, 7 bp, Homo sapiens
  chr2:119532154-119532161
  hyper
ccgggag

SEQ ID NO: 17643 - DNA, 93 bp, Homo sapiens; identical to SEQ ID NO: 6342
  chr2:119593865-119593958
  hyper

SEQ ID NO: 17644 - DNA, 15 bp, Homo sapiens
  chr2:119600555-119600570
  hyper
gttgtacagtccctg

SEQ ID NO: 17645 - DNA, 91 bp, Homo sapiens
  chr2:119600747-119600838
  hyper
cagctgctcggccgtgaacgcggtccgcggccgcttgtcctccttctcgttcttcttcttcttcagcttcctggtgcgcggacctgcagcg

SEQ ID NO: 17646 - DNA, 25 bp, Homo sapiens
  chr2:119603086-119603111
  hyper
aagcgccgcgcggggaggatgcggg

SEQ ID NO: 17647 - DNA, 38 bp, Homo sapiens
  chr2:119604158-119604196
  hyper
agctttagacgcgcccgcgccggcggcggctggctggg

SEQ ID NO: 17648 - DNA, 254 bp, Homo sapiens; identical to SEQ ID NO: 6348
  chr2:119604426-119604680
  hyper

SEQ ID NO: 17649 - DNA, 120 bp, Homo sapiens
  chr2:119604689-119604809
  hyper
cgcgccgagggccgagtcgcgctgacttttaggttccggctgctgttcttccatgctcggccgccccgccgccccggccgccgcgccggcccccgcccccaccgcctcgctccccacccc

SEQ ID NO: 17650 - DNA, 182 bp, Homo sapiens; identical to SEQ ID NO: 2039
  chr2:119607442-119607624
  hyper

SEQ ID NO: 17651 - DNA, 7 bp, Homo sapiens
  chr2:119607847-119607854
  hyper
cgtcccc

SEQ ID NO: 17652 - DNA, 71 bp, Homo sapiens; identical to SEQ ID NO: 6353
  chr2:119610540-119610611
  hyper

SEQ ID NO: 17653 - DNA, 44 bp, Homo sapiens; identical to SEQ ID NO: 6354
  chr2:119611687-119611731
  hyper

SEQ ID NO: 17654 - DNA, 30 bp, Homo sapiens; identical to SEQ ID NO: 6355
  chr2:119613184-119613214
  hyper

SEQ ID NO: 17655 - DNA, 158 bp, Homo sapiens
  chr2:119614622-119614780
  hyper
ctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactg

SEQ ID NO: 17656 - DNA, 203 bp, Homo sapiens
  chr2:119614852-119615055
  hyper
gccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccg

SEQ ID NO: 17657 - DNA, 14 bp, Homo sapiens
  chr2:119616141-119616155
  hyper
ctcagcgctcccag

SEQ ID NO: 17658 - DNA, 150 bp, Homo sapiens; identical to SEQ ID NO: 6359
  chr2:119769161-119769311
  hyper

SEQ ID NO: 17659 - DNA, 167 bp, Homo sapiens
  chr2:119914553-119914720
  hyper
ggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccag

SEQ ID NO: 17660 - DNA, 3 bp, Homo sapiens
  chr2:119914752-119914755
  hyper
gaa

SEQ ID NO: 17661 - DNA, 440 bp, Homo sapiens; identical to SEQ ID NO: 6361
  chr2:119915167-119915607
  hyper

SEQ ID NO: 17662 - DNA, 39 bp, Homo sapiens; identical to SEQ ID NO: 6363
  chr2:120190272-120190311
  hyper

SEQ ID NO: 17663 - DNA, 178 bp, Homo sapiens; identical to SEQ ID NO: 6364
  chr2:121104414-121104592
  hyper

SEQ ID NO: 17664 - DNA, 155 bp, Homo sapiens; identical to SEQ ID NO: 6365
  chr2:121104793-121104948
  hyper

SEQ ID NO: 17665 - DNA, 75 bp, Homo sapiens; identical to SEQ ID NO: 6366
  chr2:121344942-121345017
  hyper

SEQ ID NO: 17666 - DNA, 40 bp, Homo sapiens; identical to SEQ ID NO: 6367
  chr2:121493902-121493942
  hyper

SEQ ID NO: 17667 - DNA, 76 bp, Homo sapiens
  chr2:124783097-124783173
  hyper
gagcgagtgcctctccaagcgggggtgggagggggtcaggctgtgcagaggagagagacagcgagaagaagccgcg

SEQ ID NO: 17668 - DNA, 30 bp, Homo sapiens; identical to SEQ ID NO: 6370
  chr2:124783375-124783405
  hyper

SEQ ID NO: 17669 - DNA, 324 bp, Homo sapiens
  chr2:127783257-127783581
  hyper
actctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactg

SEQ ID NO: 17670 - DNA, 75 bp, Homo sapiens
  chr2:127976392-127976467
  hyper
gctgggccgggcacccggggaggcggacgatgggcgaaggcatcggagggcgccgccgcggctcgggtgcagtgc

SEQ ID NO: 17671 - DNA, 86 bp, Homo sapiens
  chr2:127976672-127976758
  hyper
ccgagcctccgtcccctcttcccccgccattacaaaatacaaaaaggactagaaatgaatacacacggtctcggccacctaaggac

SEQ ID NO: 17672 - DNA, 28 bp, Homo sapiens
  chr2:128421822-128421850
  hyper
gccgccgcagctttccggccattgtccc

SEQ ID NO: 17673 - DNA, 91 bp, Homo sapiens; identical to SEQ ID NO: 6377
  chr2:128433386-128433477
  hyper

SEQ ID NO: 17674 - DNA, 15 bp, Homo sapiens
  chr2:130737190-130737205
  hyper
aaaactgtgttgagg

SEQ ID NO: 17675 - DNA, 162 bp, Homo sapiens; identical to SEQ ID NO: 2046
  chr2:130737475-130737637
  hyper

SEQ ID NO: 17676 - DNA, 33 bp, Homo sapiens
  chr2:130763551-130763584
  hyper
cctccgccaggcctgcgctgcctcgccccggga

SEQ ID NO: 17677 - DNA, 19 bp, Homo sapiens
  chr2:130763623-130763642
  hyper
ggcccgtttcctttcagcg

SEQ ID NO: 17678 - DNA, 198 bp, Homo sapiens; identical to SEQ ID NO: 6382
  chr2:131484889-131485087
  hyper

SEQ ID NO: 17679 - DNA, 89 bp, Homo sapiens; identical to SEQ ID NO: 6383
  chr2:131485343-131485432
  hyper

SEQ ID NO: 17680 - DNA, 301 bp, Homo sapiens; identical to SEQ ID NO: 6384
  chr2:131513559-131513860
  hyper

SEQ ID NO: 17681 - DNA, 54 bp, Homo sapiens; identical to SEQ ID NO: 6385
  chr2:131595112-131595166
  hyper

SEQ ID NO: 17682 - DNA, 25 bp, Homo sapiens
  chr2:131720827-131720852
  hyper
caggagggtcgcaggcgcccggtgg

SEQ ID NO: 17683 - DNA, 35 bp, Homo sapiens
  chr2:131792225-131792260
  hyper
ccctccccaaagcgccggtgccaggcgttttggcc

SEQ ID NO: 17684 - DNA, 35 bp, Homo sapiens; identical to SEQ ID NO: 6392
  chr2:132088604-132088639
  hyper

SEQ ID NO: 17685 - DNA, 187 bp, Homo sapiens; identical to SEQ ID NO: 6393
  chr2:132121342-132121529
  hyper

SEQ ID NO: 17686 - DNA, 50 bp, Homo sapiens
  chr2:132152311-132152361
  hyper
tgctgagccgaagctcggcggggctgagctccagctgggggcgggtagct

SEQ ID NO: 17687 - DNA, 26 bp, Homo sapiens
  chr2:132182764-132182790
  hyper
ggcgggcgcgggaggcgggcgcggga

SEQ ID NO: 17688 - DNA, 43 bp, Homo sapiens
  chr2:132767414-132767457
  hyper
aaccccacaaaaacccgcggcgacggggggaaaaaaccgcggc

SEQ ID NO: 17689 - DNA, 140 bp, Homo sapiens; identical to SEQ ID NO: 6397
  chr2:132767735-132767875
  hyper

SEQ ID NO: 17690 - DNA, 79 bp, Homo sapiens; identical to SEQ ID NO: 6398
  chr2:132796105-132796184
  hyper

SEQ ID NO: 17691 - DNA, 101 bp, Homo sapiens
  chr2:133015323-133015424
  hyper
gggggcctgcggtaccaggaaaaatctgcgtgcggcaaccttgagccttcgcggtctgggcagggggcctggccgctgcgcgtgcgcgcaatccccgaagg

SEQ ID NO: 17692 - DNA, 30 bp, Homo sapiens; identical to SEQ ID NO: 6400
  chr2:133015649-133015679
  hyper

SEQ ID NO: 17693 - DNA, 26 bp, Homo sapiens
  chr2:133426223-133426249
  hyper
ccactcctgggtctccgggtagggct

SEQ ID NO: 17694 - DNA, 79 bp, Homo sapiens; identical to SEQ ID NO: 6402
  chr2:133427558-133427637
  hyper

SEQ ID NO: 17695 - DNA, 321 bp, Homo sapiens; identical to SEQ ID NO: 6403
  chr2:135475874-135476195
  hyper

SEQ ID NO: 17696 - DNA, 49 bp, Homo sapiens; identical to SEQ ID NO: 6404
  chr2:135476941-135476990
  hyper

SEQ ID NO: 17697 - DNA, 75 bp, Homo sapiens; identical to SEQ ID NO: 6405
  chr2:136876531-136876606
  hyper

SEQ ID NO: 17698 - DNA, 11 bp, Homo sapiens
  chr2:137522475-137522486
  hyper
cccggggactg

SEQ ID NO: 17699 - DNA, 32 bp, Homo sapiens; identical to SEQ ID NO: 6407
  chr2:137522850-137522882
  hyper

SEQ ID NO: 17700 - DNA, 30 bp, Homo sapiens; identical to SEQ ID NO: 6408
  chr2:137523564-137523594
  hyper

SEQ ID NO: 17701 - DNA, 163 bp, Homo sapiens
  chr2:139537145-139537308
  hyper
aagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcac

SEQ ID NO: 17702 - DNA, 149 bp, Homo sapiens; identical to SEQ ID NO: 6411
  chr2:142888097-142888246
  hyper

SEQ ID NO: 17703 - DNA, 34 bp, Homo sapiens; identical to SEQ ID NO: 6412
  chr2:142888484-142888518
  hyper

SEQ ID NO: 17704 - DNA, 52 bp, Homo sapiens
  chr2:144694315-144694367
  hyper
tggttttgcttagtgcgtcttcatcgtattccctcgctgaggactgagcctg

SEQ ID NO: 17705 - DNA, 122 bp, Homo sapiens
  chr2:144695135-144695257
  hyper
gcggtgcgccaggccagacctgaccgagggcggaagacccgagcggcagggaggcagaaagaaaagaggtagcaagccccagacaagggatccttaattacagataaaaggcaaacaaaacc

SEQ ID NO: 17706 - DNA, 31 bp, Homo sapiens; identical to SEQ ID NO: 2057
  chr2:144695258-144695289
  hyper

SEQ ID NO: 17707 - DNA, 77 bp, Homo sapiens
  chr2:145273327-145273404
  hyper
acacacgcacacacacgcgtacacacacacaaaacctagagagagagagagagagagagaaaagcatcatttgtctc

SEQ ID NO: 17708 - DNA, 39 bp, Homo sapiens
  chr2:145273751-145273790
  hyper
ttctttttaaactcagttatcctccgtcagctcccccac

SEQ ID NO: 17709 - DNA, 106 bp, Homo sapiens
  chr2:145274080-145274186
  hyper
actcagcctggataacgggctcctccagaccatgtagaaactgccgggaaaagtctcgctgcgccctgcgactccttcagtccccggcctgggggcagagcctgct

SEQ ID NO: 17710 - DNA, 56 bp, Homo sapiens
  chr2:145274455-145274511
  hyper
gcccccgccctgccccaggcggacgctcccgaagcccggccggagacccggcgggc

SEQ ID NO: 17711 - DNA, 238 bp, Homo sapiens
  chr2:145274576-145274814
  hyper
cggggctgggggcgcggggccccggccggacccccgcgctcggacccccgggtgcctgacgctcactttgcccggcacttccccaacaccccccggtccagccgccgcgcgcgccgggctccggcgccggccgcggagggaggctcgccctagagccctgggcgccgccgccgccgccgcctcggttccttttccctttccccctccttctccctgggtctcgagccgcgtagtggcc

SEQ ID NO: 17712 - DNA, 242 bp, Homo sapiens
  chr2:145275213-145275455
  hyper
gacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctgg

SEQ ID NO: 17713 - DNA, 132 bp, Homo sapiens; identical to SEQ ID NO: 6420
  chr2:145277493-145277625
  hyper

SEQ ID NO: 17714 - DNA, 92 bp, Homo sapiens; identical to SEQ ID NO: 2062
  chr2:145281307-145281399
  hyper

SEQ ID NO: 17715 - DNA, 188 bp, Homo sapiens; identical to SEQ ID NO: 6422
  chr2:145281754-145281942
  hyper

SEQ ID NO: 17716 - DNA, 36 bp, Homo sapiens; identical to SEQ ID NO: 6423
  chr2:145281943-145281979
  hyper

SEQ ID NO: 17717 - DNA, 78 bp, Homo sapiens; identical to SEQ ID NO: 6424
  chr2:145282041-145282119
  hyper

SEQ ID NO: 17718 - DNA, 345 bp, Homo sapiens
  chr2:149633399-149633744
  hyper
cgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgcct

SEQ ID NO: 17719 - DNA, 92 bp, Homo sapiens
  chr2:149633965-149634057
  hyper
gatgtggagtcccggcttgatccctcccctctgggatgacctccctcccatgtctgcagaccctctgatgcgcctcacgctgggtggagagg

SEQ ID NO: 17720 - DNA, 198 bp, Homo sapiens; identical to SEQ ID NO: 6428
  chr2:152954698-152954896
  hyper

SEQ ID NO: 17721 - DNA, 161 bp, Homo sapiens
  chr2:154333374-154333535
  hyper
aattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacg

SEQ ID NO: 17722 - DNA, 164 bp, Homo sapiens
  chr2:154333567-154333731
  hyper
cgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccagggga

SEQ ID NO: 17723 - DNA, 73 bp, Homo sapiens
  chr2:154334199-154334272
  hyper
caaaacctcttaaaacggcacgttacaatcaaaggtatttatcgcccctcccctccagggcagggggggagca

SEQ ID NO: 17724 - DNA, 179 bp, Homo sapiens
  chr2:154335271-154335450
  hyper
cttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgc

SEQ ID NO: 17725 - DNA, 30 bp, Homo sapiens; identical to SEQ ID NO: 6433
  chr2:154729766-154729796
  hyper

SEQ ID NO: 17726 - DNA, 103 bp, Homo sapiens
  chr2:157176900-157177003
  hyper
gaaagggagggacaccgaggaaacaaagttcacccaagtgaatgcgtcctaattgctccaaggctctctccgcaaagtctacgactgcaagccgcaaagtcaa

SEQ ID NO: 17727 - DNA, 30 bp, Homo sapiens; identical to SEQ ID NO: 6437
  chr2:160760685-160760715
  hyper

SEQ ID NO: 17728 - DNA, 1 bp, Homo sapiens
  chr2:160761069-160761070
  hyper
g

SEQ ID NO: 17729 - DNA, 43 bp, Homo sapiens; identical to SEQ ID NO: 6439
  chr2:162095596-162095639
  hyper

SEQ ID NO: 17730 - DNA, 30 bp, Homo sapiens; identical to SEQ ID NO: 6441
  chr2:162274914-162274944
  hyper

SEQ ID NO: 17731 - DNA, 38 bp, Homo sapiens; identical to SEQ ID NO: 6449
  chr2:162284338-162284376
  hyper

SEQ ID NO: 17732 - DNA, 34 bp, Homo sapiens; identical to SEQ ID NO: 6450
  chr2:162930251-162930285
  hyper

SEQ ID NO: 17733 - DNA, 52 bp, Homo sapiens; identical to SEQ ID NO: 6451
  chr2:162930338-162930390
  hyper

SEQ ID NO: 17734 - DNA, 25 bp, Homo sapiens
  chr2:163695246-163695271
  hyper
cggactgccgcgggtgagagggttt

SEQ ID NO: 17735 - DNA, 30 bp, Homo sapiens; identical to SEQ ID NO: 6453
  chr2:163695477-163695507
  hyper

SEQ ID NO: 17736 - DNA, 141 bp, Homo sapiens; identical to SEQ ID NO: 6454
  chr2:164592629-164592770
  hyper

SEQ ID NO: 17737 - DNA, 30 bp, Homo sapiens; identical to SEQ ID NO: 6455
  chr2:164593340-164593370
  hyper

SEQ ID NO: 17738 - DNA, 31 bp, Homo sapiens; identical to SEQ ID NO: 6456
  chr2:167233063-167233094
  hyper

SEQ ID NO: 17739 - DNA, 36 bp, Homo sapiens
  chr2:168150033-168150069
  hyper
cacagactttgacagcgcggggatggcattgtgtga

SEQ ID NO: 17740 - DNA, 185 bp, Homo sapiens
  chr2:168150566-168150751
  hyper
ctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcag

SEQ ID NO: 17741 - DNA, 42 bp, Homo sapiens; identical to SEQ ID NO: 6459
  chr2:170218695-170218737
  hyper

SEQ ID NO: 17742 - DNA, 175 bp, Homo sapiens; identical to SEQ ID NO: 6460
  chr2:170219365-170219540
  hyper

SEQ ID NO: 17743 - DNA, 51 bp, Homo sapiens; identical to SEQ ID NO: 6461
  chr2:170219958-170220009
  hyper

SEQ ID NO: 17744 - DNA, 358 bp, Homo sapiens; identical to SEQ ID NO: 6462
  chr2:171568345-171568703
  hyper

SEQ ID NO: 17745 - DNA, 214 bp, Homo sapiens
  chr2:171570470-171570684
  hyper
gggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctg

SEQ ID NO: 17746 - DNA, 168 bp, Homo sapiens
  chr2:171570733-171570901
  hyper
ttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtg

SEQ ID NO: 17747 - DNA, 35 bp, Homo sapiens; identical to SEQ ID NO: 6464
  chr2:171669891-171669926
  hyper

SEQ ID NO: 17748 - DNA, 107 bp, Homo sapiens
  chr2:171670242-171670349
  hyper
tcccccacccacccacgacggggaaaggaataaagggcattgtgggcggagggtcgtgttcccaagtcccagcggtggttgacctaaggaaacgttatcctcggcag

SEQ ID NO: 17749 - DNA, 98 bp, Homo sapiens
  chr2:171671389-171671487
  hyper
gaaatgtctcaatctcgtgccacaggtgaagtaaacgaatcttcctttccagggaatcacgggttttgggaaaaggttgaggcgagcgggcgtctatg

SEQ ID NO: 17750 - DNA, 79 bp, Homo sapiens; identical to SEQ ID NO: 6468
  chr2:171674129-171674208
  hyper

SEQ ID NO: 17751 - DNA, 61 bp, Homo sapiens
  chr2:171675592-171675653
  hyper
tgacctcctcctttccccctgggctgtgttcaaagtctataatcagcggaaatttcgacgt

SEQ ID NO: 17752 - DNA, 36 bp, Homo sapiens; identical to SEQ ID NO: 6472
  chr2:171678013-171678049
  hyper

SEQ ID NO: 17753 - DNA, 14 bp, Homo sapiens
  chr2:172946211-172946225
  hyper
gcttcaggaacagg

SEQ ID NO: 17754 - DNA, 136 bp, Homo sapiens
  chr2:172949711-172949847
  hyper
tcttaggagaacctctgtctgttggccgcctcgggcgcccccagtgcgcgactccgcgctccagaggcagaggtcagtctcctcctgagccgccctagctctgcgccgaactgagtggcagcgacgagaagcggtc

SEQ ID NO: 17755 - DNA, 141 bp, Homo sapiens; identical to SEQ ID NO: 6479
  chr2:172950071-172950212
  hyper

SEQ ID NO: 17756 - DNA, 292 bp, Homo sapiens; identical to SEQ ID NO: 6480
  chr2:172951251-172951543
  hyper

SEQ ID NO: 17757 - DNA, 128 bp, Homo sapiens
  chr2:172952393-172952521
  hyper
aggcgctgtatcttccgcaggcggtagccacggtcggactgagcccctggcaggctaaggcctggatcccggttctcccctcatcacaactcctccctggctctctgagagctgcccccgtgggctga

SEQ ID NO: 17758 - DNA, 249 bp, Homo sapiens
  chr2:172955545-172955794
  hyper
tgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagaga

SEQ ID NO: 17759 - DNA, 73 bp, Homo sapiens
  chr2:172961325-172961398
  hyper
gcgggagtacctgggcggcaggcagttggccctggagctcagtgcccgcgttctgcctgagttgggagagccc

SEQ ID NO: 17760 - DNA, 62 bp, Homo sapiens
  chr2:172961598-172961660
  hyper
ccatttttcattcgcgctttggggagctcagtagagcacggggggagcgtgtctgcgcggcg

SEQ ID NO: 17761 - DNA, 26 bp, Homo sapiens
  chr2:172964795-172964821
  hyper
gggagggcgggcaggcgggaccggga

SEQ ID NO: 17762 - DNA, 14 bp, Homo sapiens
  chr2:172966250-172966264
  hyper
tgagtcttttggaa

SEQ ID NO: 17763 - DNA, 610 bp, Homo sapiens
  chr2:172966442-172967052
  hyper
cccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggt

SEQ ID NO: 17764 - DNA, 395 bp, Homo sapiens; identical to SEQ ID NO: 6489
  chr2:172970975-172971370
  hyper

SEQ ID NO: 17765 - DNA, 32 bp, Homo sapiens
  chr2:172973218-172973250
  hyper
tccagccgtggcctttccgcggcgctgggctt

SEQ ID NO: 17766 - DNA, 43 bp, Homo sapiens
  chr2:173099741-173099784
  hyper
cagcatcggcagcatcgagaaaggtgacgagttctgcaaataa

SEQ ID NO: 17767 - DNA, 283 bp, Homo sapiens
  chr2:173099814-173100097
  hyper
acgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 17768 - DNA, 164 bp, Homo sapiens
  chr2:173100098-173100262
  hyper
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagc

SEQ ID NO: 17769 - DNA, 90 bp, Homo sapiens; identical to SEQ ID NO: 6493
  chr2:173600600-173600690
  hyper

SEQ ID NO: 17770 - DNA, 66 bp, Homo sapiens
  chr2:175190805-175190871
  hyper
aaagagaagtgttggcgcctcaaacttgaggatcagcttcttgggccccactccagggtgtcgcgg

SEQ ID NO: 17771 - DNA, 20 bp, Homo sapiens
  chr2:175193823-175193843
  hyper
tatgacgaactagaggctgg

SEQ ID NO: 17772 - DNA, 56 bp, Homo sapiens
  chr2:175197119-175197175
  hyper
atatgcgagtgcccacgtctagagtctgacagctggaactacggggaaaacggcgg

SEQ ID NO: 17773 - DNA, 62 bp, Homo sapiens
  chr2:175199465-175199527
  hyper
ccctcgccccccccccgcaagtatcccccactactcccccccacccccgcggccctagctag

SEQ ID NO: 17774 - DNA, 59 bp, Homo sapiens
  chr2:175202652-175202711
  hyper
agaaaggctccctctttgcccactctccacctccctccaacacccgtctctttcctttt

SEQ ID NO: 17775 - DNA, 30 bp, Homo sapiens; identical to SEQ ID NO: 6510
  chr2:175203142-175203172
  hyper

SEQ ID NO: 17776 - DNA, 200 bp, Homo sapiens
  chr2:175207028-175207228
  hyper
gggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttct

SEQ ID NO: 17777 - DNA, 278 bp, Homo sapiens
  chr2:175207258-175207536
  hyper
gcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacct

SEQ ID NO: 17778 - DNA, 15 bp, Homo sapiens
  chr2:175547140-175547155
  hyper
cgagacctacggaga

SEQ ID NO: 17779 - DNA, 201 bp, Homo sapiens; identical to SEQ ID NO: 6517
  chr2:175547440-175547641
  hyper

SEQ ID NO: 17780 - DNA, 43 bp, Homo sapiens; identical to SEQ ID NO: 6519
  chr2:176943640-176943683
  hyper

SEQ ID NO: 17781 - DNA, 59 bp, Homo sapiens; identical to SEQ ID NO: 240
  chr2:176944346-176944405
  hyper

SEQ ID NO: 17782 - DNA, 197 bp, Homo sapiens
  chr2:176948848-176949045
  hyper
gatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttag

SEQ ID NO: 17783 - DNA, 43 bp, Homo sapiens; identical to SEQ ID NO: 2112
  chr2:176949959-176950002
  hyper

SEQ ID NO: 17784 - DNA, 68 bp, Homo sapiens
  chr2:176950074-176950142
  hyper
cgacaactttgatagtcataatgacgccggtggcaaccattttaacgaagatcaatcttcactccagg

SEQ ID NO: 17785 - DNA, 30 bp, Homo sapiens; identical to SEQ ID NO: 6529
  chr2:176952943-176952973
  hyper

SEQ ID NO: 17786 - DNA, 68 bp, Homo sapiens; identical to SEQ ID NO: 244
  chr2:176957347-176957415
  hyper

SEQ ID NO: 17787 - DNA, 202 bp, Homo sapiens
  chr2:176957919-176958121
  hyper
ctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacat

SEQ ID NO: 17788 - DNA, 76 bp, Homo sapiens
  chr2:176959213-176959289
  hyper
tggctctaaatcagccggacatgtgcgtctaccgaagagggaggaagaagagagtgccttacaccaaactgcagct

SEQ ID NO: 17789 - DNA, 18 bp, Homo sapiens
  chr2:176965492-176965510
  hyper
gcgcgtggccagggccgg

SEQ ID NO: 17790 - DNA, 48 bp, Homo sapiens; identical to SEQ ID NO: 6539
  chr2:176969256-176969304
  hyper

SEQ ID NO: 17791 - DNA, 30 bp, Homo sapiens; identical to SEQ ID NO: 6542
  chr2:176971402-176971432
  hyper

SEQ ID NO: 17792 - DNA, 30 bp, Homo sapiens; identical to SEQ ID NO: 6543
  chr2:176972908-176972938
  hyper

SEQ ID NO: 17793 - DNA, 30 bp, Homo sapiens; identical to SEQ ID NO: 6548
  chr2:176983753-176983783
  hyper

SEQ ID NO: 17794 - DNA, 4 bp, Homo sapiens
  chr2:176986711-176986715
  hyper
cgcg

SEQ ID NO: 17795 - DNA, 209 bp, Homo sapiens
  chr2:176986848-176987057
  hyper
acattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcc

SEQ ID NO: 17796 - DNA, 33 bp, Homo sapiens
  chr2:176993514-176993547
  hyper
atttcacaggcttggcggaggaagtaggatcgt

SEQ ID NO: 17797 - DNA, 38 bp, Homo sapiens; identical to SEQ ID NO: 6554
  chr2:176996261-176996299
  hyper

SEQ ID NO: 17798 - DNA, 101 bp, Homo sapiens; identical to SEQ ID NO: 6558
  chr2:177004982-177005083
  hyper

SEQ ID NO: 17799 - DNA, 35 bp, Homo sapiens; identical to SEQ ID NO: 6559
  chr2:177005582-177005617
  hyper

SEQ ID NO: 17800 - DNA, 55 bp, Homo sapiens; identical to SEQ ID NO: 6560
  chr2:177042646-177042701
  hyper

SEQ ID NO: 17801 - DNA, 58 bp, Homo sapiens
  chr2:177042926-177042984
  hyper
ggcggggtgggctggcgctcctgatccacctggaacacttttgcaaagacagacggtg

SEQ ID NO: 17802 - DNA, 19 bp, Homo sapiens
  chr2:177053935-177053954
  hyper
cctcggccgtcttctcggg

SEQ ID NO: 17803 - DNA, 114 bp, Homo sapiens
  chr2:177053999-177054113
  hyper
cggcgaacccggcccttttccggcttgtctcaaagcgtcagccgacggccaccctggtgctttccagaccgcatccccggccccaggcacctaccccaagtccgtctctcccgc

SEQ ID NO: 17804 - DNA, 12 bp, Homo sapiens
  chr2:177054351-177054363
  hyper
aaaatgtgccag

SEQ ID NO: 17805 - DNA, 60 bp, Homo sapiens; identical to SEQ ID NO: 6567
  chr2:177502788-177502848
  hyper

SEQ ID NO: 17806 - DNA, 30 bp, Homo sapiens; identical to SEQ ID NO: 6568
  chr2:179278479-179278509
  hyper

SEQ ID NO: 17807 - DNA, 51 bp, Homo sapiens; identical to SEQ ID NO: 6569
  chr2:179278710-179278761
  hyper

SEQ ID NO: 17808 - DNA, 487 bp, Homo sapiens; identical to SEQ ID NO: 6570
  chr2:180725172-180725659
  hyper

SEQ ID NO: 17809 - DNA, 35 bp, Homo sapiens; identical to SEQ ID NO: 6571
  chr2:180726046-180726081
  hyper

SEQ ID NO: 17810 - DNA, 27 bp, Homo sapiens
  chr2:182321811-182321838
  hyper
ctggcatttgggccacgccgggctggg

SEQ ID NO: 17811 - DNA, 22 bp, Homo sapiens
  chr2:182322170-182322192
  hyper
gcgagtgcgcggcatcccaggc

SEQ ID NO: 17812 - DNA, 25 bp, Homo sapiens
  chr2:182542878-182542903
  hyper
agctgtccatggtaccgtaaggcgg

SEQ ID NO: 17813 - DNA, 385 bp, Homo sapiens
  chr2:182542933-182543318
  hyper
ggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 17814 - DNA, 151 bp, Homo sapiens
  chr2:182545388-182545539
  hyper
ccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacc

SEQ ID NO: 17815 - DNA, 91 bp, Homo sapiens
  chr2:182545694-182545785
  hyper
gaggggatttgagggaaggaagggaaaagctaatgttaactaggtctagatcagagcgagtggcctgctttcgcgccggaagtaggacaga

SEQ ID NO: 17816 - DNA, 47 bp, Homo sapiens; identical to SEQ ID NO: 6579
  chr2:182546488-182546535
  hyper

SEQ ID NO: 17817 - DNA, 319 bp, Homo sapiens
  chr2:182547613-182547932
  hyper
tacaggagaattatggtggagtcagatgttcttgagcaagagggacgcccgagtgttttgccagacggagactcaaatgcgtaaagtgcgggaattactagtctgtttcctccctctacccttgataaattcatctctaatcccactgcgcgttgttcgctcaggcctggagatttgtacaaaggaaaggccactccaggatgtttcagagacagggctgaggttgggtctcacggtagctgtccttgggcttcccatcccgcagcgctccgatgtgaccctcctctgcgcggaaaatttcgacccggggcgccggcat

SEQ ID NO: 17818 - DNA, 30 bp, Homo sapiens; identical to SEQ ID NO: 6582
  chr2:182548451-182548481
  hyper

SEQ ID NO: 17819 - DNA, 55 bp, Homo sapiens; identical to SEQ ID NO: 6583
  chr2:182548734-182548789
  hyper

SEQ ID NO: 17820 - DNA, 15 bp, Homo sapiens
  chr2:182548819-182548834
  hyper
cgccctgcctaggag

SEQ ID NO: 17821 - DNA, 203 bp, Homo sapiens
  chr2:182549134-182549337
  hyper
caacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttag

SEQ ID NO: 17822 - DNA, 133 bp, Homo sapiens
  chr2:182819216-182819349
  hyper
ttgaactgctaggtactccttttggcctaaggacacagtgaaaaatgtaccgagaccttggagagccacgaaccaagaaacttcagaaacctctgatatctgatcaagagttaagagacgtcagaatcatcac

SEQ ID NO: 17823 - DNA, 72 bp, Homo sapiens
  chr2:183731222-183731294
  hyper
ccagggcaagcagcccggcccgcagcagcagcatccctcccgggctgccgcagaccatgatcccggcaggat

SEQ ID NO: 17824 - DNA, 285 bp, Homo sapiens
  chr2:183731524-183731809
  hyper
ctatttattcctctccctctggcagaagcatcagacttcgcagatcagtcagataagagggacacgagaggaggcgaggaagacataaaaacaaaagtagaattcagctgagagctagttggagctctggggtgtctcctcccctagatcacgcacacaaaaagatgctaaagaaagcattaaattccccaaagtgaggaggacagaggggttggggggaaggagggaggaaaagctcctaatgggagagaagggtgcagtaagagtttacaagtcctgtgtggg

SEQ ID NO: 17825 - DNA, 30 bp, Homo sapiens
  chr2:183732076-183732106
  hyper
gcgccgagtcgagcgcgccctcacactagg

SEQ ID NO: 17826 - DNA, 38 bp, Homo sapiens
  chr2:185462831-185462869
  hyper
tcttgagaaagaagccgctgctggcaccggcctggatt

SEQ ID NO: 17827 - DNA, 9 bp, Homo sapiens
  chr2:185462980-185462989
  hyper
ctctccgcc

SEQ ID NO: 17828 - DNA, 31 bp, Homo sapiens
  chr2:186603457-186603488
  hyper
ccgcccttctggggccgctaccattggaagc

SEQ ID NO: 17829 - DNA, 318 bp, Homo sapiens
  chr2:193060067-193060385
  hyper
agcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctc

SEQ ID NO: 17830 - DNA, 8 bp, Homo sapiens
  chr2:193060675-193060683
  hyper
tactcggg

SEQ ID NO: 17831 - DNA, 55 bp, Homo sapiens
  chr2:193060891-193060946
  hyper
tcggggacaagggtggagaggaacatctttcttccatgaccggggtcactattgc

SEQ ID NO: 17832 - DNA, 423 bp, Homo sapiens; identical to SEQ ID NO: 6597
  chr2:197457404-197457827
  hyper

SEQ ID NO: 17833 - DNA, 66 bp, Homo sapiens; identical to SEQ ID NO: 6598
  chr2:197458195-197458261
  hyper

SEQ ID NO: 17834 - DNA, 30 bp, Homo sapiens; identical to SEQ ID NO: 6599
  chr2:198651504-198651534
  hyper

SEQ ID NO: 17835 - DNA, 46 bp, Homo sapiens; identical to SEQ ID NO: 6601
  chr2:200328258-200328304
  hyper

SEQ ID NO: 17836 - DNA, 26 bp, Homo sapiens
  chr2:200329668-200329694
  hyper
tcggcgtcacgcgtccaaccctgggg

SEQ ID NO: 17837 - DNA, 30 bp, Homo sapiens; identical to SEQ ID NO: 6604
  chr2:200334190-200334220
  hyper

SEQ ID NO: 17838 - DNA, 82 bp, Homo sapiens; identical to SEQ ID NO: 6607
  chr2:200336264-200336346
  hyper

SEQ ID NO: 17839 - DNA, 66 bp, Homo sapiens
  chr2:201450490-201450556
  hyper
caatgtttgctaagacgcaagagggtgtgacacagacgctaagcgccactggcgaggagatgaagg

SEQ ID NO: 17840 - DNA, 67 bp, Homo sapiens; identical to SEQ ID NO: 6609
  chr2:202899715-202899782
  hyper

SEQ ID NO: 17841 - DNA, 74 bp, Homo sapiens; identical to SEQ ID NO: 6610
  chr2:206550451-206550525
  hyper

SEQ ID NO: 17842 - DNA, 40 bp, Homo sapiens; identical to SEQ ID NO: 2157
  chr2:207139115-207139155
  hyper

SEQ ID NO: 17843 - DNA, 130 bp, Homo sapiens
  chr2:207139217-207139347
  hyper
cggagtggggccctgaccagggaggaagtgtccgctttaagagcttctggaggggaggaaggggctcctccgcccgggtgggagagtgagtgagtgggtgggcgggcagggggcggtcccgccgctcctg

SEQ ID NO: 17844 - DNA, 218 bp, Homo sapiens
  chr2:207139605-207139823
  hyper
gagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccacc

SEQ ID NO: 17845 - DNA, 30 bp, Homo sapiens; identical to SEQ ID NO: 6614
  chr2:207140134-207140164
  hyper

SEQ ID NO: 17846 - DNA, 15 bp, Homo sapiens
  chr2:207307463-207307478
  hyper
tctgtattgcttccc

SEQ ID NO: 17847 - DNA, 167 bp, Homo sapiens
  chr2:207307562-207307729
  hyper
tcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctc

SEQ ID NO: 17848 - DNA, 169 bp, Homo sapiens; identical to SEQ ID NO: 6617
  chr2:207308045-207308214
  hyper

SEQ ID NO: 17849 - DNA, 300 bp, Homo sapiens
  chr2:207308502-207308802
  hyper
cggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccag

SEQ ID NO: 17850 - DNA, 63 bp, Homo sapiens
  chr2:207308857-207308920
  hyper
gaaagcgaagggcgcgcgggtccgtgtgctccgggcttgtccccggctcggcctttccttccc

SEQ ID NO: 17851 - DNA, 75 bp, Homo sapiens; identical to SEQ ID NO: 6620
  chr2:208546197-208546272
  hyper

SEQ ID NO: 17852 - DNA, 124 bp, Homo sapiens; identical to SEQ ID NO: 6624
  chr2:211089565-211089689
  hyper

SEQ ID NO: 17853 - DNA, 423 bp, Homo sapiens
  chr2:213402687-213403110
  hyper
cacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagc

SEQ ID NO: 17854 - DNA, 45 bp, Homo sapiens
  chr2:213403337-213403382
  hyper
agccgggcgcgcgtgggggtgcgaggggggcgggcgcggcgcgcg

SEQ ID NO: 17855 - DNA, 88 bp, Homo sapiens; identical to SEQ ID NO: 6628
  chr2:213403913-213404001
  hyper

SEQ ID NO: 17856 - DNA, 32 bp, Homo sapiens; identical to SEQ ID NO: 6629
  chr2:216300252-216300284
  hyper

SEQ ID NO: 17857 - DNA, 30 bp, Homo sapiens; identical to SEQ ID NO: 6630
  chr2:216301757-216301787
  hyper

SEQ ID NO: 17858 - DNA, 230 bp, Homo sapiens
  chr2:217559066-217559296
  hyper
cgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgc

SEQ ID NO: 17859 - DNA, 96 bp, Homo sapiens
  chr2:217559326-217559422
  hyper
tcatgcagcagccgcagcccggctccttgaccagctcgcagcccagggggctgggggggcacatggagagggctttctcgtcgcagggctcgcagt

SEQ ID NO: 17860 - DNA, 45 bp, Homo sapiens; identical to SEQ ID NO: 6633
  chr2:219735785-219735830
  hyper

SEQ ID NO: 17861 - DNA, 30 bp, Homo sapiens; identical to SEQ ID NO: 6635
  chr2:219773737-219773767
  hyper

SEQ ID NO: 17862 - DNA, 304 bp, Homo sapiens; identical to SEQ ID NO: 6636
  chr2:219824786-219825090
  hyper

SEQ ID NO: 17863 - DNA, 36 bp, Homo sapiens; identical to SEQ ID NO: 6637
  chr2:219825513-219825549
  hyper

SEQ ID NO: 17864 - DNA, 92 bp, Homo sapiens; identical to SEQ ID NO: 6638
  chr2:219846666-219846758
  hyper

SEQ ID NO: 17865 - DNA, 103 bp, Homo sapiens; identical to SEQ ID NO: 6639
  chr2:219847047-219847150
  hyper

SEQ ID NO: 17866 - DNA, 476 bp, Homo sapiens
  chr2:219849001-219849477
  hyper
cttgaagagaccgtctccgacgggatctgcaagcagcagaagaaaagaatcaggagaaccccgggcggaagttgtgggcttgacaaaagggccccgggccaaggcttaaggggggtgctgtggtccccaggcgcgaggctgggggcccgggccacccggctcctcctcccggagcctggtccaggcgcgctgcgcggagcccctccatagagcccaagtcaggaaacgcgtccaggaaaaaggaaatccgctttccgaaggggccggctggagccttataaagccgagcggggaactgcgccagccgagctggagcgcgaagagaagaggagggtgcctggagggccggcctgaagctcgtagcaggaaggtgaggagccgtgagagcgcaggggagacgcccgcggaccacagccttctggtacggctcggccacagagtactccaccacgccagagacccgtgcttcccctctc

SEQ ID NO: 17867 - DNA, 61 bp, Homo sapiens; identical to SEQ ID NO: 6642
  chr2:219850168-219850229
  hyper

SEQ ID NO: 17868 - DNA, 58 bp, Homo sapiens; identical to SEQ ID NO: 6643
  chr2:219857911-219857969
  hyper

SEQ ID NO: 17869 - DNA, 40 bp, Homo sapiens; identical to SEQ ID NO: 6644
  chr2:219867872-219867912
  hyper

SEQ ID NO: 17870 - DNA, 67 bp, Homo sapiens
  chr2:220196567-220196634
  hyper
gccctcatcctctcattgccaccaggcctcctcccacagctgttcctgaatccgctgcattggcctc

SEQ ID NO: 17871 - DNA, 50 bp, Homo sapiens; identical to SEQ ID NO: 6647
  chr2:220197440-220197490
  hyper

SEQ ID NO: 17872 - DNA, 151 bp, Homo sapiens
  chr2:220222947-220223098
  hyper
ggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgc

SEQ ID NO: 17873 - DNA, 87 bp, Homo sapiens
  chr2:220223128-220223215
  hyper
ggaacccgtggccatcgggtgtggggtgtgcagggtgcggagaaggctaggattcctcccaatcctctgctgcgccctcccccagcc

SEQ ID NO: 17874 - DNA, 30 bp, Homo sapiens; identical to SEQ ID NO: 6649
  chr2:220223590-220223620
  hyper

SEQ ID NO: 17875 - DNA, 36 bp, Homo sapiens; identical to SEQ ID NO: 6650
  chr2:220283254-220283290
  hyper

SEQ ID NO: 17876 - DNA, 21 bp, Homo sapiens
  chr2:220283711-220283732
  hyper
cgacgtcgagcgcgacaacct

SEQ ID NO: 17877 - DNA, 55 bp, Homo sapiens
  chr2:220299533-220299588
  hyper
aatcgccggccgccccggtgaccttctgggtagcacaggccgaaggcgggcgggc

SEQ ID NO: 17878 - DNA, 13 bp, Homo sapiens
  chr2:220349706-220349719
  hyper
cacaaccagttgg

SEQ ID NO: 17879 - DNA, 30 bp, Homo sapiens; identical to SEQ ID NO: 6657
  chr2:220379221-220379251
  hyper

SEQ ID NO: 17880 - DNA, 335 bp, Homo sapiens
  chr2:220416513-220416848
  hyper
ggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagta

SEQ ID NO: 17881 - DNA, 38 bp, Homo sapiens
  chr2:220417649-220417687
  hyper
cggcgtccgaggggccgcagcgtcgcagctggagaagg

SEQ ID NO: 17882 - DNA, 26 bp, Homo sapiens
  chr2:223159453-223159479
  hyper
agaaccaaagccgacttgtccgcgcc

SEQ ID NO: 17883 - DNA, 51 bp, Homo sapiens; identical to SEQ ID NO: 6662
  chr2:223159710-223159761
  hyper

SEQ ID NO: 17884 - DNA, 51 bp, Homo sapiens
  chr2:223160065-223160116
  hyper
cagctcacccctccctccataaagtgccaagaacaccgggttggcaaatat

SEQ ID NO: 17885 - DNA, 233 bp, Homo sapiens
  chr2:223163535-223163768
  hyper
cggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtc

SEQ ID NO: 17886 - DNA, 49 bp, Homo sapiens
  chr2:223163954-223164003
  hyper
gagacagccccagggagatggcagttgctgagggcggagaagttcctgt

SEQ ID NO: 17887 - DNA, 117 bp, Homo sapiens
  chr2:223164417-223164534
  hyper
ttctccgtccgcaagcggggctaatgtgaagcacaggcagccgtcgctaggcccaagcactcgttagttgaaggctgggggtatgggggagggtgcagaaaaaaacctggctcctct

SEQ ID NO: 17888 - DNA, 15 bp, Homo sapiens
  chr2:223166211-223166226
  hyper
tgtggcctgtgtccc

SEQ ID NO: 17889 - DNA, 99 bp, Homo sapiens
  chr2:223166721-223166820
  hyper
ctcacgctctgtgcacgttcgaaatgaaacgggagccttgaagacgatatttggataatttgacaaaaaaaaaaaaaaggtgggcgggggagatagctt

SEQ ID NO: 17890 - DNA, 139 bp, Homo sapiens
  chr2:223167250-223167389
  hyper
aagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgat

SEQ ID NO: 17891 - DNA, 450 bp, Homo sapiens; identical to SEQ ID NO: 6675
  chr2:223168916-223169366
  hyper

SEQ ID NO: 17892 - DNA, 21 bp, Homo sapiens
  chr2:223170354-223170375
  hyper
cttctttccatccctcggccc

SEQ ID NO: 17893 - DNA, 318 bp, Homo sapiens
  chr2:223170434-223170752
  hyper
ctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttcca

SEQ ID NO: 17894 - DNA, 35 bp, Homo sapiens; identical to SEQ ID NO: 6678
  chr2:223171277-223171312
  hyper

SEQ ID NO: 17895 - DNA, 275 bp, Homo sapiens
  chr2:223176181-223176456
  hyper
ctactccgctgcaagccccgcagagaacctcgccttcttcccgaccgccaagtctgattgtacagacttcatagaaggtctggaataaggactgtgttgctgcagaggccgggtcttgggcccctgggcgtgaggacgcaggctcggcccctgggaagaaatgtactaacgcacctcaagactcctaaggtgtttccaagtcccccctccaactttcgtgtccaggtcacgctgccccgccctcggacaatgagagggtgtgtcaagatgctctt

SEQ ID NO: 17896 - DNA, 43 bp, Homo sapiens
  chr2:223176983-223177026
  hyper
ccgtaatggagctggcaagtgggacgaacgggacagcctaaag

SEQ ID NO: 17897 - DNA, 28 bp, Homo sapiens
  chr2:223177610-223177638
  hyper
tatccgcataatccgtcctcaaatcccc

SEQ ID NO: 17898 - DNA, 375 bp, Homo sapiens; identical to SEQ ID NO: 6682
  chr2:225906404-225906779
  hyper

SEQ ID NO: 17899 - DNA, 352 bp, Homo sapiens; identical to SEQ ID NO: 6683
  chr2:225906790-225907142
  hyper

SEQ ID NO: 17900 - DNA, 15 bp, Homo sapiens
  chr2:229046730-229046745
  hyper
ccctgaagttgttca

SEQ ID NO: 17901 - DNA, 232 bp, Homo sapiens; identical to SEQ ID NO: 2179
  chr2:230578195-230578427
  hyper

SEQ ID NO: 17902 - DNA, 123 bp, Homo sapiens; identical to SEQ ID NO: 6688
  chr2:231903049-231903172
  hyper

SEQ ID NO: 17903 - DNA, 18 bp, Homo sapiens
  chr2:232394952-232394970
  hyper
ggacggggggcaccccga

SEQ ID NO: 17904 - DNA, 70 bp, Homo sapiens
  chr2:232395061-232395131
  hyper
gcacctaccatgcggcccgcggcccgcgagaccccggcttccaccctccgagcgacggacacagacgcgg

SEQ ID NO: 17905 - DNA, 27 bp, Homo sapiens
  chr2:232791677-232791704
  hyper
gactggggtgggaggcgcagggagagc

SEQ ID NO: 17906 - DNA, 17 bp, Homo sapiens
  chr2:232792012-232792029
  hyper
cccgctccagtatcctg

SEQ ID NO: 17907 - DNA, 30 bp, Homo sapiens; identical to SEQ ID NO: 6692
  chr2:233283450-233283480
  hyper

SEQ ID NO: 17908 - DNA, 30 bp, Homo sapiens; identical to SEQ ID NO: 6693
  chr2:233283737-233283767
  hyper

SEQ ID NO: 17909 - DNA, 66 bp, Homo sapiens; identical to SEQ ID NO: 6694
  chr2:233285777-233285843
  hyper

SEQ ID NO: 17910 - DNA, 181 bp, Homo sapiens; identical to SEQ ID NO: 277
  chr2:233351415-233351596
  hyper

SEQ ID NO: 17911 - DNA, 58 bp, Homo sapiens
  chr2:233352853-233352911
  hyper
tggaaaggggctggagctggagatgaggagccgaggactcctccgaagggctgggggc

SEQ ID NO: 17912 - DNA, 98 bp, Homo sapiens; identical to SEQ ID NO: 6701
  chr2:233368141-233368239
  hyper

SEQ ID NO: 17913 - DNA, 85 bp, Homo sapiens; identical to SEQ ID NO: 6702
  chr2:233388723-233388808
  hyper

SEQ ID NO: 17914 - DNA, 30 bp, Homo sapiens; identical to SEQ ID NO: 6703
  chr2:233389121-233389151
  hyper

SEQ ID NO: 17915 - DNA, 131 bp, Homo sapiens; identical to SEQ ID NO: 6704
  chr2:233498345-233498476
  hyper

SEQ ID NO: 17916 - DNA, 51 bp, Homo sapiens; identical to SEQ ID NO: 6708
  chr2:233740999-233741050
  hyper

SEQ ID NO: 17917 - DNA, 100 bp, Homo sapiens; identical to SEQ ID NO: 6709
  chr2:233741381-233741481
  hyper

SEQ ID NO: 17918 - DNA, 117 bp, Homo sapiens; identical to SEQ ID NO: 6710
  chr2:235404416-235404533
  hyper

SEQ ID NO: 17919 - DNA, 26 bp, Homo sapiens
  chr2:235404623-235404649
  hyper
cgctcgctccccggtcgctccgggcg

SEQ ID NO: 17920 - DNA, 1 bp, Homo sapiens
  chr2:237068552-237068553
  hyper
t

SEQ ID NO: 17921 - DNA, 16 bp, Homo sapiens
  chr2:237068925-237068941
  hyper
gcggtggaggctaggg

SEQ ID NO: 17922 - DNA, 298 bp, Homo sapiens
  chr2:237073056-237073354
  hyper
cgcgcttcggggtccggcagcgagcggacagggctctgagcgcagggccggggttgggacaggagtgggcttggggaccaggcacgccccaccgagatggggaggcgcgcagctccccgtcccttgcagaccgactcccagctcccctgcgtagcctctcccgttttccccctttgtggtgcggactaccggggcgtccttggggtggggcggtgcccgggtcccgccccctcgaccccgcccggagggggaggtgccggggccgggggcgctccagccagcctccgcctccgactga

SEQ ID NO: 17923 - DNA, 82 bp, Homo sapiens
  chr2:237073414-237073496
  hyper
ggagcctgatttatggaccctccactctgccggcaggcgagcaccgcttcttttcgggccggagatatttgtaaaggaaaga

SEQ ID NO: 17924 - DNA, 9 bp, Homo sapiens
  chr2:237073564-237073573
  hyper
cgcttgcct

SEQ ID NO: 17925 - DNA, 39 bp, Homo sapiens; identical to SEQ ID NO: 6719
  chr2:237075146-237075185
  hyper

SEQ ID NO: 17926 - DNA, 34 bp, Homo sapiens; identical to SEQ ID NO: 6720
  chr2:237076602-237076636
  hyper

SEQ ID NO: 17927 - DNA, 69 bp, Homo sapiens; identical to SEQ ID NO: 6721
  chr2:237076656-237076725
  hyper

SEQ ID NO: 17928 - DNA, 28 bp, Homo sapiens
  chr2:237078348-237078376
  hyper
tggggagttggcccgtgttggacgtgtg

SEQ ID NO: 17929 - DNA, 54 bp, Homo sapiens
  chr2:237080210-237080264
  hyper
ggcgcgcttcgctgccgccgccagagtcgaggtaacgggtggtcgtggagaggg

SEQ ID NO: 17930 - DNA, 64 bp, Homo sapiens
  chr2:237081277-237081341
  hyper
ctgaaggctgggaaacgtgacccttcacacctgcgccgccctctccactccagcgacgaggaac

SEQ ID NO: 17931 - DNA, 7 bp, Homo sapiens
  chr2:237086468-237086475
  hyper
gccctgg

SEQ ID NO: 17932 - DNA, 177 bp, Homo sapiens; identical to SEQ ID NO: 6727
  chr2:237086712-237086889
  hyper

SEQ ID NO: 17933 - DNA, 22 bp, Homo sapiens
  chr2:237145988-237146010
  hyper
ggccggggcgcggggcgggggc

SEQ ID NO: 17934 - DNA, 50 bp, Homo sapiens; identical to SEQ ID NO: 6729
  chr2:237146264-237146314
  hyper

SEQ ID NO: 17935 - DNA, 52 bp, Homo sapiens
  chr2:237416164-237416216
  hyper
tcgcgaacctcacttcggccactcaggtgggcgcgacgcggccctagcaacg

SEQ ID NO: 17936 - DNA, 75 bp, Homo sapiens
  chr2:238395216-238395291
  hyper
cggtcctggaaccaccgcgccgcgcgtcctggcttccacatctgccccatttgcccgcggatcttgactttttct

SEQ ID NO: 17937 - DNA, 420 bp, Homo sapiens; identical to SEQ ID NO: 6732
  chr2:238536266-238536686
  hyper

SEQ ID NO: 17938 - DNA, 43 bp, Homo sapiens; identical to SEQ ID NO: 2193
  chr2:238864588-238864631
  hyper

SEQ ID NO: 17939 - DNA, 143 bp, Homo sapiens
  chr2:238864913-238865056
  hyper
aagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactca

SEQ ID NO: 17940 - DNA, 30 bp, Homo sapiens; identical to SEQ ID NO: 6735
  chr2:238865269-238865299
  hyper

SEQ ID NO: 17941 - DNA, 62 bp, Homo sapiens; identical to SEQ ID NO: 6736
  chr2:239072210-239072272
  hyper

SEQ ID NO: 17942 - DNA, 27 bp, Homo sapiens
  chr2:239755137-239755164
  hyper
gggtggggctgggtgcggtggctctgc

SEQ ID NO: 17943 - DNA, 40 bp, Homo sapiens; identical to SEQ ID NO: 6739
  chr2:239757929-239757969
  hyper

SEQ ID NO: 17944 - DNA, 30 bp, Homo sapiens; identical to SEQ ID NO: 6740
  chr2:239758179-239758209
  hyper

SEQ ID NO: 17945 - DNA, 37 bp, Homo sapiens; identical to SEQ ID NO: 6741
  chr2:239758409-239758446
  hyper

SEQ ID NO: 17946 - DNA, 386 bp, Homo sapiens
  chr2:241759211-241759597
  hyper
ccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcga

SEQ ID NO: 17947 - DNA, 42 bp, Homo sapiens; identical to SEQ ID NO: 6745
  chr2:241760366-241760408
  hyper

SEQ ID NO: 17948 - DNA, 30 bp, Homo sapiens; identical to SEQ ID NO: 6746
  chr2:241760679-241760709
  hyper

SEQ ID NO: 17949 - DNA, 71 bp, Homo sapiens
  chr2:241771257-241771328
  hyper
tggaaggtcagggcctggaggggagctgggtccaggcagggaactcacagcagagacgccccgagggtggg

SEQ ID NO: 17950 - DNA, 30 bp, Homo sapiens; identical to SEQ ID NO: 6748
  chr2:241771696-241771726
  hyper

SEQ ID NO: 17951 - DNA, 278 bp, Homo sapiens
  chr3:238258-238536
  hyper
gcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccg

SEQ ID NO: 17952 - DNA, 15 bp, Homo sapiens
  chr3:239094-239109
  hyper
cgctgctctctgagg

SEQ ID NO: 17953 - DNA, 275 bp, Homo sapiens
  chr3:239347-239622
  hyper
ggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttgggg

SEQ ID NO: 17954 - DNA, 29 bp, Homo sapiens
  chr3:240223-240252
  hyper
ctttctcaataatacggagattatcgata

SEQ ID NO: 17955 - DNA, 32 bp, Homo sapiens; identical to SEQ ID NO: 6753
  chr3:2139944-2139976
  hyper

SEQ ID NO: 17956 - DNA, 37 bp, Homo sapiens
  chr3:2140398-2140435
  hyper
cgttcccacccgcccgcgcctctccccttccccgagc

SEQ ID NO: 17957 - DNA, 36 bp, Homo sapiens; identical to SEQ ID NO: 6755
  chr3:2140827-2140863
  hyper

SEQ ID NO: 17958 - DNA, 69 bp, Homo sapiens; identical to SEQ ID NO: 6757
  chr3:3840887-3840956
  hyper

SEQ ID NO: 17959 - DNA, 148 bp, Homo sapiens; identical to SEQ ID NO: 6758
  chr3:3841494-3841642
  hyper

SEQ ID NO: 17960 - DNA, 422 bp, Homo sapiens; identical to SEQ ID NO: 6759
  chr3:3842186-3842608
  hyper

SEQ ID NO: 17961 - DNA, 196 bp, Homo sapiens; identical to SEQ ID NO: 6760
  chr3:4910354-4910550
  hyper

SEQ ID NO: 17962 - DNA, 30 bp, Homo sapiens; identical to SEQ ID NO: 6761
  chr3:5019001-5019031
  hyper

SEQ ID NO: 17963 - DNA, 23 bp, Homo sapiens
  chr3:5137937-5137960
  hyper
gggtggggggtggtgcggggagt

SEQ ID NO: 17964 - DNA, 246 bp, Homo sapiens
  chr3:6902353-6902599
  hyper
ggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctcccc

SEQ ID NO: 17965 - DNA, 15 bp, Homo sapiens
  chr3:6903084-6903099
  hyper
ctgaggaagctgctc

SEQ ID NO: 17966 - DNA, 47 bp, Homo sapiens; identical to SEQ ID NO: 6765
  chr3:6904160-6904207
  hyper

SEQ ID NO: 17967 - DNA, 306 bp, Homo sapiens; identical to SEQ ID NO: 6766
  chr3:8809409-8809715
  hyper

SEQ ID NO: 17968 - DNA, 30 bp, Homo sapiens; identical to SEQ ID NO: 6767
  chr3:8810241-8810271
  hyper

SEQ ID NO: 17969 - DNA, 68 bp, Homo sapiens; identical to SEQ ID NO: 6768
  chr3:8811111-8811179
  hyper

SEQ ID NO: 17970 - DNA, 258 bp, Homo sapiens; identical to SEQ ID NO: 6769
  chr3:9541746-9542004
  hyper

SEQ ID NO: 17971 - DNA, 21 bp, Homo sapiens
  chr3:9594015-9594036
  hyper
gaaaagcgaaaagcaggtgat

SEQ ID NO: 17972 - DNA, 41 bp, Homo sapiens; identical to SEQ ID NO: 6772
  chr3:9745437-9745478
  hyper

SEQ ID NO: 17973 - DNA, 71 bp, Homo sapiens
  chr3:9904554-9904625
  hyper
gccgatggccattaaagccccgccccccgcggctcaccgccgcctggccccgtccccgaggccagaaaaga

SEQ ID NO: 17974 - DNA, 154 bp, Homo sapiens
  chr3:9956910-9957064
  hyper
tcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacct

SEQ ID NO: 17975 - DNA, 309 bp, Homo sapiens
  chr3:9957142-9957451
  hyper
gggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccg

SEQ ID NO: 17976 - DNA, 35 bp, Homo sapiens; identical to SEQ ID NO: 6775
  chr3:9993993-9994028
  hyper

SEQ ID NO: 17977 - DNA, 55 bp, Homo sapiens; identical to SEQ ID NO: 6776
  chr3:10207053-10207108
  hyper

SEQ ID NO: 17978 - DNA, 112 bp, Homo sapiens; identical to SEQ ID NO: 6777
  chr3:10749325-10749437
  hyper

SEQ ID NO: 17979 - DNA, 267 bp, Homo sapiens; identical to SEQ ID NO: 6778
  chr3:10749637-10749904
  hyper

SEQ ID NO: 17980 - DNA, 43 bp, Homo sapiens; identical to SEQ ID NO: 6779
  chr3:10857674-10857717
  hyper

SEQ ID NO: 17981 - DNA, 50 bp, Homo sapiens; identical to SEQ ID NO: 6780
  chr3:11034716-11034766
  hyper

SEQ ID NO: 17982 - DNA, 23 bp, Homo sapiens
  chr3:11035330-11035353
  hyper
ttttggtctctgcgtgtactccc

SEQ ID NO: 17983 - DNA, 6 bp, Homo sapiens
  chr3:11035382-11035388
  hyper
cgggca

SEQ ID NO: 17984 - DNA, 144 bp, Homo sapiens; identical to SEQ ID NO: 6783
  chr3:12046209-12046353
  hyper

SEQ ID NO: 17985 - DNA, 28 bp, Homo sapiens
  chr3:12046377-12046405
  hyper
cgccaggaaggccaaggtgctgctggtg

SEQ ID NO: 17986 - DNA, 14 bp, Homo sapiens
  chr3:12917655-12917669
  hyper
gtctggagggaggt

SEQ ID NO: 17987 - DNA, 56 bp, Homo sapiens
  chr3:13323973-13324029
  hyper
tggagcccttttccagggaacccagtccccacccgagatcgagctccggatctggg

SEQ ID NO: 17988 - DNA, 114 bp, Homo sapiens; identical to SEQ ID NO: 2205
  chr3:13324234-13324348
  hyper

SEQ ID NO: 17989 - DNA, 5 bp, Homo sapiens
  chr3:13324433-13324438
  hyper
cctgc

SEQ ID NO: 17990 - DNA, 29 bp, Homo sapiens
  chr3:13324645-13324674
  hyper
gcctcctgctccccgcgccgccgcgctcc

SEQ ID NO: 17991 - DNA, 107 bp, Homo sapiens
  chr3:13324740-13324847
  hyper
gaggagttttgcaaagtgccggccgcggcgcgggaagagggcggggagggcgccgcctgctgggaccgcccctgggtcccgcgcccccgcaccaggcgtcgggggac

SEQ ID NO: 17992 - DNA, 48 bp, Homo sapiens; identical to SEQ ID NO: 291
  chr3:13590973-13591021
  hyper

SEQ ID NO: 17993 - DNA, 57 bp, Homo sapiens; identical to SEQ ID NO: 6793
  chr3:13920328-13920385
  hyper

SEQ ID NO: 17994 - DNA, 58 bp, Homo sapiens; identical to SEQ ID NO: 6794
  chr3:13921080-13921138
  hyper

SEQ ID NO: 17995 - DNA, 131 bp, Homo sapiens; identical to SEQ ID NO: 6795
  chr3:13921475-13921606
  hyper

SEQ ID NO: 17996 - DNA, 278 bp, Homo sapiens; identical to SEQ ID NO: 6796
  chr3:14643752-14644030
  hyper

SEQ ID NO: 17997 - DNA, 18 bp, Homo sapiens
  chr3:14851832-14851850
  hyper
tgagttctcgtccttcga

SEQ ID NO: 17998 - DNA, 30 bp, Homo sapiens
  chr3:14851897-14851927
  hyper
tgcgcagggacgccccggccctcgcctccc

SEQ ID NO: 17999 - DNA, 23 bp, Homo sapiens
  chr3:16554633-16554656
  hyper
agagcctacgacccccaacaggc

SEQ ID NO: 18000 - DNA, 466 bp, Homo sapiens; identical to SEQ ID NO: 6802
  chr3:18485186-18485652
  hyper

SEQ ID NO: 18001 - DNA, 22 bp, Homo sapiens
  chr3:19189419-19189441
  hyper
gcctcacaactaactcgggctg

SEQ ID NO: 18002 - DNA, 25 bp, Homo sapiens
  chr3:19189470-19189495
  hyper
gcaagtgctccggaagggggccgcc

SEQ ID NO: 18003 - DNA, 56 bp, Homo sapiens; identical to SEQ ID NO: 6804
  chr3:19190075-19190131
  hyper

SEQ ID NO: 18004 - DNA, 15 bp, Homo sapiens
  chr3:22413896-22413911
  hyper
ctccgccacctgaac

SEQ ID NO: 18005 - DNA, 104 bp, Homo sapiens
  chr3:22413974-22414078
  hyper
cttttctctccttcctcccaccgagctcttcattctcctgctggcggccgcccggcgccctggccctggcatccgggaggagcagccgccggggctggctgtcc

SEQ ID NO: 18006 - DNA, 75 bp, Homo sapiens; identical to SEQ ID NO: 6807
  chr3:24870769-24870844
  hyper

SEQ ID NO: 18007 - DNA, 32 bp, Homo sapiens; identical to SEQ ID NO: 6808
  chr3:24872010-24872042
  hyper

SEQ ID NO: 18008 - DNA, 45 bp, Homo sapiens; identical to SEQ ID NO: 2211
  chr3:26665077-26665122
  hyper

SEQ ID NO: 18009 - DNA, 63 bp, Homo sapiens; identical to SEQ ID NO: 6810
  chr3:26665569-26665632
  hyper

SEQ ID NO: 18010 - DNA, 47 bp, Homo sapiens; identical to SEQ ID NO: 6811
  chr3:27754174-27754221
  hyper

SEQ ID NO: 18011 - DNA, 13 bp, Homo sapiens
  chr3:27754465-27754478
  hyper
attcttttcaaga

SEQ ID NO: 18012 - DNA, 24 bp, Homo sapiens
  chr3:27754508-27754532
  hyper
gcttactcccgggctggaccttgg

SEQ ID NO: 18013 - DNA, 114 bp, Homo sapiens; identical to SEQ ID NO: 6813
  chr3:27754814-27754928
  hyper

SEQ ID NO: 18014 - DNA, 66 bp, Homo sapiens; identical to SEQ ID NO: 6814
  chr3:27756087-27756153
  hyper

SEQ ID NO: 18015 - DNA, 679 bp, Homo sapiens
  chr3:27762887-27763566
  hyper
ctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccc

SEQ ID NO: 18016 - DNA, 247 bp, Homo sapiens
  chr3:27763595-27763842
  hyper
ccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattat

SEQ ID NO: 18017 - DNA, 32 bp, Homo sapiens; identical to SEQ ID NO: 6816
  chr3:27764130-27764162
  hyper

SEQ ID NO: 18018 - DNA, 15 bp, Homo sapiens
  chr3:27765347-27765362
  hyper
cgggagcgcattttc

SEQ ID NO: 18019 - DNA, 68 bp, Homo sapiens
  chr3:28616764-28616832
  hyper
ctttacgccaaactccggcgcgccgcgagactcgcgtcctcgctgtccccgaggggccccaccccttc

SEQ ID NO: 18020 - DNA, 45 bp, Homo sapiens; identical to SEQ ID NO: 6822
  chr3:28617899-28617944
  hyper

SEQ ID NO: 18021 - DNA, 40 bp, Homo sapiens; identical to SEQ ID NO: 6823
  chr3:32857752-32857792
  hyper

SEQ ID NO: 18022 - DNA, 33 bp, Homo sapiens; identical to SEQ ID NO: 6824
  chr3:32858114-32858147
  hyper

SEQ ID NO: 18023 - DNA, 375 bp, Homo sapiens
  chr3:32859693-32860068
  hyper
cgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgc

SEQ ID NO: 18024 - DNA, 57 bp, Homo sapiens; identical to SEQ ID NO: 6828
  chr3:33259719-33259776
  hyper

SEQ ID NO: 18025 - DNA, 20 bp, Homo sapiens
  chr3:33260776-33260796
  hyper
gtcctcggcctctacttttc

SEQ ID NO: 18026 - DNA, 131 bp, Homo sapiens; identical to SEQ ID NO: 6830
  chr3:35680984-35681115
  hyper

SEQ ID NO: 18027 - DNA, 59 bp, Homo sapiens; identical to SEQ ID NO: 6831
  chr3:35681483-35681542
  hyper

SEQ ID NO: 18028 - DNA, 149 bp, Homo sapiens; identical to SEQ ID NO: 6832
  chr3:36805921-36806070
  hyper

SEQ ID NO: 18029 - DNA, 24 bp, Homo sapiens
  chr3:38035989-38036013
  hyper
ccgtggaggcggtgccttggctgg

SEQ ID NO: 18030 - DNA, 32 bp, Homo sapiens; identical to SEQ ID NO: 6834
  chr3:38071358-38071390
  hyper

SEQ ID NO: 18031 - DNA, 84 bp, Homo sapiens
  chr3:38080925-38081009
  hyper
gctggcgcagcgtcccgagcctcagctgcttcgtctgcgcccctcctcgctgcgcacccaagatatctcgcacttgctcaccgg

SEQ ID NO: 18032 - DNA, 15 bp, Homo sapiens
  chr3:38081271-38081286
  hyper
attctagtggaagga

SEQ ID NO: 18033 - DNA, 32 bp, Homo sapiens
  chr3:38690668-38690700
  hyper
gaccctccccgagcctgcgccagggatggccg

SEQ ID NO: 18034 - DNA, 66 bp, Homo sapiens; identical to SEQ ID NO: 6838
  chr3:42543514-42543580
  hyper

SEQ ID NO: 18035 - DNA, 123 bp, Homo sapiens
  chr3:42814446-42814569
  hyper
tgcatggaaaataagcgtctgcctgggttagaagagggctgtgtgtgaagattcaaaggacgaaggggaagagtcctcgctgggcgcccagcacgcggtgagcgcccggccagtggcagcgcg

SEQ ID NO: 18036 - DNA, 515 bp, Homo sapiens
  chr3:42814603-42815118
  hyper
gcccccggcagctgcgggctttcccagctccggcccgggcccttccgctctccccggcacttacagcggtctctctccacttctcccttctaggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttgaaaaatgtaaaacagtgtggggaaaggccatgttatgatggtgagtgaaggaagcaggacgcaatatagcaatg

SEQ ID NO: 18037 - DNA, 65 bp, Homo sapiens; identical to SEQ ID NO: 6841
  chr3:43020926-43020991
  hyper

SEQ ID NO: 18038 - DNA, 111 bp, Homo sapiens; identical to SEQ ID NO: 6842
  chr3:43021302-43021413
  hyper

SEQ ID NO: 18039 - DNA, 272 bp, Homo sapiens; identical to SEQ ID NO: 6843
  chr3:43935870-43936142
  hyper

SEQ ID NO: 18040 - DNA, 240 bp, Homo sapiens
  chr3:44036330-44036570
  hyper
ccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcag

SEQ ID NO: 18041 - DNA, 220 bp, Homo sapiens
  chr3:44036600-44036820
  hyper
gatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcga

SEQ ID NO: 18042 - DNA, 422 bp, Homo sapiens
  chr3:44037203-44037625
  hyper
tcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttggg

SEQ ID NO: 18043 - DNA, 212 bp, Homo sapiens
  chr3:44037662-44037874
  hyper
ccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtc

SEQ ID NO: 18044 - DNA, 248 bp, Homo sapiens
  chr3:44038646-44038894
  hyper
tggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagac

SEQ ID NO: 18045 - DNA, 20 bp, Homo sapiens
  chr3:44040006-44040026
  hyper
tgcgagttggattcgcacca

SEQ ID NO: 18046 - DNA, 455 bp, Homo sapiens
  chr3:44040056-44040511
  hyper
cggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggta

SEQ ID NO: 18047 - DNA, 243 bp, Homo sapiens
  chr3:44040553-44040796
  hyper
ccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggtta

SEQ ID NO: 18048 - DNA, 56 bp, Homo sapiens
  chr3:44041039-44041095
  hyper
tgggatgctgtggggacagtgcgggggacgtgtggggtcttcggatgcgaacgcga

SEQ ID NO: 18049 - DNA, 15 bp, Homo sapiens
  chr3:44596464-44596479
  hyper
ggtgtagagctggga

SEQ ID NO: 18050 - DNA, 207 bp, Homo sapiens
  chr3:44596509-44596716
  hyper
agcgggatgtgagtggcctgggccctcgcgagaccccgaccccgcccgcggcaggtggccgggcacagccgagaagtaagccctgccagctctcccgggtgcggggacgcgcgcgcccaccttcgcaaacgagacttccgggatcccggagggggcggaagtcgaggcctctctcgcttccggctcggccattgtttttggtctaac

SEQ ID NO: 18051 - DNA, 210 bp, Homo sapiens
  chr3:44596809-44597019
  hyper
ggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgc

SEQ ID NO: 18052 - DNA, 24 bp, Homo sapiens
  chr3:44726825-44726849
  hyper
atctgcatgcgattaaaaatgggt

SEQ ID NO: 18053 - DNA, 66 bp, Homo sapiens; identical to SEQ ID NO: 6855
  chr3:44771010-44771076
  hyper

SEQ ID NO: 18054 - DNA, 118 bp, Homo sapiens; identical to SEQ ID NO: 6856
  chr3:45837583-45837701
  hyper

SEQ ID NO: 18055 - DNA, 265 bp, Homo sapiens; identical to SEQ ID NO: 6857
  chr3:45837907-45838172
  hyper

SEQ ID NO: 18056 - DNA, 12 bp, Homo sapiens
  chr3:48693292-48693304
  hyper
ggtgggaggggg

SEQ ID NO: 18057 - DNA, 30 bp, Homo sapiens; identical to SEQ ID NO: 6863
  chr3:48699943-48699973
  hyper

SEQ ID NO: 18058 - DNA, 30 bp, Homo sapiens; identical to SEQ ID NO: 6864
  chr3:48700359-48700389
  hyper

SEQ ID NO: 18059 - DNA, 41 bp, Homo sapiens; identical to SEQ ID NO: 6865
  chr3:49851326-49851367
  hyper

SEQ ID NO: 18060 - DNA, 78 bp, Homo sapiens; identical to SEQ ID NO: 6866
  chr3:49907209-49907287
  hyper

SEQ ID NO: 18061 - DNA, 33 bp, Homo sapiens
  chr3:50243350-50243383
  hyper
tgctggtcccagagccggtgccatttgcagagg

SEQ ID NO: 18062 - DNA, 40 bp, Homo sapiens
  chr3:50243480-50243520
  hyper
aagttagagcccgcgcagcgcacggcggagagaaggaacc

SEQ ID NO: 18063 - DNA, 269 bp, Homo sapiens; identical to SEQ ID NO: 6870
  chr3:54155224-54155493
  hyper

SEQ ID NO: 18064 - DNA, 23 bp, Homo sapiens
  chr3:54155524-54155547
  hyper
cgagaaggcgcctcctccggcgc

SEQ ID NO: 18065 - DNA, 110 bp, Homo sapiens; identical to SEQ ID NO: 6872
  chr3:54155775-54155885
  hyper

SEQ ID NO: 18066 - DNA, 77 bp, Homo sapiens; identical to SEQ ID NO: 6873
  chr3:54156663-54156740
  hyper

SEQ ID NO: 18067 - DNA, 40 bp, Homo sapiens; identical to SEQ ID NO: 6874
  chr3:54157034-54157074
  hyper

SEQ ID NO: 18068 - DNA, 66 bp, Homo sapiens
  chr3:54157315-54157381
  hyper
gcattcttaactccgcgacccccctcgggccccctcccgcgctgcgctttgcagttttggtgctgg

SEQ ID NO: 18069 - DNA, 223 bp, Homo sapiens
  chr3:54157450-54157673
  hyper
gccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatgg

SEQ ID NO: 18070 - DNA, 146 bp, Homo sapiens; identical to SEQ ID NO: 6876
  chr3:55521121-55521267
  hyper

SEQ ID NO: 18071 - DNA, 114 bp, Homo sapiens; identical to SEQ ID NO: 6877
  chr3:55522622-55522736
  hyper

SEQ ID NO: 18072 - DNA, 97 bp, Homo sapiens
  chr3:55523009-55523106
  hyper
ttgctcatctggctccggcccagagcatgaggcgcgatgcgtggtcctgccacggagatcttggcgggtgccctcaggtgaggagattgcgaagttt

SEQ ID NO: 18073 - DNA, 50 bp, Homo sapiens; identical to SEQ ID NO: 6879
  chr3:56502716-56502766
  hyper

SEQ ID NO: 18074 - DNA, 30 bp, Homo sapiens; identical to SEQ ID NO: 6880
  chr3:62305019-62305049
  hyper

SEQ ID NO: 18075 - DNA, 25 bp, Homo sapiens
  chr3:62354914-62354939
  hyper
ttaggtctcccggagaaggggacgc

SEQ ID NO: 18076 - DNA, 129 bp, Homo sapiens
  chr3:62357495-62357624
  hyper
ccaatactgtgtggccgctgacaagggcatccccattttacagaataggaaactgaggcccaacgaggctcccagtttgggtagtcaactactggggagctcctcagcttgaaaaaggggcattccagg

SEQ ID NO: 18077 - DNA, 4 bp, Homo sapiens
  chr3:62357667-62357671
  hyper
ccct

SEQ ID NO: 18078 - DNA, 15 bp, Homo sapiens
  chr3:62357735-62357750
  hyper
cggagcctcctggca

SEQ ID NO: 18079 - DNA, 194 bp, Homo sapiens
  chr3:62358336-62358530
  hyper
cggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaag

SEQ ID NO: 18080 - DNA, 409 bp, Homo sapiens
  chr3:62359893-62360302
  hyper
aagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagaca

SEQ ID NO: 18081 - DNA, 51 bp, Homo sapiens
  chr3:62362851-62362902
  hyper
gcctcagcctagagccggacgctttggcttcttcgccatctggccctaggt

SEQ ID NO: 18082 - DNA, 30 bp, Homo sapiens
  chr3:62363596-62363626
  hyper
caatacataacacagcgccctatgtatgcc

SEQ ID NO: 18083 - DNA, 213 bp, Homo sapiens
  chr3:62363693-62363906
  hyper
acgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatc

SEQ ID NO: 18084 - DNA, 54 bp, Homo sapiens; identical to SEQ ID NO: 6897
  chr3:62861840-62861894
  hyper

SEQ ID NO: 18085 - DNA, 200 bp, Homo sapiens; identical to SEQ ID NO: 6898
  chr3:63264640-63264840
  hyper

SEQ ID NO: 18086 - DNA, 30 bp, Homo sapiens; identical to SEQ ID NO: 6899
  chr3:64672193-64672223
  hyper

SEQ ID NO: 18087 - DNA, 35 bp, Homo sapiens
  chr3:68057145-68057180
  hyper
tgctggagctcgggccgccccgggagaaggggtgg

SEQ ID NO: 18088 - DNA, 15 bp, Homo sapiens
  chr3:68980916-68980931
  hyper
gggtgggggtggggg

SEQ ID NO: 18089 - DNA, 105 bp, Homo sapiens
  chr3:68981113-68981218
  hyper
acatgaaccccgaaactggaagcggccgctgcctctctccagccacacatccttacttcggagtgccccttccaacttcgggttgcacgccgacctcagcacagg

SEQ ID NO: 18090 - DNA, 398 bp, Homo sapiens; identical to SEQ ID NO: 6903
  chr3:69435163-69435561
  hyper

SEQ ID NO: 18091 - DNA, 37 bp, Homo sapiens; identical to SEQ ID NO: 6904
  chr3:69435621-69435658
  hyper

SEQ ID NO: 18092 - DNA, 30 bp, Homo sapiens; identical to SEQ ID NO: 6905
  chr3:69590888-69590918
  hyper

SEQ ID NO: 18093 - DNA, 70 bp, Homo sapiens; identical to SEQ ID NO: 6908
  chr3:71179297-71179367
  hyper

SEQ ID NO: 18094 - DNA, 268 bp, Homo sapiens
  chr3:71802858-71803126
  hyper
agagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctc

SEQ ID NO: 18095 - DNA, 119 bp, Homo sapiens; identical to SEQ ID NO: 6911
  chr3:71803826-71803945
  hyper

SEQ ID NO: 18096 - DNA, 469 bp, Homo sapiens; identical to SEQ ID NO: 6912
  chr3:71834256-71834725
  hyper

SEQ ID NO: 18097 - DNA, 15 bp, Homo sapiens
  chr3:75955872-75955887
  hyper
cgctgcgccaccacc

SEQ ID NO: 18098 - DNA, 32 bp, Homo sapiens; identical to SEQ ID NO: 6915
  chr3:77089150-77089182
  hyper

SEQ ID NO: 18099 - DNA, 325 bp, Homo sapiens
  chr3:79815557-79815882
  hyper
atgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaac

SEQ ID NO: 18100 - DNA, 103 bp, Homo sapiens; identical to SEQ ID NO: 6918
  chr3:85007801-85007904
  hyper

SEQ ID NO: 18101 - DNA, 7 bp, Homo sapiens
  chr3:85008708-85008715
  hyper
agcatct

SEQ ID NO: 18102 - DNA, 30 bp, Homo sapiens; identical to SEQ ID NO: 6920
  chr3:85009273-85009303
  hyper

SEQ ID NO: 18103 - DNA, 30 bp, Homo sapiens; identical to SEQ ID NO: 6921
  chr3:85009835-85009865
  hyper

SEQ ID NO: 18104 - DNA, 30 bp, Homo sapiens; identical to SEQ ID NO: 6922
  chr3:87040188-87040218
  hyper

SEQ ID NO: 18105 - DNA, 30 bp, Homo sapiens; identical to SEQ ID NO: 6923
  chr3:87841652-87841682
  hyper

SEQ ID NO: 18106 - DNA, 36 bp, Homo sapiens; identical to SEQ ID NO: 6924
  chr3:87842210-87842246
  hyper

SEQ ID NO: 18107 - DNA, 13 bp, Homo sapiens
  chr3:87842247-87842260
  hyper
gagatagtggtca

SEQ ID NO: 18108 - DNA, 75 bp, Homo sapiens; identical to SEQ ID NO: 6926
  chr3:96532177-96532252
  hyper

SEQ ID NO: 18109 - DNA, 65 bp, Homo sapiens
  chr3:96532873-96532938
  hyper
ctcaccccctccagcggtggaaatgtggagaagtaagtgggaggcggtgtcgggaactgactcct

SEQ ID NO: 18110 - DNA, 141 bp, Homo sapiens
  chr3:96533242-96533383
  hyper
ccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaa

SEQ ID NO: 18111 - DNA, 8 bp, Homo sapiens
  chr3:96533458-96533466
  hyper
ctgtggtg

SEQ ID NO: 18112 - DNA, 205 bp, Homo sapiens; identical to SEQ ID NO: 6929
  chr3:98452166-98452371
  hyper

SEQ ID NO: 18113 - DNA, 51 bp, Homo sapiens; identical to SEQ ID NO: 6930
  chr3:98620538-98620589
  hyper

SEQ ID NO: 18114 - DNA, 54 bp, Homo sapiens
  chr3:99595105-99595159
  hyper
gggcgccggtgaccgcgggaccctcggccgcggcggcggcgcagccacacaccc

SEQ ID NO: 18115 - DNA, 30 bp, Homo sapiens; identical to SEQ ID NO: 6932
  chr3:110789665-110789695
  hyper

SEQ ID NO: 18116 - DNA, 15 bp, Homo sapiens
  chr3:112930422-112930437
  hyper
tccatatggagggac

SEQ ID NO: 18117 - DNA, 30 bp, Homo sapiens; identical to SEQ ID NO: 6934
  chr3:112931110-112931140
  hyper

SEQ ID NO: 18118 - DNA, 30 bp, Homo sapiens; identical to SEQ ID NO: 6935
  chr3:115231640-115231670
  hyper

SEQ ID NO: 18119 - DNA, 142 bp, Homo sapiens; identical to SEQ ID NO: 6936
  chr3:116163769-116163911
  hyper

SEQ ID NO: 18120 - DNA, 208 bp, Homo sapiens
  chr3:117716473-117716681
  hyper
aagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttgg

SEQ ID NO: 18121 - DNA, 48 bp, Homo sapiens; identical to SEQ ID NO: 6941
  chr3:120003868-120003916
  hyper

SEQ ID NO: 18122 - DNA, 4 bp, Homo sapiens
  chr3:120169835-120169839
  hyper
gagg

SEQ ID NO: 18123 - DNA, 53 bp, Homo sapiens; identical to SEQ ID NO: 6943
  chr3:120170117-120170170
  hyper

SEQ ID NO: 18124 - DNA, 65 bp, Homo sapiens
  chr3:120627453-120627518
  hyper
cgcctcagcgctgggcctgggggagggacagcgggagcggcggctctgcgcgcccagcaggctga

SEQ ID NO: 18125 - DNA, 39 bp, Homo sapiens; identical to SEQ ID NO: 2248
  chr3:120627972-120628011
  hyper

SEQ ID NO: 18126 - DNA, 173 bp, Homo sapiens; identical to SEQ ID NO: 308
  chr3:121902777-121902950
  hyper

SEQ ID NO: 18127 - DNA, 29 bp, Homo sapiens
  chr3:121903619-121903648
  hyper
aatgaacgggagcgcgcaccaaaacgcct

SEQ ID NO: 18128 - DNA, 45 bp, Homo sapiens; identical to SEQ ID NO: 6949
  chr3:122296693-122296738
  hyper

SEQ ID NO: 18129 - DNA, 28 bp, Homo sapiens
  chr3:123166978-123167006
  hyper
gccgccgccgccgcccgcagggggcgcc

SEQ ID NO: 18130 - DNA, 201 bp, Homo sapiens
  chr3:123167529-123167730
  hyper
cggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgaggg

SEQ ID NO: 18131 - DNA, 102 bp, Homo sapiens; identical to SEQ ID NO: 6952
  chr3:123602641-123602743
  hyper

SEQ ID NO: 18132 - DNA, 240 bp, Homo sapiens; identical to SEQ ID NO: 6953
  chr3:123603253-123603493
  hyper

SEQ ID NO: 18133 - DNA, 134 bp, Homo sapiens; identical to SEQ ID NO: 6956
  chr3:125986552-125986686
  hyper

SEQ ID NO: 18134 - DNA, 30 bp, Homo sapiens; identical to SEQ ID NO: 6957
  chr3:126113880-126113910
  hyper

SEQ ID NO: 18135 - DNA, 72 bp, Homo sapiens
  chr3:127794474-127794546
  hyper
tgtgacttggaatctcggatccctgggctaggcctggccacgcccccatggggggaggggcagcgcggcggg

SEQ ID NO: 18136 - DNA, 30 bp, Homo sapiens
  chr3:128202417-128202447
  hyper
cagaggacaggagtccggcccgtggacact

SEQ ID NO: 18137 - DNA, 222 bp, Homo sapiens; identical to SEQ ID NO: 6961
  chr3:128205402-128205624
  hyper

SEQ ID NO: 18138 - DNA, 67 bp, Homo sapiens; identical to SEQ ID NO: 6962
  chr3:128208538-128208605
  hyper

SEQ ID NO: 18139 - DNA, 161 bp, Homo sapiens
  chr3:128273832-128273993
  hyper
cctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggag

SEQ ID NO: 18140 - DNA, 44 bp, Homo sapiens
  chr3:128274611-128274655
  hyper
tggcagcgctgctagagccatcggacctgtgaggggggggcgcc

SEQ ID NO: 18141 - DNA, 206 bp, Homo sapiens
  chr3:128417231-128417437
  hyper
caggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacc

SEQ ID NO: 18142 - DNA, 39 bp, Homo sapiens
  chr3:128720830-128720869
  hyper
cggggactcagataccgatgaagaggcgcgcctggcgct

SEQ ID NO: 18143 - DNA, 86 bp, Homo sapiens
  chr3:128721229-128721315
  hyper
ctggctgcggagcccgacaggacagagtcagaggaaggggagacagagggcagccccacaccatcccactccgcatcagcacactt

SEQ ID NO: 18144 - DNA, 126 bp, Homo sapiens
  chr3:130064484-130064610
  hyper
aaagccagcaaacagctggagcgtctctggacactcacattaaaacttgtgaagagttaaaagccccagggaagagccaggccaagggcacgggtcagcgccggcttaaaagaccctctcagggca

SEQ ID NO: 18145 - DNA, 37 bp, Homo sapiens; identical to SEQ ID NO: 6977
  chr3:130235542-130235579
  hyper

SEQ ID NO: 18146 - DNA, 93 bp, Homo sapiens; identical to SEQ ID NO: 2266
  chr3:130235834-130235927
  hyper

SEQ ID NO: 18147 - DNA, 83 bp, Homo sapiens
  chr3:132757104-132757187
  hyper
gcgaccggattggctgtcgcggacgctgacggacaaggccggggcgggccagagcctggtcggaggggcgcgcgcgggggccc

SEQ ID NO: 18148 - DNA, 95 bp, Homo sapiens; identical to SEQ ID NO: 6981
  chr3:132757780-132757875
  hyper

SEQ ID NO: 18149 - DNA, 81 bp, Homo sapiens; identical to SEQ ID NO: 6982
  chr3:133646291-133646372
  hyper

SEQ ID NO: 18150 - DNA, 63 bp, Homo sapiens; identical to SEQ ID NO: 6983
  chr3:134125472-134125535
  hyper

SEQ ID NO: 18151 - DNA, 53 bp, Homo sapiens; identical to SEQ ID NO: 6984
  chr3:134370030-134370083
  hyper

SEQ ID NO: 18152 - DNA, 298 bp, Homo sapiens; identical to SEQ ID NO: 6985
  chr3:134514320-134514618
  hyper

SEQ ID NO: 18153 - DNA, 151 bp, Homo sapiens; identical to SEQ ID NO: 6986
  chr3:134515381-134515532
  hyper

SEQ ID NO: 18154 - DNA, 82 bp, Homo sapiens
  chr3:134516222-134516304
  hyper
gggtgagcgcatttgcaagggcaattccagactggacttgcagcattggggtggcgtcatgcaggtccgaggctcggtccgg

SEQ ID NO: 18155 - DNA, 11 bp, Homo sapiens
  chr3:136537631-136537642
  hyper
gaaggaataga

SEQ ID NO: 18156 - DNA, 30 bp, Homo sapiens; identical to SEQ ID NO: 6991
  chr3:137479200-137479230
  hyper

SEQ ID NO: 18157 - DNA, 79 bp, Homo sapiens
  chr3:137479522-137479601
  hyper
ggccggagggtggggcggagccttgtggcaaggcaggtgggtgcaggcctctggggccccagactgccgcgtctggctc

SEQ ID NO: 18158 - DNA, 37 bp, Homo sapiens
  chr3:137479943-137479980
  hyper
tacgcgcaggagctgcgtgaaaggagaggcccagagc

SEQ ID NO: 18159 - DNA, 157 bp, Homo sapiens
  chr3:137484531-137484688
  hyper
gacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 18160 - DNA, 54 bp, Homo sapiens; identical to SEQ ID NO: 6997
  chr3:137485531-137485585
  hyper

SEQ ID NO: 18161 - DNA, 92 bp, Homo sapiens
  chr3:137485937-137486029
  hyper
cttttctttcccctccgggtgaatgttttcttgaagattattgtctttcctgagaaaggaccctccgatgttatccagcaaaactctttgga

SEQ ID NO: 18162 - DNA, 16 bp, Homo sapiens
  chr3:137487065-137487081
  hyper
gaggggcaaaggcctc

SEQ ID NO: 18163 - DNA, 17 bp, Homo sapiens
  chr3:137487082-137487099
  hyper
gacggtggctgaagctg

SEQ ID NO: 18164 - DNA, 75 bp, Homo sapiens; identical to SEQ ID NO: 7002
  chr3:137488337-137488412
  hyper

SEQ ID NO: 18165 - DNA, 143 bp, Homo sapiens
  chr3:137488807-137488950
  hyper
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggc

SEQ ID NO: 18166 - DNA, 167 bp, Homo sapiens; identical to SEQ ID NO: 7006
  chr3:138154014-138154181
  hyper

SEQ ID NO: 18167 - DNA, 47 bp, Homo sapiens
  chr3:138662087-138662134
  hyper
ccctgaggttcctaccgcctgaccactggagggctgaagtgagaggc

SEQ ID NO: 18168 - DNA, 16 bp, Homo sapiens
  chr3:138662164-138662180
  hyper
ctcctggcccaccagc

SEQ ID NO: 18169 - DNA, 86 bp, Homo sapiens
  chr3:138662296-138662382
  hyper
atctatcctatcagaagtcggaagtcatctatcccatcagaagagtgaaagccgaccaccccctaatccgcctgggagaaccagac

SEQ ID NO: 18170 - DNA, 18 bp, Homo sapiens
  chr3:138664165-138664183
  hyper
gcgcgcagagaggcagct

SEQ ID NO: 18171 - DNA, 5 bp, Homo sapiens
  chr3:138665557-138665562
  hyper
ccatc

SEQ ID NO: 18172 - DNA, 105 bp, Homo sapiens; identical to SEQ ID NO: 321
  chr3:138679188-138679293
  hyper

SEQ ID NO: 18173 - DNA, 55 bp, Homo sapiens
  chr3:139258212-139258267
  hyper
gaggcaggcaggcagcgtctcgggagggctctagggagcggcccggagctgctcg

SEQ ID NO: 18174 - DNA, 308 bp, Homo sapiens; identical to SEQ ID NO: 7019
  chr3:139396463-139396771
  hyper

SEQ ID NO: 18175 - DNA, 179 bp, Homo sapiens
  chr3:139653693-139653872
  hyper
ccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagac

SEQ ID NO: 18176 - DNA, 682 bp, Homo sapiens; identical to SEQ ID NO: 324
  chr3:139653873-139654555
  hyper

SEQ ID NO: 18177 - DNA, 273 bp, Homo sapiens; identical to SEQ ID NO: 7023
  chr3:139654788-139655061
  hyper

SEQ ID NO: 18178 - DNA, 203 bp, Homo sapiens
  chr3:140769705-140769908
  hyper
ctttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatga

SEQ ID NO: 18179 - DNA, 211 bp, Homo sapiens
  chr3:140770829-140771040
  hyper
ttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatca

SEQ ID NO: 18180 - DNA, 48 bp, Homo sapiens; identical to SEQ ID NO: 7028
  chr3:140771752-140771800
  hyper

SEQ ID NO: 18181 - DNA, 93 bp, Homo sapiens; identical to SEQ ID NO: 7029
  chr3:141516089-141516182
  hyper

SEQ ID NO: 18182 - DNA, 25 bp, Homo sapiens
  chr3:141516719-141516744
  hyper
gaaggacctgcgcacactcatactt

SEQ ID NO: 18183 - DNA, 192 bp, Homo sapiens; identical to SEQ ID NO: 7031
  chr3:142443659-142443851
  hyper

SEQ ID NO: 18184 - DNA, 41 bp, Homo sapiens; identical to SEQ ID NO: 7032
  chr3:142607792-142607833
  hyper

SEQ ID NO: 18185 - DNA, 60 bp, Homo sapiens; identical to SEQ ID NO: 7033
  chr3:142681935-142681995
  hyper

SEQ ID NO: 18186 - DNA, 224 bp, Homo sapiens
  chr3:142682049-142682273
  hyper
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgt

SEQ ID NO: 18187 - DNA, 658 bp, Homo sapiens
  chr3:142682392-142683050
  hyper
gagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctc

SEQ ID NO: 18188 - DNA, 34 bp, Homo sapiens; identical to SEQ ID NO: 7035
  chr3:142683110-142683144
  hyper

SEQ ID NO: 18189 - DNA, 142 bp, Homo sapiens
  chr3:142838479-142838621
  hyper
cgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggct

SEQ ID NO: 18190 - DNA, 86 bp, Homo sapiens; identical to SEQ ID NO: 2296
  chr3:142839440-142839526
  hyper

SEQ ID NO: 18191 - DNA, 18 bp, Homo sapiens
  chr3:142840236-142840254
  hyper
ctacgagccagtgtggca

SEQ ID NO: 18192 - DNA, 33 bp, Homo sapiens; identical to SEQ ID NO: 7046
  chr3:145878520-145878553
  hyper

SEQ ID NO: 18193 - DNA, 30 bp, Homo sapiens; identical to SEQ ID NO: 7047
  chr3:147072640-147072670
  hyper

SEQ ID NO: 18194 - DNA, 167 bp, Homo sapiens
  chr3:147087395-147087562
  hyper
tcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaacccc

SEQ ID NO: 18195 - DNA, 36 bp, Homo sapiens; identical to SEQ ID NO: 7053
  chr3:147090647-147090683
  hyper

SEQ ID NO: 18196 - DNA, 49 bp, Homo sapiens; identical to SEQ ID NO: 7054
  chr3:147096028-147096077
  hyper

SEQ ID NO: 18197 - DNA, 10 bp, Homo sapiens
  chr3:147098421-147098431
  hyper
ttcagactgc

SEQ ID NO: 18198 - DNA, 15 bp, Homo sapiens
  chr3:147105883-147105898
  hyper
taaacgtgggcaagt

SEQ ID NO: 18199 - DNA, 35 bp, Homo sapiens
  chr3:147108806-147108841
  hyper
ggcagacggtgtagccgaatcgtagccagagctgg

SEQ ID NO: 18200 - DNA, 42 bp, Homo sapiens
  chr3:147110683-147110725
  hyper
attttataaaacagtgatagaaagatgcggaataaatcagtg

SEQ ID NO: 18201 - DNA, 45 bp, Homo sapiens
  chr3:147111089-147111134
  hyper
ggccaggtgaggccgcgccccagcttgctccggagctgcaggagg

SEQ ID NO: 18202 - DNA, 122 bp, Homo sapiens; identical to SEQ ID NO: 7061
  chr3:147111988-147112110
  hyper

SEQ ID NO: 18203 - DNA, 39 bp, Homo sapiens; identical to SEQ ID NO: 7062
  chr3:147114179-147114218
  hyper

SEQ ID NO: 18204 - DNA, 45 bp, Homo sapiens
  chr3:147126992-147127037
  hyper
cgggccaatgagctgcgcgcggcgcctcggcgcgccctccgttgg

SEQ ID NO: 18205 - DNA, 10 bp, Homo sapiens
  chr3:147127902-147127912
  hyper
ctcctggacg

SEQ ID NO: 18206 - DNA, 31 bp, Homo sapiens
  chr3:147136900-147136931
  hyper
caccgaaggctgggtcgtcagcgtttgaggg

SEQ ID NO: 18207 - DNA, 143 bp, Homo sapiens
  chr3:147138856-147138999
  hyper
gccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgc

SEQ ID NO: 18208 - DNA, 30 bp, Homo sapiens; identical to SEQ ID NO: 7068
  chr3:147139541-147139571
  hyper

SEQ ID NO: 18209 - DNA, 87 bp, Homo sapiens
  chr3:148415340-148415427
  hyper
agaagttctctaattcgtccttaaaagttttccaagttcagaaaaaaaaaatgttgaagaacacgaatctccgcaggaaatgatact

SEQ ID NO: 18210 - DNA, 176 bp, Homo sapiens
  chr3:148415644-148415820
  hyper
agcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtg

SEQ ID NO: 18211 - DNA, 30 bp, Homo sapiens; identical to SEQ ID NO: 7070
  chr3:148416021-148416051
  hyper

SEQ ID NO: 18212 - DNA, 155 bp, Homo sapiens; identical to SEQ ID NO: 7071
  chr3:149375236-149375391
  hyper

SEQ ID NO: 18213 - DNA, 46 bp, Homo sapiens
  chr3:150802935-150802981
  hyper
atcaagatcctggcacgtagcgaaggctccataaatggcagccatc

SEQ ID NO: 18214 - DNA, 518 bp, Homo sapiens
  chr3:150803080-150803598
  hyper
cgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccggg

SEQ ID NO: 18215 - DNA, 64 bp, Homo sapiens; identical to SEQ ID NO: 7074
  chr3:150803966-150804030
  hyper

SEQ ID NO: 18216 - DNA, 161 bp, Homo sapiens; identical to SEQ ID NO: 7075
  chr3:150804735-150804896
  hyper

SEQ ID NO: 18217 - DNA, 31 bp, Homo sapiens
  chr3:150804936-150804967
  hyper
cgggggccaggctgggggtgctgggcgaccc

SEQ ID NO: 18218 - DNA, 4 bp, Homo sapiens
  chr3:150805030-150805034
  hyper
tgcc

SEQ ID NO: 18219 - DNA, 68 bp, Homo sapiens
  chr3:152553275-152553343
  hyper
cggcggttccctgcgcgccctgttgtgtaagctcggcgttgccagcggacggagaagttgctggcttg

SEQ ID NO: 18220 - DNA, 102 bp, Homo sapiens
  chr3:152553384-152553486
  hyper
ggcccgcggcgaacgcggggccagagctggcgtgggcgagcccctgcgcgccccctcccgcggggatccagttcgcctgctcccttccgctcgctggctttt

SEQ ID NO: 18221 - DNA, 53 bp, Homo sapiens
  chr3:154146601-154146654
  hyper
gagcatcccccagagcgccgcagactcgggcctggagcatcctctggggacag

SEQ ID NO: 18222 - DNA, 57 bp, Homo sapiens
  chr3:154146908-154146965
  hyper
ccgagagcagcagactggctgcccacacggtcagcaccacgccgagcacctggcccg

SEQ ID NO: 18223 - DNA, 75 bp, Homo sapiens
  chr3:154797703-154797778
  hyper
tcagcccgccactgccacccggccccgtgcgctcattggtcgggatgtgtcggctcagcagcctccaacttctcc

SEQ ID NO: 18224 - DNA, 184 bp, Homo sapiens; identical to SEQ ID NO: 7082
  chr3:154797835-154798019
  hyper

SEQ ID NO: 18225 - DNA, 158 bp, Homo sapiens
  chr3:156009425-156009583
  hyper
acctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaa

SEQ ID NO: 18226 - DNA, 30 bp, Homo sapiens; identical to SEQ ID NO: 7085
  chr3:156009875-156009905
  hyper

SEQ ID NO: 18227 - DNA, 32 bp, Homo sapiens; identical to SEQ ID NO: 7088
  chr3:157261124-157261156
  hyper

SEQ ID NO: 18228 - DNA, 39 bp, Homo sapiens
  chr3:157812157-157812196
  hyper
aggaggcaagggcgccgcgagctccccggatgcactggt

SEQ ID NO: 18229 - DNA, 4 bp, Homo sapiens
  chr3:157813601-157813605
  hyper
gggc

SEQ ID NO: 18230 - DNA, 234 bp, Homo sapiens
  chr3:157823143-157823377
  hyper
gcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccc

SEQ ID NO: 18231 - DNA, 106 bp, Homo sapiens; identical to SEQ ID NO: 7096
  chr3:157823732-157823838
  hyper

SEQ ID NO: 18232 - DNA, 38 bp, Homo sapiens
  chr3:157824871-157824909
  hyper
catccccgcctctccctcacaatcccacccctgccggc

SEQ ID NO: 18233 - DNA, 92 bp, Homo sapiens; identical to SEQ ID NO: 7099
  chr3:158288920-158289012
  hyper

SEQ ID NO: 18234 - DNA, 49 bp, Homo sapiens
  chr3:159944437-159944486
  hyper
ccctctgccttgcctcgtattgtggttcactagtaagtgcctgcttccc

SEQ ID NO: 18235 - DNA, 60 bp, Homo sapiens; identical to SEQ ID NO: 7102
  chr3:160822815-160822875
  hyper

SEQ ID NO: 18236 - DNA, 34 bp, Homo sapiens; identical to SEQ ID NO: 7105
  chr3:164914188-164914222
  hyper

SEQ ID NO: 18237 - DNA, 116 bp, Homo sapiens
  chr3:164915129-164915245
  hyper
taaaactgtagggcacagggagttgggaggggggcatttgcctgagagatgctggataccatttcgcgataaattagatacggacactggaacaattaatacgtgtaataacacgt

SEQ ID NO: 18238 - DNA, 30 bp, Homo sapiens; identical to SEQ ID NO: 7107
  chr3:167097947-167097977
  hyper

SEQ ID NO: 18239 - DNA, 328 bp, Homo sapiens; identical to SEQ ID NO: 7108
  chr3:167968002-167968330
  hyper

SEQ ID NO: 18240 - DNA, 30 bp, Homo sapiens; identical to SEQ ID NO: 7110
  chr3:169530363-169530393
  hyper

SEQ ID NO: 18241 - DNA, 107 bp, Homo sapiens; identical to SEQ ID NO: 7111
  chr3:170136940-170137047
  hyper

SEQ ID NO: 18242 - DNA, 27 bp, Homo sapiens
  chr3:170302590-170302617
  hyper
cagggtgacatcctgcggcccttgggc

SEQ ID NO: 18243 - DNA, 52 bp, Homo sapiens
  chr3:170303035-170303087
  hyper
cctggacaccgctcccgtcacgtcctcttcgccgctcccgggagagtcacca

SEQ ID NO: 18244 - DNA, 30 bp, Homo sapiens; identical to SEQ ID NO: 7116
  chr3:170625828-170625858
  hyper

SEQ ID NO: 18245 - DNA, 53 bp, Homo sapiens; identical to SEQ ID NO: 7123
  chr3:173114201-173114254
  hyper

SEQ ID NO: 18246 - DNA, 87 bp, Homo sapiens; identical to SEQ ID NO: 7124
  chr3:173114500-173114587
  hyper

SEQ ID NO: 18247 - DNA, 120 bp, Homo sapiens; identical to SEQ ID NO: 2321
  chr3:173115047-173115167
  hyper

SEQ ID NO: 18248 - DNA, 39 bp, Homo sapiens; identical to SEQ ID NO: 7126
  chr3:173115655-173115694
  hyper

SEQ ID NO: 18249 - DNA, 210 bp, Homo sapiens; identical to SEQ ID NO: 7127
  chr3:173115965-173116175
  hyper

SEQ ID NO: 18250 - DNA, 65 bp, Homo sapiens
  chr3:173302927-173302992
  hyper
aatataaaaccacctcgcgcatccccggggggatcgctagggagctacctagatcgagctaaaaa

SEQ ID NO: 18251 - DNA, 374 bp, Homo sapiens
  chr3:179169266-179169640
  hyper
ccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 18252 - DNA, 308 bp, Homo sapiens; identical to SEQ ID NO: 7133
  chr3:180397489-180397797
  hyper

SEQ ID NO: 18253 - DNA, 41 bp, Homo sapiens; identical to SEQ ID NO: 7134
  chr3:180398001-180398042
  hyper

SEQ ID NO: 18254 - DNA, 27 bp, Homo sapiens
  chr3:181413421-181413448
  hyper
gacccacccagccgggcccgatccctc

SEQ ID NO: 18255 - DNA, 38 bp, Homo sapiens
  chr3:181413704-181413742
  hyper
cgtcaagtggggtgtcgggtcgttttgttttttctcta

SEQ ID NO: 18256 - DNA, 46 bp, Homo sapiens; identical to SEQ ID NO: 7137
  chr3:181419696-181419742
  hyper

SEQ ID NO: 18257 - DNA, 90 bp, Homo sapiens
  chr3:181419975-181420065
  hyper
gcggctctcgccttccggggctggaacccgactcagatgtgaagcggcactgagccgctgcgcaggttcgtgcccagcgccccctgttgg

SEQ ID NO: 18258 - DNA, 200 bp, Homo sapiens
  chr3:181420116-181420316
  hyper
ctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactc

SEQ ID NO: 18259 - DNA, 84 bp, Homo sapiens
  chr3:181420374-181420458
  hyper
ttttctgtagccgtggagaatcaagcaaagtatacttcctccgttttgtccacatttcaaaaaattaaacggaagatgctgctg

SEQ ID NO: 18260 - DNA, 71 bp, Homo sapiens; identical to SEQ ID NO: 7139
  chr3:181421249-181421320
  hyper

SEQ ID NO: 18261 - DNA, 190 bp, Homo sapiens
  chr3:181422985-181423175
  hyper
attgggatgggtttggaaacccaactccatctgagccaggactggaagaggggcgctgggggcaagcagaagtgggcccctgggaaggccgacttctcaggcatttcttttgaggccggaatagcttttgggagagggttctagatgtcaatgggaggccttgaggatgccagcccgcccaggatgggtg

SEQ ID NO: 18262 - DNA, 38 bp, Homo sapiens
  chr3:181428772-181428810
  hyper
ccagcccccatttgaaagccgcacgaccgaaacccttc

SEQ ID NO: 18263 - DNA, 318 bp, Homo sapiens
  chr3:181430771-181431089
  hyper
ctccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccct

SEQ ID NO: 18264 - DNA, 112 bp, Homo sapiens
  chr3:181437349-181437461
  hyper
atggggctccccaagaaggtgctgtgtggggctcgagttctctctgcccgggctctgctcaaacggtcgcattccctctccctcaggcaccgacccgcgtcagacaagtcta

SEQ ID NO: 18265 - DNA, 70 bp, Homo sapiens
  chr3:181438353-181438423
  hyper
ccagctccatcaccactaccaagccccagtttgggaggctcccgaggcccctggccgccccccagacccc

SEQ ID NO: 18266 - DNA, 30 bp, Homo sapiens; identical to SEQ ID NO: 7147
  chr3:181440785-181440815
  hyper

SEQ ID NO: 18267 - DNA, 183 bp, Homo sapiens
  chr3:181441962-181442145
  hyper
ggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgc

SEQ ID NO: 18268 - DNA, 356 bp, Homo sapiens
  chr3:181445013-181445369
  hyper
actcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctc

SEQ ID NO: 18269 - DNA, 15 bp, Homo sapiens
  chr3:181445710-181445725
  hyper
cgtaacaccatcatc

SEQ ID NO: 18270 - DNA, 152 bp, Homo sapiens; identical to SEQ ID NO: 7158
  chr3:182896884-182897036
  hyper

SEQ ID NO: 18271 - DNA, 30 bp, Homo sapiens; identical to SEQ ID NO: 7159
  chr3:182897285-182897315
  hyper

SEQ ID NO: 18272 - DNA, 41 bp, Homo sapiens
  chr3:183145371-183145412
  hyper
cacccaccctactcccgtcagaagcagctaacggatggtaa

SEQ ID NO: 18273 - DNA, 189 bp, Homo sapiens; identical to SEQ ID NO: 7161
  chr3:183980238-183980427
  hyper

SEQ ID NO: 18274 - DNA, 98 bp, Homo sapiens; identical to SEQ ID NO: 7162
  chr3:184243116-184243214
  hyper

SEQ ID NO: 18275 - DNA, 76 bp, Homo sapiens; identical to SEQ ID NO: 7163
  chr3:184301502-184301578
  hyper

SEQ ID NO: 18276 - DNA, 182 bp, Homo sapiens; identical to SEQ ID NO: 7164
  chr3:184871097-184871279
  hyper

SEQ ID NO: 18277 - DNA, 6 bp, Homo sapiens
  chr3:186078760-186078766
  hyper
cccacg

SEQ ID NO: 18278 - DNA, 104 bp, Homo sapiens; identical to SEQ ID NO: 7167
  chr3:186079667-186079771
  hyper

SEQ ID NO: 18279 - DNA, 26 bp, Homo sapiens
  chr3:186080162-186080188
  hyper
ttccacacatgcacacgcgtgcgcac

SEQ ID NO: 18280 - DNA, 27 bp, Homo sapiens
  chr3:186080218-186080245
  hyper
tgaccccctttggtgcaactagggcgc

SEQ ID NO: 18281 - DNA, 49 bp, Homo sapiens; identical to SEQ ID NO: 7169
  chr3:186080246-186080295
  hyper

SEQ ID NO: 18282 - DNA, 56 bp, Homo sapiens
  chr3:186857096-186857152
  hyper
aggtctgcgtgtcaccgacccgaacccgctccgtcgtcctgacgcccccggcctag

SEQ ID NO: 18283 - DNA, 65 bp, Homo sapiens
  chr3:186857607-186857672
  hyper
ggaaccgccaatgcctccagggggcgctctccctcccatcgagccaccgccgggccattggagac

SEQ ID NO: 18284 - DNA, 59 bp, Homo sapiens
  chr3:187387791-187387850
  hyper
ttttctcaagagcttcgggagctgagggacccagaaaagcaccaaaactctttagaagg

SEQ ID NO: 18285 - DNA, 118 bp, Homo sapiens; identical to SEQ ID NO: 7173
  chr3:187456159-187456277
  hyper

SEQ ID NO: 18286 - DNA, 30 bp, Homo sapiens; identical to SEQ ID NO: 7174
  chr3:187456549-187456579
  hyper

SEQ ID NO: 18287 - DNA, 30 bp, Homo sapiens; identical to SEQ ID NO: 7175
  chr3:189838630-189838660
  hyper

SEQ ID NO: 18288 - DNA, 101 bp, Homo sapiens; identical to SEQ ID NO: 7176
  chr3:190580811-190580912
  hyper

SEQ ID NO: 18289 - DNA, 97 bp, Homo sapiens
  chr3:192126863-192126960
  hyper
gggggagggcgcgagggagggagggagatcctcgagggccaagcacccctcggggagaaaccagcgagaggcgatctgcggggtcccaagagtgggc

SEQ ID NO: 18290 - DNA, 49 bp, Homo sapiens; identical to SEQ ID NO: 346
  chr3:192126961-192127010
  hyper

SEQ ID NO: 18291 - DNA, 40 bp, Homo sapiens
  chr3:192127314-192127354
  hyper
atggggattacccgccggacgcaaggccgatcactcagtc

SEQ ID NO: 18292 - DNA, 20 bp, Homo sapiens
  chr3:192232057-192232077
  hyper
ccctctcctgtggaacgcac

SEQ ID NO: 18293 - DNA, 13 bp, Homo sapiens
  chr3:192232078-192232091
  hyper
agcaacttttcgg

SEQ ID NO: 18294 - DNA, 21 bp, Homo sapiens
  chr3:192232798-192232819
  hyper
ccccttgagaccttccggagg

SEQ ID NO: 18295 - DNA, 67 bp, Homo sapiens
  chr3:192233150-192233217
  hyper
agggggtggggtagggaggcggggacgtggaataaagaaagctcctgggtgccggctatgagaagtc

SEQ ID NO: 18296 - DNA, 13 bp, Homo sapiens
  chr3:193776076-193776089
  hyper
cggttcctctgca

SEQ ID NO: 18297 - DNA, 60 bp, Homo sapiens
  chr3:193776119-193776179
  hyper
cgggaagcgaaagctgcggcgacctcccagagcctctcaggcacgcggcatctctcccca

SEQ ID NO: 18298 - DNA, 5 bp, Homo sapiens
  chr3:194208562-194208567
  hyper
cttct

SEQ ID NO: 18299 - DNA, 37 bp, Homo sapiens
  chr3:194409021-194409058
  hyper
ggctctgttgcgcgtggggatgcggggagatttgaga

SEQ ID NO: 18300 - DNA, 60 bp, Homo sapiens; identical to SEQ ID NO: 7194
  chr3:196366801-196366861
  hyper

SEQ ID NO: 18301 - DNA, 102 bp, Homo sapiens; identical to SEQ ID NO: 7195
  chr3:197840446-197840548
  hyper

SEQ ID NO: 18302 - DNA, 15 bp, Homo sapiens
  chr4:570242-570257
  hyper
ttcctcctcccggag

SEQ ID NO: 18303 - DNA, 203 bp, Homo sapiens; identical to SEQ ID NO: 7201
  chr4:570298-570501
  hyper

SEQ ID NO: 18304 - DNA, 130 bp, Homo sapiens
  chr4:570836-570966
  hyper
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgag

SEQ ID NO: 18305 - DNA, 495 bp, Homo sapiens
  chr4:571013-571508
  hyper
ccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgca

SEQ ID NO: 18306 - DNA, 44 bp, Homo sapiens; identical to SEQ ID NO: 7203
  chr4:788891-788935
  hyper

SEQ ID NO: 18307 - DNA, 102 bp, Homo sapiens; identical to SEQ ID NO: 7204
  chr4:789169-789271
  hyper

SEQ ID NO: 18308 - DNA, 44 bp, Homo sapiens; identical to SEQ ID NO: 7207
  chr4:996495-996539
  hyper

SEQ ID NO: 18309 - DNA, 139 bp, Homo sapiens; identical to SEQ ID NO: 7209
  chr4:1166167-1166306
  hyper

SEQ ID NO: 18310 - DNA, 26 bp, Homo sapiens
  chr4:1398277-1398303
  hyper
gggtagggccctgctcggcctcacca

SEQ ID NO: 18311 - DNA, 72 bp, Homo sapiens; identical to SEQ ID NO: 7212
  chr4:1399065-1399137
  hyper

SEQ ID NO: 18312 - DNA, 92 bp, Homo sapiens; identical to SEQ ID NO: 7213
  chr4:1400248-1400340
  hyper

SEQ ID NO: 18313 - DNA, 372 bp, Homo sapiens; identical to SEQ ID NO: 7214
  chr4:1401106-1401478
  hyper

SEQ ID NO: 18314 - DNA, 28 bp, Homo sapiens
  chr4:1401683-1401711
  hyper
ccccggagcctgttccgcgcgcagggcg

SEQ ID NO: 18315 - DNA, 81 bp, Homo sapiens
  chr4:1401743-1401824
  hyper
tggaagcagaaattaaaagttgggagaaataatggtggaccgatcggctgtaatttgggccaagctcggacacgctgagcc

SEQ ID NO: 18316 - DNA, 30 bp, Homo sapiens; identical to SEQ ID NO: 7216
  chr4:1404132-1404162
  hyper

SEQ ID NO: 18317 - DNA, 99 bp, Homo sapiens; identical to SEQ ID NO: 7217
  chr4:1404368-1404467
  hyper

SEQ ID NO: 18318 - DNA, 68 bp, Homo sapiens; identical to SEQ ID NO: 7218
  chr4:1408020-1408088
  hyper

SEQ ID NO: 18319 - DNA, 42 bp, Homo sapiens; identical to SEQ ID NO: 7219
  chr4:1811789-1811831
  hyper

SEQ ID NO: 18320 - DNA, 14 bp, Homo sapiens
  chr4:2042655-2042669
  hyper
gcagtcccagcttg

SEQ ID NO: 18321 - DNA, 43 bp, Homo sapiens; identical to SEQ ID NO: 7223
  chr4:2060112-2060155
  hyper

SEQ ID NO: 18322 - DNA, 41 bp, Homo sapiens; identical to SEQ ID NO: 7224
  chr4:2060173-2060214
  hyper

SEQ ID NO: 18323 - DNA, 82 bp, Homo sapiens; identical to SEQ ID NO: 7225
  chr4:2062004-2062086
  hyper

SEQ ID NO: 18324 - DNA, 84 bp, Homo sapiens
  chr4:2765778-2765862
  hyper
tggtatgggaccctccgggtgggcgcggccccgcggggccttgcggccacaccgccaccgtgcccagcggccccatcagcgcat

SEQ ID NO: 18325 - DNA, 42 bp, Homo sapiens
  chr4:2765910-2765952
  hyper
tgatgaaagctcgaatcttataggatccgtattcatttcccg

SEQ ID NO: 18326 - DNA, 42 bp, Homo sapiens; identical to SEQ ID NO: 7227
  chr4:2766173-2766215
  hyper

SEQ ID NO: 18327 - DNA, 30 bp, Homo sapiens; identical to SEQ ID NO: 7228
  chr4:3767309-3767339
  hyper

SEQ ID NO: 18328 - DNA, 45 bp, Homo sapiens; identical to SEQ ID NO: 7229
  chr4:3767848-3767893
  hyper

SEQ ID NO: 18329 - DNA, 611 bp, Homo sapiens
  chr4:3873083-3873694
  hyper
actggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccc

SEQ ID NO: 18330 - DNA, 50 bp, Homo sapiens; identical to SEQ ID NO: 7232
  chr4:3882155-3882205
  hyper

SEQ ID NO: 18331 - DNA, 15 bp, Homo sapiens
  chr4:4145386-4145401
  hyper
cgggatgtggggcta

SEQ ID NO: 18332 - DNA, 84 bp, Homo sapiens; identical to SEQ ID NO: 7234
  chr4:4228084-4228168
  hyper

SEQ ID NO: 18333 - DNA, 34 bp, Homo sapiens
  chr4:4228241-4228275
  hyper
tgcgcggagctgcggcccacgtaccacagcatcc

SEQ ID NO: 18334 - DNA, 7 bp, Homo sapiens
  chr4:4229682-4229689
  hyper
ccccttc

SEQ ID NO: 18335 - DNA, 19 bp, Homo sapiens
  chr4:4387627-4387646
  hyper
gccgcggggaagtccccgg

SEQ ID NO: 18336 - DNA, 578 bp, Homo sapiens; identical to SEQ ID NO: 7238
  chr4:4387927-4388505
  hyper

SEQ ID NO: 18337 - DNA, 50 bp, Homo sapiens; identical to SEQ ID NO: 7239
  chr4:4388506-4388556
  hyper

SEQ ID NO: 18338 - DNA, 46 bp, Homo sapiens; identical to SEQ ID NO: 7240
  chr4:4388772-4388818
  hyper

SEQ ID NO: 18339 - DNA, 82 bp, Homo sapiens; identical to SEQ ID NO: 7241
  chr4:4854669-4854751
  hyper

SEQ ID NO: 18340 - DNA, 148 bp, Homo sapiens
  chr4:4854954-4855102
  hyper
agagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactccc

SEQ ID NO: 18341 - DNA, 21 bp, Homo sapiens
  chr4:4855171-4855192
  hyper
gctgcccccgcgaaggtgggg

SEQ ID NO: 18342 - DNA, 44 bp, Homo sapiens; identical to SEQ ID NO: 7243
  chr4:4858727-4858771
  hyper

SEQ ID NO: 18343 - DNA, 259 bp, Homo sapiens; identical to SEQ ID NO: 7244
  chr4:4862186-4862445
  hyper

SEQ ID NO: 18344 - DNA, 107 bp, Homo sapiens
  chr4:4867591-4867698
  hyper
agagcaacataattgcggtaatgagcaacggctcaccctctgcagacgcgtcgcggctccagcgaggcggtagctgcaggcgaggcgggcgcgcctccccgccccct

SEQ ID NO: 18345 - DNA, 30 bp, Homo sapiens; identical to SEQ ID NO: 7247
  chr4:4868050-4868080
  hyper

SEQ ID NO: 18346 - DNA, 11 bp, Homo sapiens
  chr4:4868555-4868566
  hyper
ctcaccggccc

SEQ ID NO: 18347 - DNA, 127 bp, Homo sapiens; identical to SEQ ID NO: 2364
  chr4:4869131-4869258
  hyper

SEQ ID NO: 18348 - DNA, 30 bp, Homo sapiens; identical to SEQ ID NO: 7251
  chr4:4870173-4870203
  hyper

SEQ ID NO: 18349 - DNA, 15 bp, Homo sapiens
  chr4:4872017-4872032
  hyper
gggtgagaaggggag

SEQ ID NO: 18350 - DNA, 29 bp, Homo sapiens
  chr4:4872059-4872088
  hyper
cggagcatagaggcaggatggtgacctga

SEQ ID NO: 18351 - DNA, 140 bp, Homo sapiens
  chr4:5052930-5053070
  hyper
gacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgc

SEQ ID NO: 18352 - DNA, 229 bp, Homo sapiens
  chr4:5053518-5053747
  hyper
ctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacc

SEQ ID NO: 18353 - DNA, 12 bp, Homo sapiens
  chr4:5054093-5054105
  hyper
gcaagggcctgt

SEQ ID NO: 18354 - DNA, 194 bp, Homo sapiens; identical to SEQ ID NO: 7257
  chr4:5889144-5889338
  hyper

SEQ ID NO: 18355 - DNA, 403 bp, Homo sapiens
  chr4:5889545-5889948
  hyper
ggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggcc

SEQ ID NO: 18356 - DNA, 229 bp, Homo sapiens
  chr4:5890045-5890274
  hyper
ggaaccggcgctctcggccccgctcccagcgggcgcgctgacaaaggcccgggagggatagagacacggacggaggctcggcgcccgtggatgcccacgcgcggctgccccggctgctcggcccgcccgccgccgctccggctgccagcaccgcccggatcggcgaggagggcgggagaaggaggagggagaggcgagggcgggaggagggggctgcagacagctcctc

SEQ ID NO: 18357 - DNA, 30 bp, Homo sapiens; identical to SEQ ID NO: 7259
  chr4:5890534-5890564
  hyper

SEQ ID NO: 18358 - DNA, 234 bp, Homo sapiens; identical to SEQ ID NO: 7262
  chr4:5893517-5893751
  hyper

SEQ ID NO: 18359 - DNA, 52 bp, Homo sapiens; identical to SEQ ID NO: 7263
  chr4:5894812-5894864
  hyper

SEQ ID NO: 18360 - DNA, 19 bp, Homo sapiens
  chr4:6200878-6200897
  hyper
aggacagtgtgcctgcgag

SEQ ID NO: 18361 - DNA, 58 bp, Homo sapiens
  chr4:6201235-6201293
  hyper
caccacgagagtcaatccttgcgcgccatctccggaggccagtgcgcccagggcgcgc

SEQ ID NO: 18362 - DNA, 138 bp, Homo sapiens; identical to SEQ ID NO: 7265
  chr4:6201349-6201487
  hyper

SEQ ID NO: 18363 - DNA, 208 bp, Homo sapiens
  chr4:6201895-6202103
  hyper
gccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgcc

SEQ ID NO: 18364 - DNA, 264 bp, Homo sapiens
  chr4:6202276-6202540
  hyper
gcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgc

SEQ ID NO: 18365 - DNA, 336 bp, Homo sapiens
  chr4:6247381-6247717
  hyper
cttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 18366 - DNA, 30 bp, Homo sapiens; identical to SEQ ID NO: 7268
  chr4:6473934-6473964
  hyper

SEQ ID NO: 18367 - DNA, 277 bp, Homo sapiens; identical to SEQ ID NO: 7269
  chr4:6473965-6474242
  hyper

SEQ ID NO: 18368 - DNA, 7 bp, Homo sapiens
  chr4:6565042-6565049
  hyper
ccccggc

SEQ ID NO: 18369 - DNA, 101 bp, Homo sapiens; identical to SEQ ID NO: 7271
  chr4:7194437-7194538
  hyper

SEQ ID NO: 18370 - DNA, 30 bp, Homo sapiens; identical to SEQ ID NO: 7272
  chr4:7195153-7195183
  hyper

SEQ ID NO: 18371 - DNA, 38 bp, Homo sapiens; identical to SEQ ID NO: 7273
  chr4:8271520-8271558
  hyper

SEQ ID NO: 18372 - DNA, 69 bp, Homo sapiens
  chr4:8858758-8858827
  hyper
ctgatcgcgacactgcactccagcctgggcgacacagcggaccatctcaataacaaaccgaaactctgg

SEQ ID NO: 18373 - DNA, 200 bp, Homo sapiens
  chr4:8859738-8859938
  hyper
agcatcagctaagccattagggctaatgcgatgtactgtaagacggggatcaatgccgggcctcggggaccggcgtgggggagggggcagcaggccgaccgcccccaagccggtcgaggcccccgtccatttgggggaaatggattttcgcgatttaagaaacaaacccaaatcaaatgagcgaggcccggatgtgctga

SEQ ID NO: 18374 - DNA, 393 bp, Homo sapiens
  chr4:8862404-8862797
  hyper
ccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcg

SEQ ID NO: 18375 - DNA, 69 bp, Homo sapiens
  chr4:8863372-8863441
  hyper
cgccaggcgccttcccgggcggttggcgaaacccgaggaggcccacagctctggcctggggcgccgtcg

SEQ ID NO: 18376 - DNA, 106 bp, Homo sapiens; identical to SEQ ID NO: 7282
  chr4:8868710-8868816
  hyper

SEQ ID NO: 18377 - DNA, 233 bp, Homo sapiens
  chr4:8869368-8869601
  hyper
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggct

SEQ ID NO: 18378 - DNA, 30 bp, Homo sapiens; identical to SEQ ID NO: 7285
  chr4:8872946-8872976
  hyper

SEQ ID NO: 18379 - DNA, 36 bp, Homo sapiens
  chr4:8873773-8873809
  hyper
gggcgcaggcggggggtcgcgccgggtccgatcccg

SEQ ID NO: 18380 - DNA, 9 bp, Homo sapiens
  chr4:8874476-8874485
  hyper
ctcccatat

SEQ ID NO: 18381 - DNA, 104 bp, Homo sapiens
  chr4:8875773-8875877
  hyper
ggtggtggccctgagcgcataacgctcgcgggtgtcttcccactgcctctggggggcgcgcatgagaggggcgcttccacacactgccgcgtggggcctgggat

SEQ ID NO: 18382 - DNA, 76 bp, Homo sapiens; identical to SEQ ID NO: 7289
  chr4:8878569-8878645
  hyper

SEQ ID NO: 18383 - DNA, 60 bp, Homo sapiens; identical to SEQ ID NO: 7290
  chr4:8879491-8879551
  hyper

SEQ ID NO: 18384 - DNA, 41 bp, Homo sapiens; identical to SEQ ID NO: 7291
  chr4:8893958-8893999
  hyper

SEQ ID NO: 18385 - DNA, 46 bp, Homo sapiens
  chr4:8896052-8896098
  hyper
ggattatctcccctctcccaccaggccccggcggggggcaccaact

SEQ ID NO: 18386 - DNA, 205 bp, Homo sapiens; identical to SEQ ID NO: 2376
  chr4:8896117-8896322
  hyper

SEQ ID NO: 18387 - DNA, 58 bp, Homo sapiens
  chr4:10462775-10462833
  hyper
tgccagtctctgagacgttttctcaactgcaaaacaggagtaactggagcaacctttc

SEQ ID NO: 18388 - DNA, 51 bp, Homo sapiens; identical to SEQ ID NO: 7300
  chr4:11429636-11429687
  hyper

SEQ ID NO: 18389 - DNA, 30 bp, Homo sapiens; identical to SEQ ID NO: 7301
  chr4:13523948-13523978
  hyper

SEQ ID NO: 18390 - DNA, 54 bp, Homo sapiens
  chr4:13537688-13537742
  hyper
cgagcaggggcatggagtgggagggaaagctgaggagagcgggctttgagcctg

SEQ ID NO: 18391 - DNA, 83 bp, Homo sapiens; identical to SEQ ID NO: 357
  chr4:13545940-13546023
  hyper

SEQ ID NO: 18392 - DNA, 86 bp, Homo sapiens; identical to SEQ ID NO: 7305
  chr4:13546466-13546552
  hyper

SEQ ID NO: 18393 - DNA, 67 bp, Homo sapiens
  chr4:13548895-13548962
  hyper
ctggacgcgaccgcgcgggcgtgcctgggtcccgcttcctgcccatcgagggcgacttccttcgggc

SEQ ID NO: 18394 - DNA, 30 bp, Homo sapiens; identical to SEQ ID NO: 7308
  chr4:13549282-13549312
  hyper

SEQ ID NO: 18395 - DNA, 89 bp, Homo sapiens; identical to SEQ ID NO: 7309
  chr4:13549546-13549635
  hyper

SEQ ID NO: 18396 - DNA, 132 bp, Homo sapiens
  chr4:15780320-15780452
  hyper
cccgcgcgcagggaagccgcccggatcgcccggaaccgggcatcttccgtggcgggtcagccgagagcccgccgggtggtgctgagtagggagtcccgggctcggggctccgcgggccgctttcaggagcag

SEQ ID NO: 18397 - DNA, 30 bp, Homo sapiens; identical to SEQ ID NO: 7311
  chr4:16083935-16083965
  hyper

SEQ ID NO: 18398 - DNA, 60 bp, Homo sapiens; identical to SEQ ID NO: 7312
  chr4:16084408-16084468
  hyper

SEQ ID NO: 18399 - DNA, 18 bp, Homo sapiens
  chr4:16085381-16085399
  hyper
acccggcttctgggacca

SEQ ID NO: 18400 - DNA, 18 bp, Homo sapiens
  chr4:16085682-16085700
  hyper
ggacgcactctgattgga

SEQ ID NO: 18401 - DNA, 30 bp, Homo sapiens; identical to SEQ ID NO: 7321
  chr4:20253853-20253883
  hyper

SEQ ID NO: 18402 - DNA, 40 bp, Homo sapiens; identical to SEQ ID NO: 7322
  chr4:20254263-20254303
  hyper

SEQ ID NO: 18403 - DNA, 51 bp, Homo sapiens; identical to SEQ ID NO: 7323
  chr4:20255045-20255096
  hyper

SEQ ID NO: 18404 - DNA, 291 bp, Homo sapiens
  chr4:20255861-20256152
  hyper
agctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggg

SEQ ID NO: 18405 - DNA, 28 bp, Homo sapiens
  chr4:20256841-20256869
  hyper
gctctgacccgcacgtctccacccgcgc

SEQ ID NO: 18406 - DNA, 122 bp, Homo sapiens; identical to SEQ ID NO: 7327
  chr4:30720054-30720176
  hyper

SEQ ID NO: 18407 - DNA, 81 bp, Homo sapiens
  chr4:30724372-30724453
  hyper
tctggtgcaggtgtccgaccgagaccaaggcgagaacggggtggtcacctgcaccgtggtgggcgacgtgcccttccagct

SEQ ID NO: 18408 - DNA, 45 bp, Homo sapiens; identical to SEQ ID NO: 2391
  chr4:37245537-37245582
  hyper

SEQ ID NO: 18409 - DNA, 283 bp, Homo sapiens
  chr4:37245851-37246134
  hyper
ggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggag

SEQ ID NO: 18410 - DNA, 81 bp, Homo sapiens
  chr4:37247015-37247096
  hyper
gctggccggttttgcctgcacacttctattaggacacccattctccaccccgggttattcccctgggtcaatccaagaaac

SEQ ID NO: 18411 - DNA, 37 bp, Homo sapiens; identical to SEQ ID NO: 7333
  chr4:37247355-37247392
  hyper

SEQ ID NO: 18412 - DNA, 80 bp, Homo sapiens; identical to SEQ ID NO: 7334
  chr4:39047287-39047367
  hyper

SEQ ID NO: 18413 - DNA, 290 bp, Homo sapiens
  chr4:41259176-41259466
  hyper
cccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgt

SEQ ID NO: 18414 - DNA, 176 bp, Homo sapiens
  chr4:41746833-41747009
  hyper
tgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatgg

SEQ ID NO: 18415 - DNA, 103 bp, Homo sapiens
  chr4:41747133-41747236
  hyper
ctggaacggcgtccctactcttccctgaagaagagccccaagagaatccgtgctgttaggagggagcggatttaggggttcacaagatcgagccttcagctcc

SEQ ID NO: 18416 - DNA, 70 bp, Homo sapiens
  chr4:41747888-41747958
  hyper
cgctggcgaagggacccccaagcgaatccgggatggaggtgatggggccggggccgggagcccagccttg

SEQ ID NO: 18417 - DNA, 41 bp, Homo sapiens
  chr4:41748296-41748337
  hyper
gctcctgcttgcgaaacttggcgcggcggttctggaaccac

SEQ ID NO: 18418 - DNA, 95 bp, Homo sapiens
  chr4:41750504-41750599
  hyper
gccactggcctggctgcaggaactgaagtcagcataggctgaagccaggctcgaggtgtccatcccagccatacaggactcgtaggcagaggaat

SEQ ID NO: 18419 - DNA, 14 bp, Homo sapiens
  chr4:41752954-41752968
  hyper
gcacaaggctgaga

SEQ ID NO: 18420 - DNA, 212 bp, Homo sapiens
  chr4:41753398-41753610
  hyper
gctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcagg

SEQ ID NO: 18421 - DNA, 32 bp, Homo sapiens; identical to SEQ ID NO: 7347
  chr4:41867804-41867836
  hyper

SEQ ID NO: 18422 - DNA, 20 bp, Homo sapiens
  chr4:41875410-41875430
  hyper
aaccttttttgtaaccggct

SEQ ID NO: 18423 - DNA, 6 bp, Homo sapiens
  chr4:41881425-41881431
  hyper
ttttaa

SEQ ID NO: 18424 - DNA, 156 bp, Homo sapiens
  chr4:41882935-41883091
  hyper
gggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaag

SEQ ID NO: 18425 - DNA, 208 bp, Homo sapiens
  chr4:41883302-41883510
  hyper
tttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgat

SEQ ID NO: 18426 - DNA, 14 bp, Homo sapiens
  chr4:41883610-41883624
  hyper
gctcacccgccccg

SEQ ID NO: 18427 - DNA, 60 bp, Homo sapiens; identical to SEQ ID NO: 7351
  chr4:41883886-41883946
  hyper

SEQ ID NO: 18428 - DNA, 82 bp, Homo sapiens; identical to SEQ ID NO: 7352
  chr4:41884164-41884246
  hyper

SEQ ID NO: 18429 - DNA, 255 bp, Homo sapiens
  chr4:42154025-42154280
  hyper
ggtgggtcgctcgtagcgcttggccagcgccggtctcttgctggggaacgtcttgaggacgctgtaggggctgcgctgcttgtagattttggggacgctgggcccctcctctgccggctgcatctcttcctccatccggcgcctcggggccggtccctcggagcacgtcccctccccgccgggcgccgggctccgagggtgcctccgccgcctgcccgccgggtctgccctggtgcgcgcgtgtgggagggtgtg

SEQ ID NO: 18430 - DNA, 26 bp, Homo sapiens
  chr4:42154359-42154385
  hyper
cgagctcctgattgacaggctgcctc

SEQ ID NO: 18431 - DNA, 276 bp, Homo sapiens
  chr4:42154386-42154662
  hyper
ccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccgg

SEQ ID NO: 18432 - DNA, 38 bp, Homo sapiens
  chr4:42399099-42399137
  hyper
cttcaatgactgcaccgcattcatgcattatatccatt

SEQ ID NO: 18433 - DNA, 254 bp, Homo sapiens
  chr4:42399191-42399445
  hyper
gaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaa

SEQ ID NO: 18434 - DNA, 606 bp, Homo sapiens
  chr4:42399872-42400478
  hyper
cccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcg

SEQ ID NO: 18435 - DNA, 147 bp, Homo sapiens; identical to SEQ ID NO: 7359
  chr4:42400901-42401048
  hyper

SEQ ID NO: 18436 - DNA, 30 bp, Homo sapiens; identical to SEQ ID NO: 7360
  chr4:44449013-44449043
  hyper

SEQ ID NO: 18437 - DNA, 27 bp, Homo sapiens
  chr4:44449652-44449679
  hyper
cgaggagttacacgccaccatgtggaa

SEQ ID NO: 18438 - DNA, 127 bp, Homo sapiens; identical to SEQ ID NO: 2409
  chr4:44450050-44450177
  hyper

SEQ ID NO: 18439 - DNA, 223 bp, Homo sapiens; identical to SEQ ID NO: 2410
  chr4:44450741-44450964
  hyper

SEQ ID NO: 18440 - DNA, 554 bp, Homo sapiens
  chr4:46995835-46996389
  hyper
cgaccccaagtgggctccccgcccacagcagtgttcgtcctcctacctcctggccccctcccttccgctgggatttggatctaaccaatgaagctcctctgtcatcaggttgtgcgaggacctgtttgtacccagagtcaaggttggaggtggagaaagggcgggtgacggggactgctgggcgtcgggtggtagcggtggtgaggagaggggatcaagtccgggctcaaaccacctttgagaccctcccattcaggtgttatggggggcggtagggagagcaatgaaagcagaaagattcttcctggtaacaggggttgcagctcacccggcggactctcgccaaactattgggaagtggactcgagccgcactctagtcccagtatttgctaagctattgctttaaagacaccccatttctttacccgcctccaccagacacgcgcacaccctccgctttgctgctccatccttttctggagaggaggggagaggtggagacaagcgacctctggtcaaaatcactttcacttcttgcgacactcttctttt

SEQ ID NO: 18441 - DNA, 341 bp, Homo sapiens; identical to SEQ ID NO: 7366
  chr4:47034412-47034753
  hyper

SEQ ID NO: 18442 - DNA, 154 bp, Homo sapiens
  chr4:47034754-47034908
  hyper
tggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggc

SEQ ID NO: 18443 - DNA, 114 bp, Homo sapiens; identical to SEQ ID NO: 7370
  chr4:48987949-48988063
  hyper

SEQ ID NO: 18444 - DNA, 30 bp, Homo sapiens; identical to SEQ ID NO: 7371
  chr4:48988465-48988495
  hyper

SEQ ID NO: 18445 - DNA, 88 bp, Homo sapiens; identical to SEQ ID NO: 7372
  chr4:53617427-53617515
  hyper

SEQ ID NO: 18446 - DNA, 30 bp, Homo sapiens; identical to SEQ ID NO: 7373
  chr4:53728192-53728222
  hyper

SEQ ID NO: 18447 - DNA, 78 bp, Homo sapiens; identical to SEQ ID NO: 7375
  chr4:54965843-54965921
  hyper

SEQ ID NO: 18448 - DNA, 333 bp, Homo sapiens
  chr4:54966521-54966854
  hyper
ccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctgggg

SEQ ID NO: 18449 - DNA, 12 bp, Homo sapiens
  chr4:54967330-54967342
  hyper
gggccttaggga

SEQ ID NO: 18450 - DNA, 8 bp, Homo sapiens
  chr4:54967484-54967492
  hyper
ctcaaagg

SEQ ID NO: 18451 - DNA, 274 bp, Homo sapiens
  chr4:54970095-54970369
  hyper
aagattctgtctcccttcttcccaagaagcaggcctctccgcgcgcgagaacagaggtgggaggacgggagtttgcaggcgcaaagaacaggagtttaagcagactatttccaccaggggaaataagaagcacaaagagcgcctgctgcagctctttgcgctcttgcccaaagctaagcttcctctgggctgtggggagactcctctggtccccgttccatctacccagcccggcccctctggggctcagcgcttgggtttagccctcccctat

SEQ ID NO: 18452 - DNA, 33 bp, Homo sapiens
  chr4:54970482-54970515
  hyper
tgccatgccgcagatagccgcagtgccaaccct

SEQ ID NO: 18453 - DNA, 130 bp, Homo sapiens; identical to SEQ ID NO: 369
  chr4:54975802-54975932
  hyper

SEQ ID NO: 18454 - DNA, 15 bp, Homo sapiens
  chr4:55093818-55093833
  hyper
ttttgccttttattc

SEQ ID NO: 18455 - DNA, 123 bp, Homo sapiens; identical to SEQ ID NO: 7383
  chr4:55093888-55094011
  hyper

SEQ ID NO: 18456 - DNA, 63 bp, Homo sapiens; identical to SEQ ID NO: 7384
  chr4:55094012-55094075
  hyper

SEQ ID NO: 18457 - DNA, 72 bp, Homo sapiens; identical to SEQ ID NO: 7386
  chr4:55096538-55096610
  hyper

SEQ ID NO: 18458 - DNA, 37 bp, Homo sapiens
  chr4:55098637-55098674
  hyper
cctactgcagtttctcggcccccgcgaaaggggagcg

SEQ ID NO: 18459 - DNA, 111 bp, Homo sapiens
  chr4:55099062-55099173
  hyper
cttaaatgccgagagggcgcatgctagctctcctcagcattcccggtgagccgctacccacggccgtgcggctctcgtgcccataggaggcgctggcgagctcctgtaacc

SEQ ID NO: 18460 - DNA, 62 bp, Homo sapiens; identical to SEQ ID NO: 7390
  chr4:55523652-55523714
  hyper

SEQ ID NO: 18461 - DNA, 30 bp, Homo sapiens; identical to SEQ ID NO: 7391
  chr4:55991067-55991097
  hyper

SEQ ID NO: 18462 - DNA, 30 bp, Homo sapiens; identical to SEQ ID NO: 7392
  chr4:56501660-56501690
  hyper

SEQ ID NO: 18463 - DNA, 51 bp, Homo sapiens
  chr4:57371963-57372014
  hyper
gggcccagagccaccgctcagcacgcgggcacgcggcgggagggaaggaaa

SEQ ID NO: 18464 - DNA, 171 bp, Homo sapiens; identical to SEQ ID NO: 7396
  chr4:57396480-57396651
  hyper

SEQ ID NO: 18465 - DNA, 18 bp, Homo sapiens
  chr4:57397264-57397282
  hyper
cgccgcagtaatgatctc

SEQ ID NO: 18466 - DNA, 1 bp, Homo sapiens
  chr4:57521395-57521396
  hyper
t

SEQ ID NO: 18467 - DNA, 50 bp, Homo sapiens; identical to SEQ ID NO: 7402
  chr4:57687669-57687719
  hyper

SEQ ID NO: 18468 - DNA, 11 bp, Homo sapiens
  chr4:57976405-57976416
  hyper
ccggctcgcag

SEQ ID NO: 18469 - DNA, 96 bp, Homo sapiens
  chr4:57976573-57976669
  hyper
gccttaaacccgccgccccgcccggcctgtccgcgggaaccacaccccggggcggtgagagcacgggggccccgcccgtgccgccctcccggcccc

SEQ ID NO: 18470 - DNA, 30 bp, Homo sapiens; identical to SEQ ID NO: 7405
  chr4:57977077-57977107
  hyper

SEQ ID NO: 18471 - DNA, 18 bp, Homo sapiens
  chr4:62065800-62065818
  hyper
cgccgaggcgggcctcga

SEQ ID NO: 18472 - DNA, 290 bp, Homo sapiens; identical to SEQ ID NO: 7408
  chr4:62066913-62067203
  hyper

SEQ ID NO: 18473 - DNA, 71 bp, Homo sapiens
  chr4:62067440-62067511
  hyper
gagcaactgatgggacgatctcagggaccggcgtttacgaaaggtaatttattcttcgcactcttcataat

SEQ ID NO: 18474 - DNA, 23 bp, Homo sapiens
  chr4:66535107-66535130
  hyper
aaccgcagaggggagcgaaaagg

SEQ ID NO: 18475 - DNA, 108 bp, Homo sapiens; identical to SEQ ID NO: 7411
  chr4:71600516-71600624
  hyper

SEQ ID NO: 18476 - DNA, 39 bp, Homo sapiens; identical to SEQ ID NO: 7412
  chr4:73434048-73434087
  hyper

SEQ ID NO: 18477 - DNA, 252 bp, Homo sapiens; identical to SEQ ID NO: 7413
  chr4:73434964-73435216
  hyper

SEQ ID NO: 18478 - DNA, 42 bp, Homo sapiens; identical to SEQ ID NO: 7414
  chr4:75231005-75231047
  hyper

SEQ ID NO: 18479 - DNA, 188 bp, Homo sapiens
  chr4:81106163-81106351
  hyper
gggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaatt

SEQ ID NO: 18480 - DNA, 92 bp, Homo sapiens; identical to SEQ ID NO: 7417
  chr4:81123206-81123298
  hyper

SEQ ID NO: 18481 - DNA, 279 bp, Homo sapiens; identical to SEQ ID NO: 2424
  chr4:81123625-81123904
  hyper

SEQ ID NO: 18482 - DNA, 156 bp, Homo sapiens
  chr4:81124121-81124277
  hyper
gcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcgga

SEQ ID NO: 18483 - DNA, 36 bp, Homo sapiens; identical to SEQ ID NO: 7420
  chr4:81124695-81124731
  hyper

SEQ ID NO: 18484 - DNA, 6 bp, Homo sapiens
  chr4:81187040-81187046
  hyper
cgtcat

SEQ ID NO: 18485 - DNA, 327 bp, Homo sapiens
  chr4:81187076-81187403
  hyper
agaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcaca

SEQ ID NO: 18486 - DNA, 16 bp, Homo sapiens
  chr4:81187782-81187798
  hyper
gcgttataaatatccc

SEQ ID NO: 18487 - DNA, 271 bp, Homo sapiens; identical to SEQ ID NO: 7423
  chr4:81187799-81188070
  hyper

SEQ ID NO: 18488 - DNA, 40 bp, Homo sapiens; identical to SEQ ID NO: 7424
  chr4:81188276-81188316
  hyper

SEQ ID NO: 18489 - DNA, 2 bp, Homo sapiens
  chr4:81188489-81188491
  hyper
tg

SEQ ID NO: 18490 - DNA, 214 bp, Homo sapiens; identical to SEQ ID NO: 7427
  chr4:81257025-81257239
  hyper

SEQ ID NO: 18491 - DNA, 10 bp, Homo sapiens
  chr4:81951421-81951431
  hyper
gcaggtgcag

SEQ ID NO: 18492 - DNA, 26 bp, Homo sapiens
  chr4:81951460-81951486
  hyper
gggaaagtaagcgagaatggtgttca

SEQ ID NO: 18493 - DNA, 17 bp, Homo sapiens
  chr4:81951832-81951849
  hyper
agatcagctagagagcg

SEQ ID NO: 18494 - DNA, 32 bp, Homo sapiens
  chr4:81951909-81951941
  hyper
cgcacacacacacacacgtacactaaaaaact

SEQ ID NO: 18495 - DNA, 76 bp, Homo sapiens
  chr4:81951970-81952046
  hyper
ccctggaaaaggcaatcgagcgccctccggaccgctgcgcacagccccggctccgacctggcgcccaaaacagagc

SEQ ID NO: 18496 - DNA, 157 bp, Homo sapiens; identical to SEQ ID NO: 7432
  chr4:81952727-81952884
  hyper

SEQ ID NO: 18497 - DNA, 123 bp, Homo sapiens; identical to SEQ ID NO: 7433
  chr4:82136082-82136205
  hyper

SEQ ID NO: 18498 - DNA, 37 bp, Homo sapiens; identical to SEQ ID NO: 7434
  chr4:82136243-82136280
  hyper

SEQ ID NO: 18499 - DNA, 172 bp, Homo sapiens
  chr4:82136635-82136807
  hyper
ttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcac

SEQ ID NO: 18500 - DNA, 84 bp, Homo sapiens
  chr4:82136837-82136921
  hyper
ccgaagcagctcgtcgacgcgcccctcccggactctggggccataacttacatctagtttgccagttcacgtgatgctgggggc

SEQ ID NO: 18501 - DNA, 12 bp, Homo sapiens
  chr4:85402764-85402776
  hyper
cggagactattc

SEQ ID NO: 18502 - DNA, 189 bp, Homo sapiens; identical to SEQ ID NO: 7440
  chr4:85414148-85414337
  hyper

SEQ ID NO: 18503 - DNA, 25 bp, Homo sapiens
  chr4:85414457-85414482
  hyper
ggctcggacgcgtgcagtaggaggc

SEQ ID NO: 18504 - DNA, 401 bp, Homo sapiens
  chr4:85416935-85417336
  hyper
ggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctc

SEQ ID NO: 18505 - DNA, 53 bp, Homo sapiens; identical to SEQ ID NO: 7444
  chr4:85417666-85417719
  hyper

SEQ ID NO: 18506 - DNA, 37 bp, Homo sapiens; identical to SEQ ID NO: 7446
  chr4:85418265-85418302
  hyper

SEQ ID NO: 18507 - DNA, 123 bp, Homo sapiens; identical to SEQ ID NO: 378
  chr4:85419120-85419243
  hyper

SEQ ID NO: 18508 - DNA, 87 bp, Homo sapiens; identical to SEQ ID NO: 7448
  chr4:85419695-85419782
  hyper

SEQ ID NO: 18509 - DNA, 18 bp, Homo sapiens
  chr4:85422432-85422450
  hyper
cttcggacactccaccct

SEQ ID NO: 18510 - DNA, 86 bp, Homo sapiens; identical to SEQ ID NO: 7451
  chr4:87281209-87281295
  hyper

SEQ ID NO: 18511 - DNA, 75 bp, Homo sapiens; identical to SEQ ID NO: 7452
  chr4:87515552-87515627
  hyper

SEQ ID NO: 18512 - DNA, 91 bp, Homo sapiens
  chr4:89378373-89378464
  hyper
ggcgttctctcctctcgcctctgggcctgggaccccgcaaagcggcgatggagcggaggtcgcggaggaagtcgcggcgcaacgggcgctc

SEQ ID NO: 18513 - DNA, 12 bp, Homo sapiens
  chr4:89378497-89378509
  hyper
gaagtctccggg

SEQ ID NO: 18514 - DNA, 122 bp, Homo sapiens; identical to SEQ ID NO: 7455
  chr4:90758478-90758600
  hyper

SEQ ID NO: 18515 - DNA, 30 bp, Homo sapiens; identical to SEQ ID NO: 7457
  chr4:90759319-90759349
  hyper

SEQ ID NO: 18516 - DNA, 30 bp, Homo sapiens; identical to SEQ ID NO: 7458
  chr4:93225390-93225420
  hyper

SEQ ID NO: 18517 - DNA, 76 bp, Homo sapiens
  chr4:94750906-94750982
  hyper
cagccccagcttctgcgggagggtactcggtgcagctggacgctctgcacttctcgactttcgaggacagcgccct

SEQ ID NO: 18518 - DNA, 51 bp, Homo sapiens
  chr4:94751368-94751419
  hyper
aaattgtgtcctttccgcccaccttctgctccccctttagatagatacggt

SEQ ID NO: 18519 - DNA, 97 bp, Homo sapiens
  chr4:94751502-94751599
  hyper
actggtttgggtttaatttattttacgccctgggcatccatccttgtgtgttgcgcactcaagtgtgggagatttagtcttccgaagttgttttcca

SEQ ID NO: 18520 - DNA, 114 bp, Homo sapiens; identical to SEQ ID NO: 7462
  chr4:94753279-94753393
  hyper

SEQ ID NO: 18521 - DNA, 55 bp, Homo sapiens; identical to SEQ ID NO: 7464
  chr4:95678866-95678921
  hyper

SEQ ID NO: 18522 - DNA, 30 bp, Homo sapiens; identical to SEQ ID NO: 7465
  chr4:95679715-95679745
  hyper

SEQ ID NO: 18523 - DNA, 30 bp, Homo sapiens; identical to SEQ ID NO: 7466
  chr4:96469039-96469069
  hyper

SEQ ID NO: 18524 - DNA, 83 bp, Homo sapiens
  chr4:101111504-101111587
  hyper
acaggcaggtggcttcttaggagtcccctctcctggggactcggtgacctgcagaccccagcagccagcggcaccctgctcac

SEQ ID NO: 18525 - DNA, 31 bp, Homo sapiens
  chr4:101111826-101111857
  hyper
ttccagggtagatctcgggccactgggaccg

SEQ ID NO: 18526 - DNA, 61 bp, Homo sapiens
  chr4:107955250-107955311
  hyper
ctgcaaaattgtccccgtgagagggcagtagggggccaagcccgggtcttgtctctctgtc

SEQ ID NO: 18527 - DNA, 113 bp, Homo sapiens; identical to SEQ ID NO: 7472
  chr4:107957249-107957362
  hyper

SEQ ID NO: 18528 - DNA, 10 bp, Homo sapiens
  chr4:107957363-107957373
  hyper
ttgtcccctg

SEQ ID NO: 18529 - DNA, 85 bp, Homo sapiens
  chr4:107957466-107957551
  hyper
tgctctctccccagtcctctttgctttttatagcttcccacagtgaggactttttttttttttttacctccgcccccaattcaag

SEQ ID NO: 18530 - DNA, 30 bp, Homo sapiens; identical to SEQ ID NO: 7474
  chr4:107957963-107957993
  hyper

SEQ ID NO: 18531 - DNA, 30 bp, Homo sapiens; identical to SEQ ID NO: 7475
  chr4:107958442-107958472
  hyper

SEQ ID NO: 18532 - DNA, 213 bp, Homo sapiens; identical to SEQ ID NO: 7476
  chr4:109088250-109088463
  hyper

SEQ ID NO: 18533 - DNA, 98 bp, Homo sapiens
  chr4:109093307-109093405
  hyper
tcctctccgccccctcggtcctaacccccgcccaggctccaggtcttcccctttgtgtggcctggactctctcccagctacgactttggtgggatcca

SEQ ID NO: 18534 - DNA, 8 bp, Homo sapiens
  chr4:109093506-109093514
  hyper
ctctattt

SEQ ID NO: 18535 - DNA, 117 bp, Homo sapiens; identical to SEQ ID NO: 7478
  chr4:109093806-109093923
  hyper

SEQ ID NO: 18536 - DNA, 89 bp, Homo sapiens; identical to SEQ ID NO: 7479
  chr4:109094183-109094272
  hyper

SEQ ID NO: 18537 - DNA, 30 bp, Homo sapiens; identical to SEQ ID NO: 7480
  chr4:109683691-109683721
  hyper

SEQ ID NO: 18538 - DNA, 70 bp, Homo sapiens; identical to SEQ ID NO: 7481
  chr4:109684016-109684086
  hyper

SEQ ID NO: 18539 - DNA, 37 bp, Homo sapiens; identical to SEQ ID NO: 7485
  chr4:110224118-110224155
  hyper

SEQ ID NO: 18540 - DNA, 49 bp, Homo sapiens
  chr4:111532961-111533010
  hyper
accccggaggtgcgtaggtggccctccgggttcccgcttctcctagtgc

SEQ ID NO: 18541 - DNA, 19 bp, Homo sapiens
  chr4:111540360-111540379
  hyper
ggtacgtgctcccttaaca

SEQ ID NO: 18542 - DNA, 3 bp, Homo sapiens
  chr4:111540641-111540644
  hyper
gtc

SEQ ID NO: 18543 - DNA, 105 bp, Homo sapiens; identical to SEQ ID NO: 2442
  chr4:111544076-111544181
  hyper

SEQ ID NO: 18544 - DNA, 83 bp, Homo sapiens
  chr4:111544298-111544381
  hyper
cgccgcggccctccccagccctctccgcctccgcctcctcccagacccttctccgggtgcgactgacgtggctccgcaccaat

SEQ ID NO: 18545 - DNA, 30 bp, Homo sapiens; identical to SEQ ID NO: 7494
  chr4:111549993-111550023
  hyper

SEQ ID NO: 18546 - DNA, 10 bp, Homo sapiens
  chr4:111550834-111550844
  hyper
cgcaaagcca

SEQ ID NO: 18547 - DNA, 105 bp, Homo sapiens
  chr4:111552994-111553099
  hyper
cttcagggatgttgtcggccccccgcccctcccccaaccagccaaagcaaaccttcgccaactcaagtttcccttgcttgcctcccgcgatgaaccgcgcaccca

SEQ ID NO: 18548 - DNA, 245 bp, Homo sapiens
  chr4:111553450-111553695
  hyper
cggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaa

SEQ ID NO: 18549 - DNA, 67 bp, Homo sapiens
  chr4:111557898-111557965
  hyper
tatctcacatccctgcgggatagatggcctccacttaccggctaccgggagagagctgctgtctccg

SEQ ID NO: 18550 - DNA, 18 bp, Homo sapiens
  chr4:111559233-111559251
  hyper
tggcgaggatggtattaa

SEQ ID NO: 18551 - DNA, 24 bp, Homo sapiens
  chr4:113431810-113431834
  hyper
tttcttttgcagattcggaggccg

SEQ ID NO: 18552 - DNA, 30 bp, Homo sapiens; identical to SEQ ID NO: 7506
  chr4:113432579-113432609
  hyper

SEQ ID NO: 18553 - DNA, 379 bp, Homo sapiens
  chr4:113435837-113436216
  hyper
aggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtgggga

SEQ ID NO: 18554 - DNA, 106 bp, Homo sapiens
  chr4:113436287-113436393
  hyper
agtctacgggtcttcttgatgcgctgcaccgtctcggccgtcttggcgcctcgggagacggcccgcgcccgggaagggcgccgtttgcaatcgtgtaccagaccca

SEQ ID NO: 18555 - DNA, 342 bp, Homo sapiens; identical to SEQ ID NO: 7508
  chr4:113437629-113437971
  hyper

SEQ ID NO: 18556 - DNA, 30 bp, Homo sapiens; identical to SEQ ID NO: 7509
  chr4:113438171-113438201
  hyper

SEQ ID NO: 18557 - DNA, 198 bp, Homo sapiens; identical to SEQ ID NO: 7510
  chr4:113438506-113438704
  hyper

SEQ ID NO: 18558 - DNA, 151 bp, Homo sapiens
  chr4:113441947-113442098
  hyper
gagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcat

SEQ ID NO: 18559 - DNA, 32 bp, Homo sapiens; identical to SEQ ID NO: 7516
  chr4:113626580-113626612
  hyper

SEQ ID NO: 18560 - DNA, 93 bp, Homo sapiens
  chr4:117847306-117847399
  hyper
cgacccctcccatctcgctccccacatccccgcggacacagctggtggcgactcagacctctcgggcagcggctgcagggcgagcacagaggg

SEQ ID NO: 18561 - DNA, 1 bp, Homo sapiens
  chr4:117847458-117847459
  hyper
c

SEQ ID NO: 18562 - DNA, 11 bp, Homo sapiens
  chr4:117847469-117847480
  hyper
cgggcccgctc

SEQ ID NO: 18563 - DNA, 56 bp, Homo sapiens
  chr4:121844007-121844063
  hyper
gggcgcgggcctgggcgctgcgggcgccgggacgccgctcgctgattggcccgaag

SEQ ID NO: 18564 - DNA, 114 bp, Homo sapiens; identical to SEQ ID NO: 7520
  chr4:121992426-121992540
  hyper

SEQ ID NO: 18565 - DNA, 249 bp, Homo sapiens; identical to SEQ ID NO: 7521
  chr4:121993436-121993685
  hyper

SEQ ID NO: 18566 - DNA, 2 bp, Homo sapiens
  chr4:121993995-121993997
  hyper
cc

SEQ ID NO: 18567 - DNA, 30 bp, Homo sapiens; identical to SEQ ID NO: 7523
  chr4:121994303-121994333
  hyper

SEQ ID NO: 18568 - DNA, 48 bp, Homo sapiens; identical to SEQ ID NO: 385
  chr4:122301962-122302010
  hyper

SEQ ID NO: 18569 - DNA, 57 bp, Homo sapiens
  chr4:122302246-122302303
  hyper
cagcttcagtggcgccaacgccgcttccccgcaccctcagggcgagggaagacttcc

SEQ ID NO: 18570 - DNA, 43 bp, Homo sapiens
  chr4:122871251-122871294
  hyper
ctccatttcctgggccgtttccattccacgcttatcttcagca

SEQ ID NO: 18571 - DNA, 239 bp, Homo sapiens
  chr4:122871334-122871573
  hyper
agaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcg

SEQ ID NO: 18572 - DNA, 452 bp, Homo sapiens
  chr4:122872000-122872452
  hyper
cccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcct

SEQ ID NO: 18573 - DNA, 258 bp, Homo sapiens; identical to SEQ ID NO: 7530
  chr4:123747826-123748084
  hyper

SEQ ID NO: 18574 - DNA, 354 bp, Homo sapiens; identical to SEQ ID NO: 7531
  chr4:123748540-123748894
  hyper

SEQ ID NO: 18575 - DNA, 24 bp, Homo sapiens
  chr4:126238000-126238024
  hyper
ggaagacagtagcagcggacgcca

SEQ ID NO: 18576 - DNA, 30 bp, Homo sapiens
  chr4:128544161-128544191
  hyper
gctcgcgcccagcgccggagacgggctgtg

SEQ ID NO: 18577 - DNA, 61 bp, Homo sapiens; identical to SEQ ID NO: 7535
  chr4:134068338-134068399
  hyper

SEQ ID NO: 18578 - DNA, 43 bp, Homo sapiens; identical to SEQ ID NO: 7536
  chr4:134068856-134068899
  hyper

SEQ ID NO: 18579 - DNA, 101 bp, Homo sapiens; identical to SEQ ID NO: 7538
  chr4:134071103-134071204
  hyper

SEQ ID NO: 18580 - DNA, 30 bp, Homo sapiens; identical to SEQ ID NO: 7539
  chr4:134071425-134071455
  hyper

SEQ ID NO: 18581 - DNA, 13 bp, Homo sapiens
  chr4:134072967-134072980
  hyper
ccactgtcaacat

SEQ ID NO: 18582 - DNA, 228 bp, Homo sapiens
  chr4:134073340-134073568
  hyper
cgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcct

SEQ ID NO: 18583 - DNA, 38 bp, Homo sapiens; identical to SEQ ID NO: 7546
  chr4:140657110-140657148
  hyper

SEQ ID NO: 18584 - DNA, 47 bp, Homo sapiens; identical to SEQ ID NO: 7547
  chr4:141294349-141294396
  hyper

SEQ ID NO: 18585 - DNA, 30 bp, Homo sapiens
  chr4:141348151-141348181
  hyper
ggagactgagacagccgagcctattttgat

SEQ ID NO: 18586 - DNA, 13 bp, Homo sapiens
  chr4:141419418-141419431
  hyper
gataatgccaggg

SEQ ID NO: 18587 - DNA, 142 bp, Homo sapiens; identical to SEQ ID NO: 7551
  chr4:142054074-142054216
  hyper

SEQ ID NO: 18588 - DNA, 96 bp, Homo sapiens
  chr4:144622058-144622154
  hyper
gctggcttctggggaccccagatacgcgcccagcgcggcgagacttagcgagggtgcagcgctgtcccctccgctcctgggcgcttcacccagcct

SEQ ID NO: 18589 - DNA, 125 bp, Homo sapiens
  chr4:145568334-145568459
  hyper
atctctgaaaacagacgtttctgcggtacccgcaccctgggctgggtaaatattttaaaagaatcgcgatgaacagtgtgttttggatcgaatggggcattggctgcggtgaaactgtaaattaa

SEQ ID NO: 18590 - DNA, 112 bp, Homo sapiens
  chr4:147558504-147558616
  hyper
cctgctcccggtcaacccccgtccggattgggccacccgcgggttcctgcgtcggggtcccggggccttctcaccctcgcctgcaccctgctccttccgctctctagggagg

SEQ ID NO: 18591 - DNA, 131 bp, Homo sapiens
  chr4:147559190-147559321
  hyper
gggagggggaggagtcgcatgcgcacagacgacccgagcctgctccgcggctgtccaatccgctgagagctgcgagaaatcgagtgagagaaagccctgcagcccctccgaccccatgtctctttggcacc

SEQ ID NO: 18592 - DNA, 40 bp, Homo sapiens
  chr4:147562055-147562095
  hyper
ccagtaaatgtgaatctcgacaaatcgaggactgaagagg

SEQ ID NO: 18593 - DNA, 41 bp, Homo sapiens; identical to SEQ ID NO: 7565
  chr4:147569117-147569158
  hyper

SEQ ID NO: 18594 - DNA, 205 bp, Homo sapiens
  chr4:147576639-147576844
  hyper
gggaagcgtcccaagcccgcgcggtctgccccggagccccggaggacccgaatactcagcggaatgtcaccctggccgggttctttggattcccctccggggccatcctacggaatccagccgtccccacaagctacctcatgtaactggagacctaagaaaagactctccataccttttgacaaaaagacgtaccagaagcaat

SEQ ID NO: 18595 - DNA, 30 bp, Homo sapiens; identical to SEQ ID NO: 7567
  chr4:151000206-151000236
  hyper

SEQ ID NO: 18596 - DNA, 157 bp, Homo sapiens; identical to SEQ ID NO: 7568
  chr4:154143837-154143994
  hyper

SEQ ID NO: 18597 - DNA, 46 bp, Homo sapiens; identical to SEQ ID NO: 7569
  chr4:154144430-154144476
  hyper

SEQ ID NO: 18598 - DNA, 76 bp, Homo sapiens; identical to SEQ ID NO: 7570
  chr4:154680788-154680864
  hyper

SEQ ID NO: 18599 - DNA, 30 bp, Homo sapiens; identical to SEQ ID NO: 7571
  chr4:154709169-154709199
  hyper

SEQ ID NO: 18600 - DNA, 48 bp, Homo sapiens
  chr4:154709476-154709524
  hyper
aaggcttaccttcctcggtggctggcaggaggtggtcgctgctagcga

SEQ ID NO: 18601 - DNA, 148 bp, Homo sapiens
  chr4:154712024-154712172
  hyper
ctctgagagatgctacgacttgggcctgggagtgggataagggccctctcgctttcacgcccccccaaccccccgccggccccggccaacccctaaatccccaacgccctccgctggggtcgcctcctccccgcagagccccttgttg

SEQ ID NO: 18602 - DNA, 114 bp, Homo sapiens
  chr4:154712594-154712708
  hyper
gcccatatgagcagcgcagggatgggacactgggtgcccatcccagcgcgcctccccagactggtccctgggatgctcacacgtggcgcggcaccgcggcggcgccttcacgaa

SEQ ID NO: 18603 - DNA, 36 bp, Homo sapiens
  chr4:155254130-155254166
  hyper
cgcgtttctcgataacgactgtcagcaccagcaggg

SEQ ID NO: 18604 - DNA, 105 bp, Homo sapiens
  chr4:155254196-155254301
  hyper
ccctgagagtcagcgtgagctcccgctgctcgcccgcgcccaggctgccgttgaggaacagcacccccagggctctgtcgatggcaaagacgcctggctgcgggc

SEQ ID NO: 18605 - DNA, 56 bp, Homo sapiens; identical to SEQ ID NO: 7579
  chr4:155411438-155411494
  hyper

SEQ ID NO: 18606 - DNA, 143 bp, Homo sapiens; identical to SEQ ID NO: 7581
  chr4:155413374-155413517
  hyper

SEQ ID NO: 18607 - DNA, 110 bp, Homo sapiens; identical to SEQ ID NO: 7583
  chr4:155664194-155664304
  hyper

SEQ ID NO: 18608 - DNA, 60 bp, Homo sapiens
  chr4:155665385-155665445
  hyper
cgcagcacccctgcccggcgagcttaacttgcccagcccggcccctgccggagtggcacc

SEQ ID NO: 18609 - DNA, 30 bp, Homo sapiens; identical to SEQ ID NO: 7585
  chr4:155665748-155665778
  hyper

SEQ ID NO: 18610 - DNA, 140 bp, Homo sapiens
  chr4:156129606-156129746
  hyper
gcaaagggagagattcgtggaagggaagggaggtaggggtggcgcaaacgcccagagtatcaaacttgggggtggcacagtaggtgacagcagcagctgcaggtggtggctggggacccgcgagggggcgcccctctggg

SEQ ID NO: 18611 - DNA, 250 bp, Homo sapiens
  chr4:156129797-156130047
  hyper
ggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactg

SEQ ID NO: 18612 - DNA, 162 bp, Homo sapiens; identical to SEQ ID NO: 7589
  chr4:156588521-156588683
  hyper

SEQ ID NO: 18613 - DNA, 130 bp, Homo sapiens; identical to SEQ ID NO: 7590
  chr4:156588684-156588814
  hyper

SEQ ID NO: 18614 - DNA, 70 bp, Homo sapiens; identical to SEQ ID NO: 7591
  chr4:156680699-156680769
  hyper

SEQ ID NO: 18615 - DNA, 200 bp, Homo sapiens; identical to SEQ ID NO: 7592
  chr4:156680770-156680970
  hyper

SEQ ID NO: 18616 - DNA, 13 bp, Homo sapiens
  chr4:158142999-158143012
  hyper
gaaggccagcgag

SEQ ID NO: 18617 - DNA, 74 bp, Homo sapiens
  chr4:158143369-158143443
  hyper
gttggacaaatcccacgagggactgccggagcccagtggcctcctgccccagcagctgccgctctcgcccgctg

SEQ ID NO: 18618 - DNA, 30 bp, Homo sapiens; identical to SEQ ID NO: 7595
  chr4:158144242-158144272
  hyper

SEQ ID NO: 18619 - DNA, 30 bp, Homo sapiens; identical to SEQ ID NO: 7598
  chr4:164264670-164264700
  hyper

SEQ ID NO: 18620 - DNA, 98 bp, Homo sapiens; identical to SEQ ID NO: 2479
  chr4:164265532-164265630
  hyper

SEQ ID NO: 18621 - DNA, 43 bp, Homo sapiens
  chr4:165304472-165304515
  hyper
cgactcagggttgagcgcatcagcgctaaacccaagacaaagg

SEQ ID NO: 18622 - DNA, 61 bp, Homo sapiens
  chr4:165304578-165304639
  hyper
cacactaggagcgcgtgagcctgtgaagtggctgtcatcgactccgcgctttccgaggggt

SEQ ID NO: 18623 - DNA, 27 bp, Homo sapiens
  chr4:165305163-165305190
  hyper
ccggctctggctcggctccccagtcct

SEQ ID NO: 18624 - DNA, 61 bp, Homo sapiens; identical to SEQ ID NO: 7602
  chr4:166300073-166300134
  hyper

SEQ ID NO: 18625 - DNA, 43 bp, Homo sapiens; identical to SEQ ID NO: 7603
  chr4:166300367-166300410
  hyper

SEQ ID NO: 18626 - DNA, 30 bp, Homo sapiens; identical to SEQ ID NO: 7604
  chr4:166793825-166793855
  hyper

SEQ ID NO: 18627 - DNA, 74 bp, Homo sapiens
  chr4:166794697-166794771
  hyper
cggccgcgggaagttcggcagccagaaggacgacctggcaggctgcgagcgccagcgccgccagagccgagttt

SEQ ID NO: 18628 - DNA, 254 bp, Homo sapiens
  chr4:166794909-166795163
  hyper
gtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacac

SEQ ID NO: 18629 - DNA, 53 bp, Homo sapiens
  chr4:166796212-166796265
  hyper
gtaaaggttgcatggtggttggggctaacctagcagagcggtttgtaagcgga

SEQ ID NO: 18630 - DNA, 239 bp, Homo sapiens
  chr4:168155269-168155508
  hyper
actgactgcaccaagcggctgcacacacacacagtacggctgacaccttgagcatctgggagaggagacacaacggggggtgggggggcatgtcagtgtcaaataaggggtacgaagccaggagcgaccctggaaaacatgcattagcaacgacgagggtagagggaggaggagacaagcagaggcaagcgtgtcccctccccgcaggctttacccccaaaagccgggcactcacacac

SEQ ID NO: 18631 - DNA, 98 bp, Homo sapiens; identical to SEQ ID NO: 2481
  chr4:172733771-172733869
  hyper

SEQ ID NO: 18632 - DNA, 73 bp, Homo sapiens
  chr4:172734203-172734276
  hyper
cagccgccgcgccccggctcgccgcgctcccgccggcaccatggaggaattcctgggacaaccgcctgcagcc

SEQ ID NO: 18633 - DNA, 115 bp, Homo sapiens; identical to SEQ ID NO: 404
  chr4:172734277-172734392
  hyper

SEQ ID NO: 18634 - DNA, 10 bp, Homo sapiens
  chr4:174429648-174429658
  hyper
cggacctctg

SEQ ID NO: 18635 - DNA, 30 bp, Homo sapiens; identical to SEQ ID NO: 7615
  chr4:174438209-174438239
  hyper

SEQ ID NO: 18636 - DNA, 12 bp, Homo sapiens
  chr4:174443551-174443563
  hyper
agatgtccctaa

SEQ ID NO: 18637 - DNA, 30 bp, Homo sapiens; identical to SEQ ID NO: 7623
  chr4:174459927-174459957
  hyper

SEQ ID NO: 18638 - DNA, 29 bp, Homo sapiens
  chr4:175134868-175134897
  hyper
cctctgggtccttaccgaaagggaaggtc

SEQ ID NO: 18639 - DNA, 16 bp, Homo sapiens
  chr4:175135672-175135688
  hyper
gcggcagtgaggctgg

SEQ ID NO: 18640 - DNA, 30 bp, Homo sapiens; identical to SEQ ID NO: 7627
  chr4:175137723-175137753
  hyper

SEQ ID NO: 18641 - DNA, 223 bp, Homo sapiens
  chr4:175138546-175138769
  hyper
ggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggct

SEQ ID NO: 18642 - DNA, 79 bp, Homo sapiens
  chr4:175139254-175139333
  hyper
tgaatcttcccagttccttccctgtttatttctcaacccagcagttcaaaaattcactttataacggtcccctaacaaa

SEQ ID NO: 18643 - DNA, 192 bp, Homo sapiens
  chr4:175750264-175750456
  hyper
caaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggt

SEQ ID NO: 18644 - DNA, 57 bp, Homo sapiens; identical to SEQ ID NO: 7632
  chr4:176923024-176923081
  hyper

SEQ ID NO: 18645 - DNA, 20 bp, Homo sapiens
  chr4:176923082-176923102
  hyper
ctattcggatcctgggtctc

SEQ ID NO: 18646 - DNA, 22 bp, Homo sapiens
  chr4:176923402-176923424
  hyper
gcccattcccgaggccgagcct

SEQ ID NO: 18647 - DNA, 85 bp, Homo sapiens
  chr4:176923558-176923643
  hyper
cgccctggcaagtgacagcctcgcccctcccagcggagacaactcgcagggcgcctggcgactctgcgggcgcacagacccctcc

SEQ ID NO: 18648 - DNA, 124 bp, Homo sapiens; identical to SEQ ID NO: 2495
  chr4:176987050-176987174
  hyper

SEQ ID NO: 18649 - DNA, 5 bp, Homo sapiens
  chr4:176987175-176987180
  hyper
cccgc

SEQ ID NO: 18650 - DNA, 107 bp, Homo sapiens; identical to SEQ ID NO: 2497
  chr4:176987206-176987313
  hyper

SEQ ID NO: 18651 - DNA, 10 bp, Homo sapiens
  chr4:176987314-176987324
  hyper
agaggggctc

SEQ ID NO: 18652 - DNA, 530 bp, Homo sapiens; identical to SEQ ID NO: 7640
  chr4:177713662-177714192
  hyper

SEQ ID NO: 18653 - DNA, 30 bp, Homo sapiens; identical to SEQ ID NO: 7641
  chr4:180979304-180979334
  hyper

SEQ ID NO: 18654 - DNA, 91 bp, Homo sapiens; identical to SEQ ID NO: 7642
  chr4:183062455-183062546
  hyper

SEQ ID NO: 18655 - DNA, 30 bp, Homo sapiens; identical to SEQ ID NO: 7645
  chr4:183065138-183065168
  hyper

SEQ ID NO: 18656 - DNA, 33 bp, Homo sapiens; identical to SEQ ID NO: 7648
  chr4:184826624-184826657
  hyper

SEQ ID NO: 18657 - DNA, 29 bp, Homo sapiens
  chr4:185937889-185937918
  hyper
caggcctggctctgcgccctgaggctccc

SEQ ID NO: 18658 - DNA, 154 bp, Homo sapiens
  chr4:185938343-185938497
  hyper
ccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattga

SEQ ID NO: 18659 - DNA, 170 bp, Homo sapiens
  chr4:185938564-185938734
  hyper
aaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgt

SEQ ID NO: 18660 - DNA, 212 bp, Homo sapiens; identical to SEQ ID NO: 7652
  chr4:185939694-185939906
  hyper

SEQ ID NO: 18661 - DNA, 44 bp, Homo sapiens
  chr4:185940294-185940338
  hyper
ctgcctggaggctggcggccacctccccaaaggcctgggtaggg

SEQ ID NO: 18662 - DNA, 25 bp, Homo sapiens
  chr4:185941560-185941585
  hyper
ttgcagtccaaggcccgcctgggcg

SEQ ID NO: 18663 - DNA, 174 bp, Homo sapiens
  chr4:185942760-185942934
  hyper
ccttaggggattgttccctacacgccatcctttaccattcggacactggtgcaggatggagaccctggggtctccgtttaagttctcaggcttggagagaaaagtcctccttatcctttccccagtgagatttttttttttatctcgccccacccagaacgtggtgaggaaagt

SEQ ID NO: 18664 - DNA, 40 bp, Homo sapiens; identical to SEQ ID NO: 7657
  chr4:186048748-186048788
  hyper

SEQ ID NO: 18665 - DNA, 70 bp, Homo sapiens; identical to SEQ ID NO: 7658
  chr4:186049492-186049562
  hyper

SEQ ID NO: 18666 - DNA, 57 bp, Homo sapiens; identical to SEQ ID NO: 7659
  chr4:186049764-186049821
  hyper

SEQ ID NO: 18667 - DNA, 61 bp, Homo sapiens; identical to SEQ ID NO: 7660
  chr5:53500-53561
  hyper

SEQ ID NO: 18668 - DNA, 30 bp, Homo sapiens; identical to SEQ ID NO: 7662
  chr5:54402-54432
  hyper

SEQ ID NO: 18669 - DNA, 74 bp, Homo sapiens; identical to SEQ ID NO: 7663
  chr5:92039-92113
  hyper

SEQ ID NO: 18670 - DNA, 352 bp, Homo sapiens
  chr5:320982-321334
  hyper
ccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagc

SEQ ID NO: 18671 - DNA, 76 bp, Homo sapiens
  chr5:374266-374342
  hyper
tgtgcccccacccgcgctgccccagcccgcggacctcggcggggagcgcccagggccagcacgggggtctcacggg

SEQ ID NO: 18672 - DNA, 82 bp, Homo sapiens; identical to SEQ ID NO: 7667
  chr5:524772-524854
  hyper

SEQ ID NO: 18673 - DNA, 23 bp, Homo sapiens
  chr5:1294607-1294630
  hyper
cagtgcgtcggtcaccgtgttgg

SEQ ID NO: 18674 - DNA, 264 bp, Homo sapiens
  chr5:1294767-1295031
  hyper
ttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtgg

SEQ ID NO: 18675 - DNA, 17 bp, Homo sapiens
  chr5:1295662-1295679
  hyper
tccgggcaccacgaatg

SEQ ID NO: 18676 - DNA, 52 bp, Homo sapiens; identical to SEQ ID NO: 7670
  chr5:1444711-1444763
  hyper

SEQ ID NO: 18677 - DNA, 14 bp, Homo sapiens
  chr5:1445157-1445171
  hyper
agccatagacaccc

SEQ ID NO: 18678 - DNA, 26 bp, Homo sapiens
  chr5:1445928-1445954
  hyper
gcggctgcgcgcggggaactgctggg

SEQ ID NO: 18679 - DNA, 83 bp, Homo sapiens
  chr5:1446236-1446319
  hyper
cgcactcgcctaagaaaaccatttcccgggacgggcctggaaagccctggcggttggtatccggctccagggccgaatggact

SEQ ID NO: 18680 - DNA, 214 bp, Homo sapiens; identical to SEQ ID NO: 7674
  chr5:1667861-1668075
  hyper

SEQ ID NO: 18681 - DNA, 133 bp, Homo sapiens; identical to SEQ ID NO: 7675
  chr5:1851756-1851889
  hyper

SEQ ID NO: 18682 - DNA, 354 bp, Homo sapiens
  chr5:1875099-1875453
  hyper
aacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagcca

SEQ ID NO: 18683 - DNA, 45 bp, Homo sapiens
  chr5:1875497-1875542
  hyper
ccaagggaagggtgtgggggaagcgcccagcgaggggatgccatt

SEQ ID NO: 18684 - DNA, 41 bp, Homo sapiens
  chr5:1875829-1875870
  hyper
ggggctgcagagccccgccaggctgcccgcggccgggagcg

SEQ ID NO: 18685 - DNA, 49 bp, Homo sapiens
  chr5:1878528-1878577
  hyper
ccagggaccagatgcgcggcttagcctccaggcctgccgacgcccccgc

SEQ ID NO: 18686 - DNA, 67 bp, Homo sapiens
  chr5:1879538-1879605
  hyper
aagacgtcctagaaccgcagagaaggcactgtgcctgcactccagggcctcagcccccagtgacaac

SEQ ID NO: 18687 - DNA, 239 bp, Homo sapiens
  chr5:1882605-1882844
  hyper
tagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggag

SEQ ID NO: 18688 - DNA, 85 bp, Homo sapiens
  chr5:1883430-1883515
  hyper
cagttaaaattagcccggcgctgcgcaggcggccggcccggcctcgcgctggcgcgctctgctccgagtggcaggaaggggctcg

SEQ ID NO: 18689 - DNA, 299 bp, Homo sapiens
  chr5:1883879-1884178
  hyper
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggacct

SEQ ID NO: 18690 - DNA, 33 bp, Homo sapiens
  chr5:1884698-1884731
  hyper
attcagacagtttagcgtcggtagccgcgagaa

SEQ ID NO: 18691 - DNA, 160 bp, Homo sapiens; identical to SEQ ID NO: 7691
  chr5:1886379-1886539
  hyper

SEQ ID NO: 18692 - DNA, 73 bp, Homo sapiens
  chr5:1886739-1886812
  hyper
cttgctccctgggtacggcctgaggctggacggagcgccgtccgggcgtccaggactcaggcctggccactcc

SEQ ID NO: 18693 - DNA, 19 bp, Homo sapiens
  chr5:1887737-1887756
  hyper
cctccgaggtcttagtatt

SEQ ID NO: 18694 - DNA, 212 bp, Homo sapiens
  chr5:1931754-1931966
  hyper
tttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgt

SEQ ID NO: 18695 - DNA, 266 bp, Homo sapiens
  chr5:2038439-2038705
  hyper
cggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagcc

SEQ ID NO: 18696 - DNA, 13 bp, Homo sapiens
  chr5:2038850-2038863
  hyper
tcaggatctgacc

SEQ ID NO: 18697 - DNA, 28 bp, Homo sapiens
  chr5:2738820-2738848
  hyper
ccacccccagccgcacgcttgggcctcc

SEQ ID NO: 18698 - DNA, 31 bp, Homo sapiens
  chr5:2743713-2743744
  hyper
ctgctcctggtcgccccgttttgccgacgtc

SEQ ID NO: 18699 - DNA, 21 bp, Homo sapiens
  chr5:2748353-2748374
  hyper
cctggatcttcttcccggacc

SEQ ID NO: 18700 - DNA, 43 bp, Homo sapiens
  chr5:2751894-2751937
  hyper
ccgcccgctgcagcctccgggccgcggccgggggaggggcaga

SEQ ID NO: 18701 - DNA, 200 bp, Homo sapiens; identical to SEQ ID NO: 7711
  chr5:2752242-2752442
  hyper

SEQ ID NO: 18702 - DNA, 93 bp, Homo sapiens
  chr5:2752898-2752991
  hyper
ggggcggttgccttgcggggctcagaagcgaggcggttggcgagggttcctaggaccccagcttcctagaaccctctccccatcacgcttctc

SEQ ID NO: 18703 - DNA, 8 bp, Homo sapiens
  chr5:2753040-2753048
  hyper
tccgaagg

SEQ ID NO: 18704 - DNA, 114 bp, Homo sapiens
  chr5:2753078-2753192
  hyper
aagagtgtcaggtctgtgctggcctattgggagcacccacccagcaggtgcctctatcctcggaagccgtctcgggtgggtgcggtggagaagagagagcgcagtggcctgggg

SEQ ID NO: 18705 - DNA, 30 bp, Homo sapiens; identical to SEQ ID NO: 7713
  chr5:2754590-2754620
  hyper

SEQ ID NO: 18706 - DNA, 135 bp, Homo sapiens
  chr5:2756464-2756599
  hyper
aattctccagcatctcgccgactccgtctctaccctcctctccttcctaatctcgcgctggcttcgcccttttctctctcctcctccttcctacgcgccccgccccctccccccaggtcgcacctctccccgccc

SEQ ID NO: 18707 - DNA, 30 bp, Homo sapiens; identical to SEQ ID NO: 7718
  chr5:3122164-3122194
  hyper

SEQ ID NO: 18708 - DNA, 41 bp, Homo sapiens; identical to SEQ ID NO: 7719
  chr5:3197756-3197797
  hyper

SEQ ID NO: 18709 - DNA, 123 bp, Homo sapiens; identical to SEQ ID NO: 7721
  chr5:3591143-3591266
  hyper

SEQ ID NO: 18710 - DNA, 21 bp, Homo sapiens
  chr5:3600732-3600753
  hyper
cgtccccaggccagattcgcc

SEQ ID NO: 18711 - DNA, 34 bp, Homo sapiens; identical to SEQ ID NO: 7727
  chr5:3606775-3606809
  hyper

SEQ ID NO: 18712 - DNA, 30 bp, Homo sapiens; identical to SEQ ID NO: 7728
  chr5:3607118-3607148
  hyper

SEQ ID NO: 18713 - DNA, 100 bp, Homo sapiens
  chr5:5139900-5140000
  hyper
cacagctgtgcccgggcacagaggcgcggccagaccgcactccgcgggctgcaggtgtcccggcctctggcggcgccggtgcggcccggaggtgggagcc

SEQ ID NO: 18714 - DNA, 137 bp, Homo sapiens; identical to SEQ ID NO: 7730
  chr5:5140031-5140168
  hyper

SEQ ID NO: 18715 - DNA, 18 bp, Homo sapiens
  chr5:5140438-5140456
  hyper
cttcagtaataaccccgg

SEQ ID NO: 18716 - DNA, 103 bp, Homo sapiens
  chr5:5140527-5140630
  hyper
cgctgccggccggggaccctccggtggcccctagcccctcggagcgctcctggatgaagccccgcgcgcgcggatggcggggcttggcggcgctgtggatgct

SEQ ID NO: 18717 - DNA, 192 bp, Homo sapiens
  chr5:6448738-6448930
  hyper
gcagcagcagcaccccgggggcgcgggcgacgccagcccgggacccggcaagggaaagggcaagcgcgcggcggagctggccccgcgcgacaaggcgccggcggctgcggcggcggcggcggcggctgcggcgggggccgggggcccccgcgagagggcagcgggcgccagggcggggccgggcccggcggt

SEQ ID NO: 18718 - DNA, 272 bp, Homo sapiens
  chr5:6583189-6583461
  hyper
cccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaa

SEQ ID NO: 18719 - DNA, 30 bp, Homo sapiens; identical to SEQ ID NO: 7736
  chr5:6687127-6687157
  hyper

SEQ ID NO: 18720 - DNA, 8 bp, Homo sapiens
  chr5:7395538-7395546
  hyper
caccgcgg

SEQ ID NO: 18721 - DNA, 49 bp, Homo sapiens; identical to SEQ ID NO: 7740
  chr5:7396986-7397035
  hyper

SEQ ID NO: 18722 - DNA, 53 bp, Homo sapiens
  chr5:7850962-7851015
  hyper
tccgcgcccagtccgcggtcctcacccgcgccgggcggtagtagtagctgtgc

SEQ ID NO: 18723 - DNA, 18 bp, Homo sapiens
  chr5:7851121-7851139
  hyper
cgtcgtcctccatgccgc

SEQ ID NO: 18724 - DNA, 70 bp, Homo sapiens
  chr5:10333618-10333688
  hyper
tgcgtcctgggtgggcgcgatgctcccccagaacgactggagatggagagtgtcggggagggaaacggga

SEQ ID NO: 18725 - DNA, 31 bp, Homo sapiens; identical to SEQ ID NO: 428
  chr5:10564628-10564659
  hyper

SEQ ID NO: 18726 - DNA, 221 bp, Homo sapiens
  chr5:10564800-10565021
  hyper
cgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcct

SEQ ID NO: 18727 - DNA, 15 bp, Homo sapiens
  chr5:10565607-10565622
  hyper
cggggctccccagag

SEQ ID NO: 18728 - DNA, 28 bp, Homo sapiens
  chr5:11385363-11385391
  hyper
cacgcgcacttagcgagggagaagcaca

SEQ ID NO: 18729 - DNA, 180 bp, Homo sapiens; identical to SEQ ID NO: 7749
  chr5:11903545-11903725
  hyper

SEQ ID NO: 18730 - DNA, 30 bp, Homo sapiens; identical to SEQ ID NO: 7754
  chr5:11904962-11904992
  hyper

SEQ ID NO: 18731 - DNA, 30 bp, Homo sapiens; identical to SEQ ID NO: 7755
  chr5:15500979-15501009
  hyper

SEQ ID NO: 18732 - DNA, 30 bp, Homo sapiens; identical to SEQ ID NO: 7756
  chr5:15501264-15501294
  hyper

SEQ ID NO: 18733 - DNA, 61 bp, Homo sapiens
  chr5:16180260-16180321
  hyper
cgggccgggtggggcgcgacagtctgagccgagacccgcgtgggcttaagggtgcgcgagg

SEQ ID NO: 18734 - DNA, 53 bp, Homo sapiens; identical to SEQ ID NO: 2541
  chr5:16180371-16180424
  hyper

SEQ ID NO: 18735 - DNA, 43 bp, Homo sapiens; identical to SEQ ID NO: 7761
  chr5:17216867-17216910
  hyper

SEQ ID NO: 18736 - DNA, 16 bp, Homo sapiens
  chr5:17217708-17217724
  hyper
atgcagaggctgcagc

SEQ ID NO: 18737 - DNA, 81 bp, Homo sapiens; identical to SEQ ID NO: 7763
  chr5:17217784-17217865
  hyper

SEQ ID NO: 18738 - DNA, 49 bp, Homo sapiens; identical to SEQ ID NO: 7764
  chr5:17217991-17218040
  hyper

SEQ ID NO: 18739 - DNA, 276 bp, Homo sapiens; identical to SEQ ID NO: 7765
  chr5:17218658-17218934
  hyper

SEQ ID NO: 18740 - DNA, 16 bp, Homo sapiens
  chr5:17219018-17219034
  hyper
tcggtggacagccctt

SEQ ID NO: 18741 - DNA, 121 bp, Homo sapiens; identical to SEQ ID NO: 2542
  chr5:22853104-22853225
  hyper

SEQ ID NO: 18742 - DNA, 270 bp, Homo sapiens; identical to SEQ ID NO: 7769
  chr5:31855221-31855491
  hyper

SEQ ID NO: 18743 - DNA, 66 bp, Homo sapiens; identical to SEQ ID NO: 7770
  chr5:32710234-32710300
  hyper

SEQ ID NO: 18744 - DNA, 183 bp, Homo sapiens; identical to SEQ ID NO: 7771
  chr5:32710598-32710781
  hyper

SEQ ID NO: 18745 - DNA, 61 bp, Homo sapiens
  chr5:32711765-32711826
  hyper
aagcgcccaagggggcgcagggaccttggagagaagagtggggaggaaagaggaagggtgg

SEQ ID NO: 18746 - DNA, 273 bp, Homo sapiens
  chr5:32712491-32712764
  hyper
tacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgg

SEQ ID NO: 18747 - DNA, 29 bp, Homo sapiens
  chr5:33892054-33892083
  hyper
gggtgcatggtcaggcgcgagaaggcagc

SEQ ID NO: 18748 - DNA, 298 bp, Homo sapiens
  chr5:33892115-33892413
  hyper
tttttaagcagaaaggagctagacacctttttcccctccctcctcctaaaaggggagtgattcagctgacagtgtccgctttcggcggggtgtggaatgggccagagcgggagggcgcagcccaccccggtccccacccctccgcctcccgcatgccccgcggcctcgcagcccgcccgctcggtgcatcttcctcccggactcccacccccgcgctcctccggccccgccccgaacgccaggcccagctggccgagccggccaaataggggagacccgggagagccgccctgggagg

SEQ ID NO: 18749 - DNA, 106 bp, Homo sapiens
  chr5:33892443-33892549
  hyper
caggccagccccccggcgtgcttaaatacaagctcaaaatgaggagaacagagttgaggcagaggggggccccactccctccatccttccgcgctcagcgctgccc

SEQ ID NO: 18750 - DNA, 26 bp, Homo sapiens
  chr5:33936336-33936362
  hyper
acccactgacctccaggaagctgagc

SEQ ID NO: 18751 - DNA, 123 bp, Homo sapiens
  chr5:33936363-33936486
  hyper
tggtggatggaactctacgatctctttctctccaaggacggaaacctcatccaagcagtcccagaggaaacggataaaggtatttgaaagggagcgagcggccccaaatcgcacaattgagcg

SEQ ID NO: 18752 - DNA, 133 bp, Homo sapiens; identical to SEQ ID NO: 7780
  chr5:36690192-36690325
  hyper

SEQ ID NO: 18753 - DNA, 12 bp, Homo sapiens
  chr5:37834672-37834684
  hyper
gtgcggggctgg

SEQ ID NO: 18754 - DNA, 23 bp, Homo sapiens
  chr5:37834714-37834737
  hyper
gcggcccccccgcggggagggaa

SEQ ID NO: 18755 - DNA, 385 bp, Homo sapiens
  chr5:37837992-37838377
  hyper
ctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagaga

SEQ ID NO: 18756 - DNA, 30 bp, Homo sapiens; identical to SEQ ID NO: 7784
  chr5:37839237-37839267
  hyper

SEQ ID NO: 18757 - DNA, 95 bp, Homo sapiens
  chr5:37840125-37840220
  hyper
gcgccaggagcgcaggctggtcttctagagcccgggctgggggtccggggtccggggtgggggaggggaggcgcggggccccgggagggaggggt

SEQ ID NO: 18758 - DNA, 96 bp, Homo sapiens; identical to SEQ ID NO: 2551
  chr5:37840267-37840363
  hyper

SEQ ID NO: 18759 - DNA, 34 bp, Homo sapiens
  chr5:38257451-38257485
  hyper
agccaggacgcccaccgagtcctggcagcgttgc

SEQ ID NO: 18760 - DNA, 496 bp, Homo sapiens; identical to SEQ ID NO: 7793
  chr5:38258174-38258670
  hyper

SEQ ID NO: 18761 - DNA, 144 bp, Homo sapiens; identical to SEQ ID NO: 7794
  chr5:38258671-38258815
  hyper

SEQ ID NO: 18762 - DNA, 123 bp, Homo sapiens; identical to SEQ ID NO: 7795
  chr5:38556551-38556674
  hyper

SEQ ID NO: 18763 - DNA, 30 bp, Homo sapiens; identical to SEQ ID NO: 7796
  chr5:39425493-39425523
  hyper

SEQ ID NO: 18764 - DNA, 150 bp, Homo sapiens
  chr5:42424672-42424822
  hyper
tgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcg

SEQ ID NO: 18765 - DNA, 99 bp, Homo sapiens
  chr5:42425060-42425159
  hyper
ggtgtgcagggtggaagaggccacagaggtgccgcctgtctgtttgtgccgccaggagaccttggaagggacagagaaaggtaacggaaggccaaagtg

SEQ ID NO: 18766 - DNA, 40 bp, Homo sapiens
  chr5:42991785-42991825
  hyper
tggaggagccaaatccgtcccattctggatccttattcca

SEQ ID NO: 18767 - DNA, 87 bp, Homo sapiens
  chr5:42992934-42993021
  hyper
accccgcagattcgtctgtcgttggcttgttggtcctaacaagtttcgatttcagggtgcctgcgtttctttttcttttctcttctt

SEQ ID NO: 18768 - DNA, 118 bp, Homo sapiens
  chr5:43007818-43007936
  hyper
taagcatgcctgctgcggattaagagcgcgcatgcgcactgggggaatgggatggagccacccgggattctcgccttatacaaacagggaacccagcctccttagctttcatataaaa

SEQ ID NO: 18769 - DNA, 236 bp, Homo sapiens
  chr5:43007966-43008202
  hyper
ggcaacctgctttcaggacccttgttttttatgagagctttcgtttacgcttaataaattctactccactcactcttcgatatccgcgtgcccacttcctcctgatcgtgagacaaggacccggatatagctgagcttagaagcaaaaatcctgcatcaatagcaaatgcggacactgaacgactagcggagtacccagcggcaaactttagtttttggtgcagttaaggtattgc

SEQ ID NO: 18770 - DNA, 199 bp, Homo sapiens; identical to SEQ ID NO: 7810
  chr5:43008737-43008936
  hyper

SEQ ID NO: 18771 - DNA, 47 bp, Homo sapiens
  chr5:43019191-43019238
  hyper
gcaagtcctgccgaacgcgactttttcctcttgtggaccaagtctga

SEQ ID NO: 18772 - DNA, 1 bp, Homo sapiens
  chr5:43040869-43040870
  hyper
t

SEQ ID NO: 18773 - DNA, 52 bp, Homo sapiens
  chr5:43040964-43041016
  hyper
aaaagtgacagcactgagaacctaaggaccccgcgaacgggaaatgtcacgt

SEQ ID NO: 18774 - DNA, 238 bp, Homo sapiens; identical to SEQ ID NO: 7816
  chr5:43191854-43192092
  hyper

SEQ ID NO: 18775 - DNA, 470 bp, Homo sapiens; identical to SEQ ID NO: 7817
  chr5:43192670-43193140
  hyper

SEQ ID NO: 18776 - DNA, 33 bp, Homo sapiens
  chr5:43396969-43397002
  hyper
tgaagtggaaaacagcgggcggtagccgaagca

SEQ ID NO: 18777 - DNA, 72 bp, Homo sapiens; identical to SEQ ID NO: 7819
  chr5:43397305-43397377
  hyper

SEQ ID NO: 18778 - DNA, 367 bp, Homo sapiens; identical to SEQ ID NO: 7820
  chr5:44388245-44388612
  hyper

SEQ ID NO: 18779 - DNA, 30 bp, Homo sapiens; identical to SEQ ID NO: 7821
  chr5:44388856-44388886
  hyper

SEQ ID NO: 18780 - DNA, 252 bp, Homo sapiens
  chr5:44389852-44390104
  hyper
acggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcag

SEQ ID NO: 18781 - DNA, 75 bp, Homo sapiens
  chr5:45695533-45695608
  hyper
caaggaggagagcccgtccgggattcccgggcaacaggagcacatcctccgagcccctcctgggtggaaactacc

SEQ ID NO: 18782 - DNA, 17 bp, Homo sapiens
  chr5:45695947-45695964
  hyper
tcttcgaagccccccgc

SEQ ID NO: 18783 - DNA, 293 bp, Homo sapiens
  chr5:49736685-49736978
  hyper
gttcagcttaggtgacacaaacgtagctaatgggaggccgccgccgactctcccacccgcccttaccagcatccccgcgcctctccccgccacccttgcccggcgcgccggcgatgccctctgcccgcggggacccgagcctcgcgcgccctccgccctccctaccctggaccctgtacccatcacacctggggcactgccgtccgccgagcttgggcgcgcggcagcgagaaggcactggaggaggagcagccggggcgtacgcgccctggcctccagcaggccggggaggg

SEQ ID NO: 18784 - DNA, 158 bp, Homo sapiens; identical to SEQ ID NO: 7827
  chr5:49737098-49737256
  hyper

SEQ ID NO: 18785 - DNA, 84 bp, Homo sapiens
  chr5:50263484-50263568
  hyper
cctcgccccaattaacgccctacagccagtcagccttacacctgctggaaaaatcttggtggcagtggtgggaggtggtggttt

SEQ ID NO: 18786 - DNA, 39 bp, Homo sapiens
  chr5:50264603-50264642
  hyper
taaagtgtccaggactggaactcacgtccctgaggcagg

SEQ ID NO: 18787 - DNA, 243 bp, Homo sapiens
  chr5:50265429-50265672
  hyper
gtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccacca

SEQ ID NO: 18788 - DNA, 40 bp, Homo sapiens; identical to SEQ ID NO: 7832
  chr5:50683270-50683310
  hyper

SEQ ID NO: 18789 - DNA, 229 bp, Homo sapiens; identical to SEQ ID NO: 7833
  chr5:50685846-50686075
  hyper

SEQ ID NO: 18790 - DNA, 7 bp, Homo sapiens
  chr5:50695234-50695241
  hyper
cacagac

SEQ ID NO: 18791 - DNA, 37 bp, Homo sapiens
  chr5:54516334-54516371
  hyper
gtggctcaggttcaacgcgctccggctgcagtctgtg

SEQ ID NO: 18792 - DNA, 293 bp, Homo sapiens
  chr5:54527343-54527636
  hyper
tcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaagg

SEQ ID NO: 18793 - DNA, 180 bp, Homo sapiens
  chr5:57878091-57878271
  hyper
tttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtg

SEQ ID NO: 18794 - DNA, 165 bp, Homo sapiens
  chr5:57878375-57878540
  hyper
ccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaa

SEQ ID NO: 18795 - DNA, 35 bp, Homo sapiens; identical to SEQ ID NO: 7841
  chr5:57879028-57879063
  hyper

SEQ ID NO: 18796 - DNA, 149 bp, Homo sapiens; identical to SEQ ID NO: 7842
  chr5:58335677-58335826
  hyper

SEQ ID NO: 18797 - DNA, 59 bp, Homo sapiens
  chr5:59188996-59189055
  hyper
cctgagtccctggaacgaggagggccaggacatcctggatttcttcaggccgggccggt

SEQ ID NO: 18798 - DNA, 292 bp, Homo sapiens
  chr5:59189206-59189498
  hyper
cagggggggcggcggcggcggctgtagcggacactggggctggggctggggcgagggtggcggcggcgggggcaggtggtgatggggatgcaggaggcggaactggggctgccggagcgggtactggtggtgctgctcgtgcctccagagatgcttgggggctttgagcgtggccccgccggcgctgtcgctgccctctccgctgcccgcccgggccggcgcgctgctgccctctgcctccatcctggctcgcggctccgcgacctgctgcccagcccgggttcaccgcgct

SEQ ID NO: 18799 - DNA, 81 bp, Homo sapiens
  chr5:59189948-59190029
  hyper
accaaaaccactccagccagtcaggagtcagacctgtcctcttgatccttcccctcgccgtgcccgcgcctccctcctcca

SEQ ID NO: 18800 - DNA, 130 bp, Homo sapiens
  chr5:63801877-63802007
  hyper
acaagcccttagagacgagggatcaaggcagccgattagagccaattgcttgctttggggacggccagtccttccaggcctggcgacagtggagggaggggaaagacgaaccgagtgccgctgcgggaag

SEQ ID NO: 18801 - DNA, 38 bp, Homo sapiens
  chr5:63986450-63986488
  hyper
atgagcgaggccagccgactgtgctccggctactacag

SEQ ID NO: 18802 - DNA, 53 bp, Homo sapiens; identical to SEQ ID NO: 7852
  chr5:63986909-63986962
  hyper

SEQ ID NO: 18803 - DNA, 132 bp, Homo sapiens; identical to SEQ ID NO: 7853
  chr5:67583945-67584077
  hyper

SEQ ID NO: 18804 - DNA, 19 bp, Homo sapiens
  chr5:71014895-71014914
  hyper
tctgcgctctagcccatct

SEQ ID NO: 18805 - DNA, 30 bp, Homo sapiens; identical to SEQ ID NO: 7856
  chr5:71403263-71403293
  hyper

SEQ ID NO: 18806 - DNA, 30 bp, Homo sapiens; identical to SEQ ID NO: 7859
  chr5:71404812-71404842
  hyper

SEQ ID NO: 18807 - DNA, 63 bp, Homo sapiens; identical to SEQ ID NO: 7860
  chr5:72416102-72416165
  hyper

SEQ ID NO: 18808 - DNA, 15 bp, Homo sapiens
  chr5:72526051-72526066
  hyper
tcgccccagactgtc

SEQ ID NO: 18809 - DNA, 18 bp, Homo sapiens
  chr5:72526395-72526413
  hyper
gtgggcccaatgctccgg

SEQ ID NO: 18810 - DNA, 4 bp, Homo sapiens
  chr5:72526643-72526647
  hyper
gtta

SEQ ID NO: 18811 - DNA, 102 bp, Homo sapiens
  chr5:72595440-72595542
  hyper
ttgtccaccttgccccgaaggcaagtctggatatgaaaagaaaaaggcgggcaacggaggagatttatttttcattttaactttcctctcccaggcttcctc

SEQ ID NO: 18812 - DNA, 30 bp, Homo sapiens; identical to SEQ ID NO: 7871
  chr5:72596861-72596891
  hyper

SEQ ID NO: 18813 - DNA, 72 bp, Homo sapiens; identical to SEQ ID NO: 7872
  chr5:72598030-72598102
  hyper

SEQ ID NO: 18814 - DNA, 20 bp, Homo sapiens
  chr5:72599059-72599079
  hyper
cgaatgcagcgcccgggagt

SEQ ID NO: 18815 - DNA, 30 bp, Homo sapiens; identical to SEQ ID NO: 7875
  chr5:72608427-72608457
  hyper

SEQ ID NO: 18816 - DNA, 40 bp, Homo sapiens; identical to SEQ ID NO: 7877
  chr5:72716058-72716098
  hyper

SEQ ID NO: 18817 - DNA, 30 bp, Homo sapiens; identical to SEQ ID NO: 7879
  chr5:72733558-72733588
  hyper

SEQ ID NO: 18818 - DNA, 9 bp, Homo sapiens
  chr5:72740138-72740147
  hyper
cccatccag

SEQ ID NO: 18819 - DNA, 232 bp, Homo sapiens; identical to SEQ ID NO: 7881
  chr5:72742850-72743082
  hyper

SEQ ID NO: 18820 - DNA, 51 bp, Homo sapiens; identical to SEQ ID NO: 7882
  chr5:72743504-72743555
  hyper

SEQ ID NO: 18821 - DNA, 171 bp, Homo sapiens; identical to SEQ ID NO: 7883
  chr5:72744287-72744458
  hyper

SEQ ID NO: 18822 - DNA, 32 bp, Homo sapiens; identical to SEQ ID NO: 7884
  chr5:72744886-72744918
  hyper

SEQ ID NO: 18823 - DNA, 53 bp, Homo sapiens; identical to SEQ ID NO: 7885
  chr5:74162540-74162593
  hyper

SEQ ID NO: 18824 - DNA, 208 bp, Homo sapiens
  chr5:75378033-75378241
  hyper
cgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaa

SEQ ID NO: 18825 - DNA, 148 bp, Homo sapiens; identical to SEQ ID NO: 7887
  chr5:75379107-75379255
  hyper

SEQ ID NO: 18826 - DNA, 96 bp, Homo sapiens
  chr5:75380067-75380163
  hyper
caggcgaagcagacccgaggctgtgaagctcagaggggagagggaccaatcgcagtaaataagctaccgaggtaatcttagatggcgatgagggca

SEQ ID NO: 18827 - DNA, 202 bp, Homo sapiens
  chr5:75380422-75380624
  hyper
gggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcgg

SEQ ID NO: 18828 - DNA, 17 bp, Homo sapiens
  chr5:76011337-76011354
  hyper
gacgtataaaagttcaa

SEQ ID NO: 18829 - DNA, 211 bp, Homo sapiens; identical to SEQ ID NO: 7894
  chr5:76506548-76506759
  hyper

SEQ ID NO: 18830 - DNA, 275 bp, Homo sapiens
  chr5:76506760-76507035
  hyper
cccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgc

SEQ ID NO: 18831 - DNA, 12 bp, Homo sapiens
  chr5:76507114-76507126
  hyper
cgtgggggccgt

SEQ ID NO: 18832 - DNA, 133 bp, Homo sapiens; identical to SEQ ID NO: 7898
  chr5:76924754-76924887
  hyper

SEQ ID NO: 18833 - DNA, 97 bp, Homo sapiens
  chr5:76925464-76925561
  hyper
tgcaccgtgtctgtgcgcgcgcgtgtgtagcgtctgagcgtgagcgagagtgcgagtgtgtgtgtttctgcccacaaaccagtccattggtgtctga

SEQ ID NO: 18834 - DNA, 199 bp, Homo sapiens
  chr5:76925690-76925889
  hyper
gtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaa

SEQ ID NO: 18835 - DNA, 326 bp, Homo sapiens; identical to SEQ ID NO: 7900
  chr5:76926106-76926432
  hyper

SEQ ID NO: 18836 - DNA, 10 bp, Homo sapiens
  chr5:76928678-76928688
  hyper
caattgagct

SEQ ID NO: 18837 - DNA, 34 bp, Homo sapiens
  chr5:76928906-76928940
  hyper
tgcaagtgccagtgaatcccgaaatgtttgtttg

SEQ ID NO: 18838 - DNA, 20 bp, Homo sapiens
  chr5:76932282-76932302
  hyper
tatttgtcaataatgcgagc

SEQ ID NO: 18839 - DNA, 210 bp, Homo sapiens
  chr5:76932332-76932542
  hyper
cccgggggggcgctgaggttgccttctcaggcggaggaggcgaaccctgtagcccgacaacgccgggcttcgattttgaggagcttcttccgggatgtcgctatactggccggagacgggccttgcgtgtccattgggggatggcgatggggaccagtttccgggtagagaaggagataactcgatacaggaacgcacaggcagcctgaa

SEQ ID NO: 18840 - DNA, 30 bp, Homo sapiens; identical to SEQ ID NO: 7903
  chr5:76933489-76933519
  hyper

SEQ ID NO: 18841 - DNA, 47 bp, Homo sapiens; identical to SEQ ID NO: 7904
  chr5:76934057-76934104
  hyper

SEQ ID NO: 18842 - DNA, 30 bp, Homo sapiens; identical to SEQ ID NO: 7909
  chr5:76940379-76940409
  hyper

SEQ ID NO: 18843 - DNA, 97 bp, Homo sapiens; identical to SEQ ID NO: 7910
  chr5:76940857-76940954
  hyper

SEQ ID NO: 18844 - DNA, 9 bp, Homo sapiens
  chr5:76941192-76941201
  hyper
ccctccatg

SEQ ID NO: 18845 - DNA, 172 bp, Homo sapiens
  chr5:76941326-76941498
  hyper
tcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccaggggg

SEQ ID NO: 18846 - DNA, 389 bp, Homo sapiens; identical to SEQ ID NO: 7912
  chr5:76941512-76941901
  hyper

SEQ ID NO: 18847 - DNA, 14 bp, Homo sapiens
  chr5:77147549-77147563
  hyper
aagtgcgtgtgtag

SEQ ID NO: 18848 - DNA, 105 bp, Homo sapiens
  chr5:77148393-77148498
  hyper
ggagctgacgctgaacgcctgaatgggcagcgcgccaacttcgctgctccaggaggggggtggggagggagaggaggaggaggaggatgaggagagaggggaggt

SEQ ID NO: 18849 - DNA, 3 bp, Homo sapiens
  chr5:77269309-77269312
  hyper
cct

SEQ ID NO: 18850 - DNA, 196 bp, Homo sapiens; identical to SEQ ID NO: 7922
  chr5:79330939-79331135
  hyper

SEQ ID NO: 18851 - DNA, 108 bp, Homo sapiens; identical to SEQ ID NO: 7923
  chr5:79331229-79331337
  hyper

SEQ ID NO: 18852 - DNA, 3 bp, Homo sapiens
  chr5:79331476-79331479
  hyper
cgc

SEQ ID NO: 18853 - DNA, 36 bp, Homo sapiens
  chr5:79864862-79864898
  hyper
acccctggaaccaggcgcgtttcctcagtttttcct

SEQ ID NO: 18854 - DNA, 367 bp, Homo sapiens
  chr5:79865078-79865445
  hyper
gccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 18855 - DNA, 71 bp, Homo sapiens; identical to SEQ ID NO: 2602
  chr5:79865522-79865593
  hyper

SEQ ID NO: 18856 - DNA, 41 bp, Homo sapiens
  chr5:80255775-80255816
  hyper
ttttgtgcatatgtgcgcgcattgtgtttgtgtgcatttgt

SEQ ID NO: 18857 - DNA, 58 bp, Homo sapiens; identical to SEQ ID NO: 7929
  chr5:80256312-80256370
  hyper

SEQ ID NO: 18858 - DNA, 91 bp, Homo sapiens; identical to SEQ ID NO: 7930
  chr5:80256428-80256519
  hyper

SEQ ID NO: 18859 - DNA, 60 bp, Homo sapiens
  chr5:80689735-80689795
  hyper
cccagcccccagccgccgccgctcccgcagccccggtcccgcgcctccccgcagccccgg

SEQ ID NO: 18860 - DNA, 56 bp, Homo sapiens
  chr5:80690062-80690118
  hyper
aggtggtgggagctgcgagtgagggggcccgcactgtcatcccaggactatcgcga

SEQ ID NO: 18861 - DNA, 30 bp, Homo sapiens; identical to SEQ ID NO: 7933
  chr5:81075100-81075130
  hyper

SEQ ID NO: 18862 - DNA, 37 bp, Homo sapiens; identical to SEQ ID NO: 7934
  chr5:82767171-82767208
  hyper

SEQ ID NO: 18863 - DNA, 156 bp, Homo sapiens; identical to SEQ ID NO: 7936
  chr5:82768425-82768581
  hyper

SEQ ID NO: 18864 - DNA, 110 bp, Homo sapiens; identical to SEQ ID NO: 7937
  chr5:82769171-82769281
  hyper

SEQ ID NO: 18865 - DNA, 41 bp, Homo sapiens; identical to SEQ ID NO: 7938
  chr5:82769910-82769951
  hyper

SEQ ID NO: 18866 - DNA, 18 bp, Homo sapiens
  chr5:83679177-83679195
  hyper
ggacaagctgcacctcgc

SEQ ID NO: 18867 - DNA, 31 bp, Homo sapiens
  chr5:87956168-87956199
  hyper
gcaagcgctcaccaacgccggccaccgagca

SEQ ID NO: 18868 - DNA, 142 bp, Homo sapiens
  chr5:87956964-87957106
  hyper
gcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctt

SEQ ID NO: 18869 - DNA, 73 bp, Homo sapiens; identical to SEQ ID NO: 472
  chr5:87970041-87970114
  hyper

SEQ ID NO: 18870 - DNA, 78 bp, Homo sapiens
  chr5:87970115-87970193
  hyper
ggggtgcggggaggcggtgcaggaatccgtcccgccgagtgccgtcggcccctgtgggcctgtttgcgcgcctggggc

SEQ ID NO: 18871 - DNA, 35 bp, Homo sapiens
  chr5:87970872-87970907
  hyper
gcaaaacaccaggccaaatccggcaaggcggcggc

SEQ ID NO: 18872 - DNA, 318 bp, Homo sapiens; identical to SEQ ID NO: 7951
  chr5:87971517-87971835
  hyper

SEQ ID NO: 18873 - DNA, 20 bp, Homo sapiens
  chr5:87974084-87974104
  hyper
aatctcccttattggcgcat

SEQ ID NO: 18874 - DNA, 151 bp, Homo sapiens
  chr5:87974307-87974458
  hyper
ccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaac

SEQ ID NO: 18875 - DNA, 31 bp, Homo sapiens
  chr5:87979725-87979756
  hyper
acttaaaagcccttgcgactccctctgaatt

SEQ ID NO: 18876 - DNA, 73 bp, Homo sapiens
  chr5:87979912-87979985
  hyper
catcagcagctgatcagacatggtaatccaataatttttttgaatacacacaatttttcgttgaagttaattt

SEQ ID NO: 18877 - DNA, 30 bp, Homo sapiens; identical to SEQ ID NO: 7955
  chr5:87985488-87985518
  hyper

SEQ ID NO: 18878 - DNA, 69 bp, Homo sapiens; identical to SEQ ID NO: 7956
  chr5:87985975-87986044
  hyper

SEQ ID NO: 18879 - DNA, 124 bp, Homo sapiens; identical to SEQ ID NO: 474
  chr5:88185263-88185387
  hyper

SEQ ID NO: 18880 - DNA, 82 bp, Homo sapiens
  chr5:88185388-88185470
  hyper
acgagtgggcggccacgctggtttggcgcggggaaggaagggggtgtgccgacttgtatttagttgggggttgtggaagtca

SEQ ID NO: 18881 - DNA, 333 bp, Homo sapiens
  chr5:89854523-89854856
  hyper
cctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccggg

SEQ ID NO: 18882 - DNA, 7 bp, Homo sapiens
  chr5:89854902-89854909
  hyper
ggggcat

SEQ ID NO: 18883 - DNA, 26 bp, Homo sapiens
  chr5:92915099-92915125
  hyper
cgctagggtcacgccgggtcccaggg

SEQ ID NO: 18884 - DNA, 12 bp, Homo sapiens
  chr5:92940177-92940189
  hyper
ggggtgggccgg

SEQ ID NO: 18885 - DNA, 73 bp, Homo sapiens; identical to SEQ ID NO: 7963
  chr5:94621061-94621134
  hyper

SEQ ID NO: 18886 - DNA, 66 bp, Homo sapiens
  chr5:94955615-94955681
  hyper
ggatgaggttctcagcgcccaggggtccgcggcttccgcgagggtagcgtcgggggccgctgcaga

SEQ ID NO: 18887 - DNA, 241 bp, Homo sapiens
  chr5:94955919-94956160
  hyper
actttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaaca

SEQ ID NO: 18888 - DNA, 329 bp, Homo sapiens
  chr5:94956606-94956935
  hyper
gcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgc

SEQ ID NO: 18889 - DNA, 92 bp, Homo sapiens
  chr5:94957000-94957092
  hyper
cgatggccaacagcgctctcaatcccttcgtctacctcttcttccaggcgggcgactgccggctccggcgacagctgcggaagcggctgggc

SEQ ID NO: 18890 - DNA, 130 bp, Homo sapiens
  chr5:100236552-100236682
  hyper
tcattctttccccctcgccgccggcgctctggcagcaggggataaccccggtgcgcgcctctcttcctgtttggtttactcaagcgcctgccccaacgccttctcagtcaagctgggaggaaactgcttc

SEQ ID NO: 18891 - DNA, 211 bp, Homo sapiens
  chr5:100236757-100236968
  hyper
aacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctc

SEQ ID NO: 18892 - DNA, 59 bp, Homo sapiens; identical to SEQ ID NO: 7968
  chr5:100237658-100237717
  hyper

SEQ ID NO: 18893 - DNA, 30 bp, Homo sapiens; identical to SEQ ID NO: 7969
  chr5:100238368-100238398
  hyper

SEQ ID NO: 18894 - DNA, 573 bp, Homo sapiens
  chr5:100239151-100239724
  hyper
acatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 18895 - DNA, 141 bp, Homo sapiens; identical to SEQ ID NO: 7974
  chr5:107005171-107005312
  hyper

SEQ ID NO: 18896 - DNA, 479 bp, Homo sapiens; identical to SEQ ID NO: 7975
  chr5:110408719-110409198
  hyper

SEQ ID NO: 18897 - DNA, 46 bp, Homo sapiens; identical to SEQ ID NO: 7976
  chr5:110560287-110560333
  hyper

SEQ ID NO: 18898 - DNA, 62 bp, Homo sapiens
  chr5:112629674-112629736
  hyper
attttaccgatcagggaaataaaagggtgtatataaattagtggaagcgggtgggaaggaac

SEQ ID NO: 18899 - DNA, 34 bp, Homo sapiens; identical to SEQ ID NO: 7978
  chr5:112824097-112824131
  hyper

SEQ ID NO: 18900 - DNA, 229 bp, Homo sapiens; identical to SEQ ID NO: 7981
  chr5:113696982-113697211
  hyper

SEQ ID NO: 18901 - DNA, 251 bp, Homo sapiens; identical to SEQ ID NO: 7982
  chr5:113697471-113697722
  hyper

SEQ ID NO: 18902 - DNA, 87 bp, Homo sapiens; identical to SEQ ID NO: 7983
  chr5:113698053-113698140
  hyper

SEQ ID NO: 18903 - DNA, 7 bp, Homo sapiens
  chr5:113698141-113698148
  hyper
cacctcc

SEQ ID NO: 18904 - DNA, 175 bp, Homo sapiens
  chr5:113698392-113698567
  hyper
accaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgca

SEQ ID NO: 18905 - DNA, 156 bp, Homo sapiens; identical to SEQ ID NO: 7987
  chr5:113699401-113699557
  hyper

SEQ ID NO: 18906 - DNA, 168 bp, Homo sapiens; identical to SEQ ID NO: 7990
  chr5:114515948-114516116
  hyper

SEQ ID NO: 18907 - DNA, 82 bp, Homo sapiens
  chr5:115151185-115151267
  hyper
cgaatatttaatctgcgaaacttggcagtggatttgaataaacccacagtcggggaagttagttaaattggtttgggaaagg

SEQ ID NO: 18908 - DNA, 39 bp, Homo sapiens
  chr5:115152638-115152677
  hyper
cacctccgccgctgtggttcgcgacgctgggacgtagac

SEQ ID NO: 18909 - DNA, 6 bp, Homo sapiens
  chr5:115297186-115297192
  hyper
agactc

SEQ ID NO: 18910 - DNA, 204 bp, Homo sapiens
  chr5:115298781-115298985
  hyper
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgt

SEQ ID NO: 18911 - DNA, 30 bp, Homo sapiens; identical to SEQ ID NO: 7998
  chr5:115911931-115911961
  hyper

SEQ ID NO: 18912 - DNA, 30 bp, Homo sapiens; identical to SEQ ID NO: 7999
  chr5:119800264-119800294
  hyper

SEQ ID NO: 18913 - DNA, 326 bp, Homo sapiens; identical to SEQ ID NO: 8000
  chr5:119800576-119800902
  hyper

SEQ ID NO: 18914 - DNA, 143 bp, Homo sapiens
  chr5:119801156-119801299
  hyper
tttcctatcccacttcggttcagccctactcccgcccgcccctagccccaggtgatccagatggaaagaagcagagaaggtgtcagggctgaggctgcgtaactcaggcggcggctccgggcgggggcgggggccgggctggg

SEQ ID NO: 18915 - DNA, 23 bp, Homo sapiens
  chr5:119801445-119801468
  hyper
tagaacttcgaaggtggcggtgg

SEQ ID NO: 18916 - DNA, 81 bp, Homo sapiens; identical to SEQ ID NO: 8002
  chr5:121412825-121412906
  hyper

SEQ ID NO: 18917 - DNA, 148 bp, Homo sapiens; identical to SEQ ID NO: 8003
  chr5:121413157-121413305
  hyper

SEQ ID NO: 18918 - DNA, 55 bp, Homo sapiens; identical to SEQ ID NO: 8004
  chr5:121647480-121647535
  hyper

SEQ ID NO: 18919 - DNA, 154 bp, Homo sapiens; identical to SEQ ID NO: 8007
  chr5:122423874-122424028
  hyper

SEQ ID NO: 18920 - DNA, 78 bp, Homo sapiens; identical to SEQ ID NO: 8008
  chr5:122424436-122424514
  hyper

SEQ ID NO: 18921 - DNA, 164 bp, Homo sapiens
  chr5:122425168-122425332
  hyper
tcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacg

SEQ ID NO: 18922 - DNA, 79 bp, Homo sapiens; identical to SEQ ID NO: 8010
  chr5:122425562-122425641
  hyper

SEQ ID NO: 18923 - DNA, 162 bp, Homo sapiens; identical to SEQ ID NO: 8011
  chr5:122425701-122425863
  hyper

SEQ ID NO: 18924 - DNA, 182 bp, Homo sapiens; identical to SEQ ID NO: 8012
  chr5:122426164-122426346
  hyper

SEQ ID NO: 18925 - DNA, 44 bp, Homo sapiens; identical to SEQ ID NO: 8013
  chr5:122426805-122426849
  hyper

SEQ ID NO: 18926 - DNA, 80 bp, Homo sapiens; identical to SEQ ID NO: 8014
  chr5:122430755-122430835
  hyper

SEQ ID NO: 18927 - DNA, 8 bp, Homo sapiens
  chr5:122431378-122431386
  hyper
gcaggctt

SEQ ID NO: 18928 - DNA, 28 bp, Homo sapiens
  chr5:122434500-122434528
  hyper
tccagaacagcaccccggtcccccaccc

SEQ ID NO: 18929 - DNA, 15 bp, Homo sapiens
  chr5:122434605-122434620
  hyper
cgcccttggagtcct

SEQ ID NO: 18930 - DNA, 311 bp, Homo sapiens; identical to SEQ ID NO: 8018
  chr5:125930586-125930897
  hyper

SEQ ID NO: 18931 - DNA, 265 bp, Homo sapiens
  chr5:127874183-127874448
  hyper
tggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgt

SEQ ID NO: 18932 - DNA, 104 bp, Homo sapiens
  chr5:127874839-127874943
  hyper
ggctgggagtttccagattgaaatgcgccctccaccaccaagagggagctcacgcggccgcggggggccgaggcagccagccggcgccgcggtcctggggagtc

SEQ ID NO: 18933 - DNA, 25 bp, Homo sapiens
  chr5:128300655-128300680
  hyper
tggatgacctttgtgcgacactgtt

SEQ ID NO: 18934 - DNA, 193 bp, Homo sapiens; identical to SEQ ID NO: 8026
  chr5:128301033-128301226
  hyper

SEQ ID NO: 18935 - DNA, 339 bp, Homo sapiens
  chr5:128795742-128796081
  hyper
cagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgc

SEQ ID NO: 18936 - DNA, 220 bp, Homo sapiens
  chr5:128796244-128796464
  hyper
gcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgat

SEQ ID NO: 18937 - DNA, 51 bp, Homo sapiens
  chr5:128796816-128796867
  hyper
cgaggagtgggaagtcgtgtttcctgcgctctggcgccgggagccggtgga

SEQ ID NO: 18938 - DNA, 359 bp, Homo sapiens
  chr5:128796985-128797344
  hyper
gtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatc

SEQ ID NO: 18939 - DNA, 84 bp, Homo sapiens
  chr5:128797386-128797470
  hyper
caccggagctgtgctgcggcaccctggctcgctggcttctttcagcacctgtggaggtggcctggtaagcgccttctttcccta

SEQ ID NO: 18940 - DNA, 37 bp, Homo sapiens; identical to SEQ ID NO: 8030
  chr5:129241413-129241450
  hyper

SEQ ID NO: 18941 - DNA, 338 bp, Homo sapiens; identical to SEQ ID NO: 8031
  chr5:131346877-131347215
  hyper

SEQ ID NO: 18942 - DNA, 30 bp, Homo sapiens; identical to SEQ ID NO: 8032
  chr5:131593289-131593319
  hyper

SEQ ID NO: 18943 - DNA, 136 bp, Homo sapiens
  chr5:131992157-131992293
  hyper
cccccctatctccgcgggccatcgccgccgcaaccgccgcgccagcgccttctcccacgcgcgggggcgcccctgcccaccgctcccggcagggcttttggtggccatgggggataaggggcgttgactcacccgg

SEQ ID NO: 18944 - DNA, 65 bp, Homo sapiens; identical to SEQ ID NO: 8034
  chr5:132947112-132947177
  hyper

SEQ ID NO: 18945 - DNA, 693 bp, Homo sapiens
  chr5:132947836-132948529
  hyper
gggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 18946 - DNA, 107 bp, Homo sapiens; identical to SEQ ID NO: 8036
  chr5:133449736-133449843
  hyper

SEQ ID NO: 18947 - DNA, 248 bp, Homo sapiens
  chr5:134375210-134375458
  hyper
gcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttc

SEQ ID NO: 18948 - DNA, 252 bp, Homo sapiens
  chr5:134870528-134870780
  hyper
cggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggct

SEQ ID NO: 18949 - DNA, 180 bp, Homo sapiens; identical to SEQ ID NO: 8045
  chr5:134914251-134914431
  hyper

SEQ ID NO: 18950 - DNA, 4 bp, Homo sapiens
  chr5:134914748-134914752
  hyper
atat

SEQ ID NO: 18951 - DNA, 37 bp, Homo sapiens; identical to SEQ ID NO: 8047
  chr5:135170325-135170362
  hyper

SEQ ID NO: 18952 - DNA, 30 bp, Homo sapiens; identical to SEQ ID NO: 8048
  chr5:135171026-135171056
  hyper

SEQ ID NO: 18953 - DNA, 93 bp, Homo sapiens
  chr5:135265767-135265860
  hyper
gtgtggagtcacaggcaggtggccacggggaattagctgaagaccagcaggcaggaagcctcccacatgccacctaaggggcgctcccggaac

SEQ ID NO: 18954 - DNA, 12 bp, Homo sapiens
  chr5:135265919-135265931
  hyper
cgccaggtgggc

SEQ ID NO: 18955 - DNA, 182 bp, Homo sapiens
  chr5:135265932-135266114
  hyper
ccatcgccgcggcctgctgggggaggcggcctttgaggagcgggcgcgaggcggggccaggcggggcggggccttgggcggctgcggtctgcgcggacccccgtgcctaggcgctcctgtgcctccagtgcgcggagccggcctcgctcgggcgtgttcctgcgccgaccggacggccggac

SEQ ID NO: 18956 - DNA, 15 bp, Homo sapiens
  chr5:135266672-135266687
  hyper
cgagtgtgcctttta

SEQ ID NO: 18957 - DNA, 49 bp, Homo sapiens; identical to SEQ ID NO: 8053
  chr5:135527945-135527994
  hyper

SEQ ID NO: 18958 - DNA, 421 bp, Homo sapiens
  chr5:135528233-135528654
  hyper
ccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctga

SEQ ID NO: 18959 - DNA, 17 bp, Homo sapiens
  chr5:136834033-136834050
  hyper
cccagggccgggtggcg

SEQ ID NO: 18960 - DNA, 53 bp, Homo sapiens; identical to SEQ ID NO: 8057
  chr5:136834828-136834881
  hyper

SEQ ID NO: 18961 - DNA, 7 bp, Homo sapiens
  chr5:136834912-136834919
  hyper
cgcggca

SEQ ID NO: 18962 - DNA, 1 bp, Homo sapiens
  chr5:137225091-137225092
  hyper
c

SEQ ID NO: 18963 - DNA, 86 bp, Homo sapiens; identical to SEQ ID NO: 8060
  chr5:137577679-137577765
  hyper

SEQ ID NO: 18964 - DNA, 9 bp, Homo sapiens
  chr5:139048162-139048171
  hyper
gggagccag

SEQ ID NO: 18965 - DNA, 44 bp, Homo sapiens; identical to SEQ ID NO: 8062
  chr5:139175833-139175877
  hyper

SEQ ID NO: 18966 - DNA, 21 bp, Homo sapiens
  chr5:139175929-139175950
  hyper
cgtgtgcgtggggggtgccag

SEQ ID NO: 18967 - DNA, 11 bp, Homo sapiens
  chr5:139227762-139227773
  hyper
cgacagcgagt

SEQ ID NO: 18968 - DNA, 12 bp, Homo sapiens
  chr5:139227909-139227921
  hyper
ggtctcgtactc

SEQ ID NO: 18969 - DNA, 305 bp, Homo sapiens
  chr5:139525423-139525728
  hyper
cagttcccagcctcccgccagattcttgcgtgacctcgggcggcacccagtgctgctgtggacagctcattccgccgcggcggcggctgcggctgcggcggctacaacggctcccggcgtgtccccggcgccgccagggggcgaatggggtgcccgccggctcctcggactccgggcgcgccggcactgcgctccggagaggcccggccagggaagaagcaacttccctccgccgccgcagaccagccgggcagagacttccagccccaccctcaagccctctcggtggctctgtgcgcccaggc

SEQ ID NO: 18970 - DNA, 93 bp, Homo sapiens; identical to SEQ ID NO: 8066
  chr5:140012165-140012258
  hyper

SEQ ID NO: 18971 - DNA, 173 bp, Homo sapiens
  chr5:140305805-140305978
  hyper
cctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccaca

SEQ ID NO: 18972 - DNA, 30 bp, Homo sapiens; identical to SEQ ID NO: 8071
  chr5:140345497-140345527
  hyper

SEQ ID NO: 18973 - DNA, 30 bp, Homo sapiens; identical to SEQ ID NO: 8072
  chr5:140346719-140346749
  hyper

SEQ ID NO: 18974 - DNA, 30 bp, Homo sapiens; identical to SEQ ID NO: 8074
  chr5:140593316-140593346
  hyper

SEQ ID NO: 18975 - DNA, 15 bp, Homo sapiens
  chr5:140614383-140614398
  hyper
cgagcagctggaccg

SEQ ID NO: 18976 - DNA, 182 bp, Homo sapiens
  chr5:140777487-140777669
  hyper
cgcgcagccgcagcgcgctttccagggcagccccagctcagactccccagcgccggcctttacaccgcttcctcctcggaaaaagaatcgtttcctaaactggaactggaactaaagcccgttcggagatccaaaaatctacaatacagaggttatttgtaacctggcgtctccaggctggt

SEQ ID NO: 18977 - DNA, 97 bp, Homo sapiens; identical to SEQ ID NO: 8079
  chr5:140797493-140797590
  hyper

SEQ ID NO: 18978 - DNA, 16 bp, Homo sapiens
  chr5:140801246-140801262
  hyper
gcgatttgctcttcct

SEQ ID NO: 18979 - DNA, 11 bp, Homo sapiens
  chr5:140856622-140856633
  hyper
gacaccaaact

SEQ ID NO: 18980 - DNA, 317 bp, Homo sapiens
  chr5:141262718-141263035
  hyper
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagca

SEQ ID NO: 18981 - DNA, 36 bp, Homo sapiens; identical to SEQ ID NO: 8085
  chr5:141293999-141294035
  hyper

SEQ ID NO: 18982 - DNA, 10 bp, Homo sapiens
  chr5:141931330-141931340
  hyper
ctcacttctc

SEQ ID NO: 18983 - DNA, 101 bp, Homo sapiens; identical to SEQ ID NO: 8088
  chr5:142781774-142781875
  hyper

SEQ ID NO: 18984 - DNA, 136 bp, Homo sapiens; identical to SEQ ID NO: 8089
  chr5:143584941-143585077
  hyper

SEQ ID NO: 18985 - DNA, 4 bp, Homo sapiens
  chr5:145713641-145713645
  hyper
cgtg

SEQ ID NO: 18986 - DNA, 181 bp, Homo sapiens
  chr5:145716994-145717175
  hyper
cggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggt

SEQ ID NO: 18987 - DNA, 187 bp, Homo sapiens; identical to SEQ ID NO: 8093
  chr5:145717842-145718029
  hyper

SEQ ID NO: 18988 - DNA, 12 bp, Homo sapiens
  chr5:145719925-145719937
  hyper
ccttaaaaagaa

SEQ ID NO: 18989 - DNA, 280 bp, Homo sapiens; identical to SEQ ID NO: 2659
  chr5:145720018-145720298
  hyper

SEQ ID NO: 18990 - DNA, 161 bp, Homo sapiens; identical to SEQ ID NO: 8100
  chr5:145723309-145723470
  hyper

SEQ ID NO: 18991 - DNA, 82 bp, Homo sapiens
  chr5:145724420-145724502
  hyper
tgagaagcttggccccggtcagcggctccaggagcccggaacctcctccctggcggaatcccgggcaccattcagccttttc

SEQ ID NO: 18992 - DNA, 34 bp, Homo sapiens; identical to SEQ ID NO: 8102
  chr5:145724804-145724838
  hyper

SEQ ID NO: 18993 - DNA, 183 bp, Homo sapiens
  chr5:146257602-146257785
  hyper
ttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagag

SEQ ID NO: 18994 - DNA, 30 bp, Homo sapiens; identical to SEQ ID NO: 8106
  chr5:146258370-146258400
  hyper

SEQ ID NO: 18995 - DNA, 309 bp, Homo sapiens; identical to SEQ ID NO: 8107
  chr5:146888874-146889183
  hyper

SEQ ID NO: 18996 - DNA, 160 bp, Homo sapiens; identical to SEQ ID NO: 8110
  chr5:148206272-148206432
  hyper

SEQ ID NO: 18997 - DNA, 299 bp, Homo sapiens; identical to SEQ ID NO: 8111
  chr5:148651823-148652122
  hyper

SEQ ID NO: 18998 - DNA, 71 bp, Homo sapiens; identical to SEQ ID NO: 8112
  chr5:149569700-149569771
  hyper

SEQ ID NO: 18999 - DNA, 13 bp, Homo sapiens
  chr5:149682061-149682074
  hyper
gtccagtgtctgg

SEQ ID NO: 19000 - DNA, 138 bp, Homo sapiens
  chr5:150399985-150400123
  hyper
tgcttatgtcactgtcgccccgggacggggaggtggggagctgagggcaagtcgcgcccgcccctgaaatcccagccgcctagcgattggctgcaagggtctcggcttggccgcggattggtcacacccgagggcttg

SEQ ID NO: 19001 - DNA, 206 bp, Homo sapiens
  chr5:150400203-150400409
  hyper
ccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaat

SEQ ID NO: 19002 - DNA, 7 bp, Homo sapiens
  chr5:151066474-151066481
  hyper
ctgaagg

SEQ ID NO: 19003 - DNA, 147 bp, Homo sapiens
  chr5:151304224-151304371
  hyper
ggcggggaacaggggcgcggagggagagccccaggggaaattggagcgagggggtcgtagataccacggacagcggcggctgcgaggcgtttcagcaccacggagagcgtccagacctgcttttcaggagcgcgaagagtattgctg

SEQ ID NO: 19004 - DNA, 238 bp, Homo sapiens
  chr5:151304401-151304639
  hyper
cctgcggcgctggggaggcacgtttgggggtgggtatatttccttttttttttttttttttttaaacccctgtttttctgtttaaacggccagctccctgcaaggaaaaaaatcttctgtggagatcagagcgctggcctcggaccgttggattgggcgagcatcttgggtaaagagaacagagctttatggctctgggccggcctgagggggttaggggcgaggggaaagcggttga

SEQ ID NO: 19005 - DNA, 33 bp, Homo sapiens; identical to SEQ ID NO: 8118
  chr5:151304708-151304741
  hyper

SEQ ID NO: 19006 - DNA, 97 bp, Homo sapiens; identical to SEQ ID NO: 2664
  chr5:152870193-152870290
  hyper

SEQ ID NO: 19007 - DNA, 27 bp, Homo sapiens
  chr5:153853277-153853304
  hyper
gcccgcgtggcctctcggcccctgcta

SEQ ID NO: 19008 - DNA, 34 bp, Homo sapiens
  chr5:153853386-153853420
  hyper
cgaggccctgccccggagctgcctgaggtctcct

SEQ ID NO: 19009 - DNA, 41 bp, Homo sapiens
  chr5:153853478-153853519
  hyper
agcctcacgggtctcccctcctccttcgcagtgagcgccgc

SEQ ID NO: 19010 - DNA, 36 bp, Homo sapiens; identical to SEQ ID NO: 8126
  chr5:153856624-153856660
  hyper

SEQ ID NO: 19011 - DNA, 109 bp, Homo sapiens
  chr5:153856996-153857105
  hyper
ggctggagcatgcaagccccaggactcaccagctcccttttccgcttgctctcacggccgccatccgccttcttgagttcagccttgaaggcctcgggatcgccagact

SEQ ID NO: 19012 - DNA, 30 bp, Homo sapiens; identical to SEQ ID NO: 8128
  chr5:153857851-153857881
  hyper

SEQ ID NO: 19013 - DNA, 17 bp, Homo sapiens
  chr5:153858878-153858895
  hyper
agactgcacagcatccg

SEQ ID NO: 19014 - DNA, 18 bp, Homo sapiens
  chr5:153858916-153858934
  hyper
cgacgtccggcatctctc

SEQ ID NO: 19015 - DNA, 23 bp, Homo sapiens
  chr5:153863394-153863417
  hyper
gagagatgtctgcttcgggacgc

SEQ ID NO: 19016 - DNA, 3 bp, Homo sapiens
  chr5:153863418-153863421
  hyper
ttc

SEQ ID NO: 19017 - DNA, 53 bp, Homo sapiens; identical to SEQ ID NO: 8136
  chr5:153990970-153991023
  hyper

SEQ ID NO: 19018 - DNA, 406 bp, Homo sapiens
  chr5:155107388-155107794
  hyper
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcac

SEQ ID NO: 19019 - DNA, 86 bp, Homo sapiens
  chr5:155108763-155108849
  hyper
aaaggggctccctagagcagatcgctgacttcctcaccaacgtgccatttggggcttttcagccgcccgcgcgttaagctagctcc

SEQ ID NO: 19020 - DNA, 240 bp, Homo sapiens; identical to SEQ ID NO: 8140
  chr5:155109207-155109447
  hyper

SEQ ID NO: 19021 - DNA, 259 bp, Homo sapiens; identical to SEQ ID NO: 8141
  chr5:156887194-156887453
  hyper

SEQ ID NO: 19022 - DNA, 15 bp, Homo sapiens
  chr5:157001843-157001858
  hyper
cgcttcacagaaggg

SEQ ID NO: 19023 - DNA, 18 bp, Homo sapiens
  chr5:157098344-157098362
  hyper
cacttcttccagacccgt

SEQ ID NO: 19024 - DNA, 40 bp, Homo sapiens
  chr5:157098619-157098659
  hyper
gcaatgacacagccgactaggccctcggtcacctgtgacc

SEQ ID NO: 19025 - DNA, 1 bp, Homo sapiens
  chr5:158478465-158478466
  hyper
g

SEQ ID NO: 19026 - DNA, 24 bp, Homo sapiens
  chr5:158478764-158478788
  hyper
agccgatcccgctttgcagttgtg

SEQ ID NO: 19027 - DNA, 6 bp, Homo sapiens
  chr5:158524686-158524692
  hyper
atgtgg

SEQ ID NO: 19028 - DNA, 1 bp, Homo sapiens
  chr5:158527442-158527443
  hyper
t

SEQ ID NO: 19029 - DNA, 88 bp, Homo sapiens; identical to SEQ ID NO: 8149
  chr5:158533565-158533653
  hyper

SEQ ID NO: 19030 - DNA, 23 bp, Homo sapiens
  chr5:159399072-159399095
  hyper
tcgcctgggcggctgcgcctaca

SEQ ID NO: 19031 - DNA, 262 bp, Homo sapiens; identical to SEQ ID NO: 8151
  chr5:160973528-160973790
  hyper

SEQ ID NO: 19032 - DNA, 40 bp, Homo sapiens; identical to SEQ ID NO: 8152
  chr5:160974819-160974859
  hyper

SEQ ID NO: 19033 - DNA, 235 bp, Homo sapiens; identical to SEQ ID NO: 8153
  chr5:160975112-160975347
  hyper

SEQ ID NO: 19034 - DNA, 100 bp, Homo sapiens; identical to SEQ ID NO: 8154
  chr5:160975348-160975448
  hyper

SEQ ID NO: 19035 - DNA, 180 bp, Homo sapiens
  chr5:160975754-160975934
  hyper
aactagacagcctacactccgaagtctcctgagtcagcgaccttgcccgctgccagcgctttgctgtggcgggtcaagctcctggcgcccgaggagcccgcggcggctgcgggtggagttgagcgcggaccgcacgagctagacccggccggtgtctgcggagaggaggggtcgccggcc

SEQ ID NO: 19036 - DNA, 15 bp, Homo sapiens
  chr5:160975955-160975970
  hyper
cggaagtagctccac

SEQ ID NO: 19037 - DNA, 30 bp, Homo sapiens; identical to SEQ ID NO: 8157
  chr5:161274605-161274635
  hyper

SEQ ID NO: 19038 - DNA, 30 bp, Homo sapiens; identical to SEQ ID NO: 8158
  chr5:162931253-162931283
  hyper

SEQ ID NO: 19039 - DNA, 79 bp, Homo sapiens; identical to SEQ ID NO: 8159
  chr5:162931522-162931601
  hyper

SEQ ID NO: 19040 - DNA, 37 bp, Homo sapiens; identical to SEQ ID NO: 8160
  chr5:166405784-166405821
  hyper

SEQ ID NO: 19041 - DNA, 30 bp, Homo sapiens; identical to SEQ ID NO: 8161
  chr5:166406285-166406315
  hyper

SEQ ID NO: 19042 - DNA, 87 bp, Homo sapiens
  chr5:167956090-167956177
  hyper
tggcacagccaggaccgacgctgatgcttacctccccctctcctgcagcagagacgcccccgtccctgtggcccagggaagtgccag

SEQ ID NO: 19043 - DNA, 42 bp, Homo sapiens; identical to SEQ ID NO: 8164
  chr5:168727504-168727546
  hyper

SEQ ID NO: 19044 - DNA, 82 bp, Homo sapiens; identical to SEQ ID NO: 8166
  chr5:168727994-168728076
  hyper

SEQ ID NO: 19045 - DNA, 35 bp, Homo sapiens; identical to SEQ ID NO: 8167
  chr5:168728077-168728112
  hyper

SEQ ID NO: 19046 - DNA, 30 bp, Homo sapiens; identical to SEQ ID NO: 8168
  chr5:168728323-168728353
  hyper

SEQ ID NO: 19047 - DNA, 63 bp, Homo sapiens; identical to SEQ ID NO: 8169
  chr5:169064022-169064085
  hyper

SEQ ID NO: 19048 - DNA, 32 bp, Homo sapiens
  chr5:169064295-169064327
  hyper
ttccccacgggaggacgcgaggccccggccca

SEQ ID NO: 19049 - DNA, 38 bp, Homo sapiens; identical to SEQ ID NO: 8172
  chr5:169931409-169931447
  hyper

SEQ ID NO: 19050 - DNA, 253 bp, Homo sapiens
  chr5:170108034-170108287
  hyper
ccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccga

SEQ ID NO: 19051 - DNA, 40 bp, Homo sapiens
  chr5:170108372-170108412
  hyper
tgaaatgtggtgcgcctggggagtgcgggagccaggaagt

SEQ ID NO: 19052 - DNA, 23 bp, Homo sapiens
  chr5:170735131-170735154
  hyper
ggaagaaaatgattccgcttgtc

SEQ ID NO: 19053 - DNA, 25 bp, Homo sapiens
  chr5:170735206-170735231
  hyper
tgccctgggccgggtagacagtcac

SEQ ID NO: 19054 - DNA, 256 bp, Homo sapiens
  chr5:170737479-170737735
  hyper
ttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcacttgatttcctctcacccacccccgccccaaacacacag

SEQ ID NO: 19055 - DNA, 342 bp, Homo sapiens
  chr5:170739481-170739823
  hyper
tccacctggggggtgggaggcagggtggcctcgaacttcttagagctcaagtcggaactcggagccccacttcaccccgcaactcgctttccgccctctttttcccgcggagcctcagagaggacctggctctggccagtctgcgcgcgctgtgggcaggctttgcgcgcagagccgctgcaaatcctcggtctccaaacgcctggggagcaaatgcagcgcacaaccctaggggccctctccttgtcgggtttgcgtgggaccccaggtggagcgtgacgtcatgtgacgtcaccgcagcccccgcggtgtcactgggctggagtgggcggggcgcccgga

SEQ ID NO: 19056 - DNA, 6 bp, Homo sapiens
  chr5:170740455-170740461
  hyper
aaggca

SEQ ID NO: 19057 - DNA, 30 bp, Homo sapiens; identical to SEQ ID NO: 8190
  chr5:170745324-170745354
  hyper

SEQ ID NO: 19058 - DNA, 28 bp, Homo sapiens
  chr5:172655851-172655879
  hyper
cgctgggcctgagctcggaatgcttccc

SEQ ID NO: 19059 - DNA, 146 bp, Homo sapiens
  chr5:172661684-172661830
  hyper
tggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaa

SEQ ID NO: 19060 - DNA, 157 bp, Homo sapiens; identical to SEQ ID NO: 8198
  chr5:172662041-172662198
  hyper

SEQ ID NO: 19061 - DNA, 81 bp, Homo sapiens
  chr5:172664487-172664568
  hyper
ctgctggccaggcggctcgcgatgacagtttgaaagattagtgtgagcggacgcctgaaatattaccgtttaatgggggac

SEQ ID NO: 19062 - DNA, 49 bp, Homo sapiens
  chr5:172665812-172665861
  hyper
cctccgcctccgcctccgcgctgggcccctccgccgcccggcttccttc

SEQ ID NO: 19063 - DNA, 50 bp, Homo sapiens
  chr5:172670933-172670983
  hyper
ccaccccttctgccccgacggctgcaaaccgcttcagccaaaacgggcgg

SEQ ID NO: 19064 - DNA, 64 bp, Homo sapiens
  chr5:172671018-172671082
  hyper
ctcggagtcccgtcgctggaggtcacagctgggaaaatcaggtgacattcgagtcagatggaca

SEQ ID NO: 19065 - DNA, 92 bp, Homo sapiens; identical to SEQ ID NO: 8204
  chr5:172672801-172672893
  hyper

SEQ ID NO: 19066 - DNA, 26 bp, Homo sapiens
  chr5:172754563-172754589
  hyper
aaagttctgggatgtcgggcatcttt

SEQ ID NO: 19067 - DNA, 211 bp, Homo sapiens
  chr5:172754621-172754832
  hyper
ggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttc

SEQ ID NO: 19068 - DNA, 671 bp, Homo sapiens
  chr5:172756377-172757048
  hyper
caaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccagg

SEQ ID NO: 19069 - DNA, 55 bp, Homo sapiens; identical to SEQ ID NO: 8210
  chr5:174119987-174120042
  hyper

SEQ ID NO: 19070 - DNA, 95 bp, Homo sapiens
  chr5:174147428-174147523
  hyper
ctctctgcgcctggacgacttcatctgtggaatggggagaaagctcaggctttagggggccttcagtaatctgcatcgtgcttttggcaaaagct

SEQ ID NO: 19071 - DNA, 37 bp, Homo sapiens; identical to SEQ ID NO: 8213
  chr5:174162509-174162546
  hyper

SEQ ID NO: 19072 - DNA, 30 bp, Homo sapiens; identical to SEQ ID NO: 8214
  chr5:174162799-174162829
  hyper

SEQ ID NO: 19073 - DNA, 120 bp, Homo sapiens; identical to SEQ ID NO: 8215
  chr5:174178667-174178787
  hyper

SEQ ID NO: 19074 - DNA, 388 bp, Homo sapiens
  chr5:174870786-174871174
  hyper
gcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcacc

SEQ ID NO: 19075 - DNA, 381 bp, Homo sapiens
  chr5:174871497-174871878
  hyper
acccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtg

SEQ ID NO: 19076 - DNA, 73 bp, Homo sapiens
  chr5:175085074-175085147
  hyper
catccctgcccggagcgcagccggcgcgggcgcgggaccgaggcgaaccgggtgcggagccaatacccgcggc

SEQ ID NO: 19077 - DNA, 106 bp, Homo sapiens
  chr5:175085209-175085315
  hyper
ggcgggcttggggacccggcgtgggctggcggagccgcccgaggggctgctcgggatccccggcggccgtcgtggccccgaacccgggttcgagcctcggccccac

SEQ ID NO: 19078 - DNA, 30 bp, Homo sapiens; identical to SEQ ID NO: 2706
  chr5:175223920-175223950
  hyper

SEQ ID NO: 19079 - DNA, 92 bp, Homo sapiens; identical to SEQ ID NO: 8220
  chr5:175224643-175224735
  hyper

SEQ ID NO: 19080 - DNA, 40 bp, Homo sapiens; identical to SEQ ID NO: 8222
  chr5:175298910-175298950
  hyper

SEQ ID NO: 19081 - DNA, 161 bp, Homo sapiens; identical to SEQ ID NO: 8224
  chr5:175299980-175300141
  hyper

SEQ ID NO: 19082 - DNA, 29 bp, Homo sapiens
  chr5:175300142-175300171
  hyper
cagggatagaccaaggcttcccgcagaat

SEQ ID NO: 19083 - DNA, 135 bp, Homo sapiens
  chr5:175300216-175300351
  hyper
cggcaacctgctggacctcagcactcccgcaggcatatggcaaaacatacacacacacacaccctgcacacacgcacgcactcacacgatgtctaagtccagagttgcacacacggggtcatactttcaacgcac

SEQ ID NO: 19084 - DNA, 31 bp, Homo sapiens
  chr5:175300381-175300412
  hyper
ttcaacccggcacacacgtcctcaggatcta

SEQ ID NO: 19085 - DNA, 42 bp, Homo sapiens; identical to SEQ ID NO: 8227
  chr5:175488184-175488226
  hyper

SEQ ID NO: 19086 - DNA, 180 bp, Homo sapiens; identical to SEQ ID NO: 8228
  chr5:175560567-175560747
  hyper

SEQ ID NO: 19087 - DNA, 11 bp, Homo sapiens
  chr5:175621379-175621390
  hyper
tctccaagctg

SEQ ID NO: 19088 - DNA, 101 bp, Homo sapiens; identical to SEQ ID NO: 8230
  chr5:175792208-175792309
  hyper

SEQ ID NO: 19089 - DNA, 1 bp, Homo sapiens
  chr5:175792864-175792865
  hyper
c

SEQ ID NO: 19090 - DNA, 30 bp, Homo sapiens; identical to SEQ ID NO: 8234
  chr5:176038550-176038580
  hyper

SEQ ID NO: 19091 - DNA, 57 bp, Homo sapiens
  chr5:176046306-176046363
  hyper
gagagagggcctctgcggcaagagggcaggggcggggcctcgcgcagggactgccta

SEQ ID NO: 19092 - DNA, 24 bp, Homo sapiens
  chr5:176046554-176046578
  hyper
cggcgccttcgtgggggtgggagg

SEQ ID NO: 19093 - DNA, 458 bp, Homo sapiens; identical to SEQ ID NO: 2708
  chr5:176056505-176056963
  hyper

SEQ ID NO: 19094 - DNA, 103 bp, Homo sapiens; identical to SEQ ID NO: 8237
  chr5:176057411-176057514
  hyper

SEQ ID NO: 19095 - DNA, 95 bp, Homo sapiens; identical to SEQ ID NO: 2711
  chr5:177411327-177411422
  hyper

SEQ ID NO: 19096 - DNA, 15 bp, Homo sapiens
  chr5:177411507-177411522
  hyper
cgcggagatgggcca

SEQ ID NO: 19097 - DNA, 77 bp, Homo sapiens
  chr5:177412141-177412218
  hyper
atcgtaaacggggcaacttccaactctgccagttttaagcttctagagtatctcctcggcggagcgcggtggctcac

SEQ ID NO: 19098 - DNA, 197 bp, Homo sapiens; identical to SEQ ID NO: 8249
  chr5:178450910-178451107
  hyper

SEQ ID NO: 19099 - DNA, 26 bp, Homo sapiens
  chr5:178487398-178487424
  hyper
cggggacagctcgcggcctttcgggg

SEQ ID NO: 19100 - DNA, 30 bp, Homo sapiens; identical to SEQ ID NO: 8252
  chr5:178487700-178487730
  hyper

SEQ ID NO: 19101 - DNA, 81 bp, Homo sapiens; identical to SEQ ID NO: 8253
  chr5:178594307-178594388
  hyper

SEQ ID NO: 19102 - DNA, 100 bp, Homo sapiens; identical to SEQ ID NO: 2716
  chr5:178770805-178770905
  hyper

SEQ ID NO: 19103 - DNA, 116 bp, Homo sapiens
  chr5:178771198-178771314
  hyper
cggagccccagtgcctcagagacccgccggcaagccacgcccccccagaccccgccccactgcgaagggaaggggcattccgccaggcgaccccagaagccagcctgcacctcccc

SEQ ID NO: 19104 - DNA, 3 bp, Homo sapiens
  chr5:178771967-178771970
  hyper
cgc

SEQ ID NO: 19105 - DNA, 21 bp, Homo sapiens
  chr5:178772184-178772205
  hyper
acctacctggggggtcggcgg

SEQ ID NO: 19106 - DNA, 331 bp, Homo sapiens
  chr5:178772272-178772603
  hyper
cagcagcagcagcgcggggcagagcaggcggcgagcggctcccgccggcggatccatggcagccggactgcagccggggccccgcactcgcagccggcgcgaaagttccccgcgagccgcccagcccacatctgggggcagctggagccgcccgcagctgcagcaccgcagggcgcggggcggaggaggcgaggcgcggaggggcgggcgggggagcgcggagggaaggcggggagagggaaggagcgagcgagcgagggaggcaggcgggagggagggaggcgagcgagggggagggcggggacggcgggcgcctcagcctgcggtgacc

SEQ ID NO: 19107 - DNA, 58 bp, Homo sapiens; identical to SEQ ID NO: 2722
  chr5:178772778-178772836
  hyper

SEQ ID NO: 19108 - DNA, 2 bp, Homo sapiens
  chr5:178957944-178957946
  hyper
ac

SEQ ID NO: 19109 - DNA, 22 bp, Homo sapiens
  chr5:179244320-179244342
  hyper
gggcgttcgtcctccatccctc

SEQ ID NO: 19110 - DNA, 135 bp, Homo sapiens; identical to SEQ ID NO: 8263
  chr5:179779648-179779783
  hyper

SEQ ID NO: 19111 - DNA, 173 bp, Homo sapiens; identical to SEQ ID NO: 8264
  chr5:179779840-179780013
  hyper

SEQ ID NO: 19112 - DNA, 69 bp, Homo sapiens
  chr5:179780035-179780104
  hyper
cgggtgaggggcagccaggcccggccgacgacagcccctcggtaggggcccggggcagatcggcgcccc

SEQ ID NO: 19113 - DNA, 118 bp, Homo sapiens
  chr5:179780144-179780262
  hyper
agaggctgcggcgccgggacccgcggacggcgtggaggaggcggctcgggcgggcgcggcactcaccgcacatcgtggctgcttctcgggctccttcgcggctcgagggggtctgccc

SEQ ID NO: 19114 - DNA, 178 bp, Homo sapiens
  chr5:179780528-179780706
  hyper
gtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacgggg

SEQ ID NO: 19115 - DNA, 242 bp, Homo sapiens
  chr5:179780985-179781227
  hyper
ccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcact

SEQ ID NO: 19116 - DNA, 126 bp, Homo sapiens
  chr5:180017198-180017324
  hyper
ttgtcctcaggtgtagatgctccagtctcggctcagccaaacactgtcagggccccctggaaagcagaagccgagcttgagtgcccccagccctgccaccaagaactcaggcgggggcgcggcagc

SEQ ID NO: 19117 - DNA, 72 bp, Homo sapiens
  chr5:180017536-180017608
  hyper
agttttgaggctggccgggaagggatgcccgcgcaggaagggcacccggggtgcccactttaccagcagggc

SEQ ID NO: 19118 - DNA, 199 bp, Homo sapiens
  chr5:180017933-180018132
  hyper
gcgccctgcccggctccccgaccgcccctccctcctgcgccgaggcctgccaggtgcgagcccccgggacacaggcgggtctggggaggcggccccgccaggagacgctgcagggtcaccggagtggcctgagggtggcggaaggaccggtgaactctgtgcagggtccgggacaggcccccaagggaggggacactcg

SEQ ID NO: 19119 - DNA, 112 bp, Homo sapiens
  chr5:180018498-180018610
  hyper
tgcccgggcaaggccacgaggcttcttatacccggtcctcgcccctccagcgccggcctcgcccgcgctcctgagaaagccctgcccgctccgctcacggccgtgccctggc

SEQ ID NO: 19120 - DNA, 32 bp, Homo sapiens
  chr5:180075814-180075846
  hyper
ctgtcccctcaaatccggggacccctggcctt

SEQ ID NO: 19121 - DNA, 141 bp, Homo sapiens
  chr5:180076317-180076458
  hyper
ccgaggtcccgcgccccaagcgccgtgctcccctcaggcgtccgcgcaccagggccaccgtgtcccccgcccgtacccggcggagcggtctcagcgcccgccccaggtgcgcggtaccccctccccggccagccccacgct

SEQ ID NO: 19122 - DNA, 35 bp, Homo sapiens
  chr5:180076532-180076567
  hyper
cgccccgctgcatctccggccgctgcgcgtgggtc

SEQ ID NO: 19123 - DNA, 202 bp, Homo sapiens
  chr5:180076602-180076804
  hyper
ccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcggg

SEQ ID NO: 19124 - DNA, 30 bp, Homo sapiens; identical to SEQ ID NO: 8275
  chr5:180100685-180100715
  hyper

SEQ ID NO: 19125 - DNA, 39 bp, Homo sapiens; identical to SEQ ID NO: 8277
  chr5:180527793-180527832
  hyper

SEQ ID NO: 19126 - DNA, 135 bp, Homo sapiens; identical to SEQ ID NO: 2732
  chr5:180531170-180531305
  hyper

SEQ ID NO: 19127 - DNA, 45 bp, Homo sapiens; identical to SEQ ID NO: 8288
  chr6:1314017-1314062
  hyper

SEQ ID NO: 19128 - DNA, 23 bp, Homo sapiens
  chr6:1378199-1378222
  hyper
catattggaggaagtcggccggc

SEQ ID NO: 19129 - DNA, 123 bp, Homo sapiens; identical to SEQ ID NO: 8290
  chr6:1379267-1379390
  hyper

SEQ ID NO: 19130 - DNA, 363 bp, Homo sapiens; identical to SEQ ID NO: 8291
  chr6:1383078-1383441
  hyper

SEQ ID NO: 19131 - DNA, 54 bp, Homo sapiens
  chr6:1385170-1385224
  hyper
tgcggaaatggggtgaggccggtcttcgcttgagggtctcgtagattggacccc

SEQ ID NO: 19132 - DNA, 63 bp, Homo sapiens; identical to SEQ ID NO: 8297
  chr6:1389953-1390016
  hyper

SEQ ID NO: 19133 - DNA, 283 bp, Homo sapiens
  chr6:1391035-1391318
  hyper
tggccagctgcccggtgcccgcgggacccgggggcgtcggtgcggccgggggcggcggcggcggcgactacgggccggacagcagcagcagcccggtaccctcgtccccggccatggcgagcgccatcgaatgccactcgccctacacgagccctgcggcgcactggagctcgcctggcgcctcgccttacctcaagcagccgcctgccctgacgcccagcagcaaccccgccgcctcggcaggcctgcactccagcatgtcctcctactcgctggagcagag

SEQ ID NO: 19134 - DNA, 27 bp, Homo sapiens
  chr6:1391379-1391406
  hyper
agctgggcgcaccgcttctaggcctcc

SEQ ID NO: 19135 - DNA, 30 bp, Homo sapiens; identical to SEQ ID NO: 8300
  chr6:1605320-1605350
  hyper

SEQ ID NO: 19136 - DNA, 347 bp, Homo sapiens; identical to SEQ ID NO: 8301
  chr6:1611408-1611755
  hyper

SEQ ID NO: 19137 - DNA, 440 bp, Homo sapiens; identical to SEQ ID NO: 8303
  chr6:2903077-2903517
  hyper

SEQ ID NO: 19138 - DNA, 18 bp, Homo sapiens
  chr6:3229011-3229029
  hyper
tttcttatcttccatcgc

SEQ ID NO: 19139 - DNA, 39 bp, Homo sapiens; identical to SEQ ID NO: 8305
  chr6:3231729-3231768
  hyper

SEQ ID NO: 19140 - DNA, 41 bp, Homo sapiens; identical to SEQ ID NO: 8306
  chr6:4775411-4775452
  hyper

SEQ ID NO: 19141 - DNA, 179 bp, Homo sapiens; identical to SEQ ID NO: 8307
  chr6:5086150-5086329
  hyper

SEQ ID NO: 19142 - DNA, 30 bp, Homo sapiens; identical to SEQ ID NO: 8308
  chr6:5851769-5851799
  hyper

SEQ ID NO: 19143 - DNA, 638 bp, Homo sapiens; identical to SEQ ID NO: 8309
  chr6:5996066-5996704
  hyper

SEQ ID NO: 19144 - DNA, 57 bp, Homo sapiens
  chr6:5996989-5997046
  hyper
aaacgaaaccaacaaaatgcaactattttccaaaaccccgagcgtttgctggtgggt

SEQ ID NO: 19145 - DNA, 36 bp, Homo sapiens; identical to SEQ ID NO: 8311
  chr6:5997581-5997617
  hyper

SEQ ID NO: 19146 - DNA, 18 bp, Homo sapiens
  chr6:6003269-6003287
  hyper
aagcctcaggcttggcgc

SEQ ID NO: 19147 - DNA, 275 bp, Homo sapiens
  chr6:6007318-6007593
  hyper
accttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcacc

SEQ ID NO: 19148 - DNA, 30 bp, Homo sapiens; identical to SEQ ID NO: 8319
  chr6:6009468-6009498
  hyper

SEQ ID NO: 19149 - DNA, 95 bp, Homo sapiens; identical to SEQ ID NO: 8320
  chr6:6546546-6546641
  hyper

SEQ ID NO: 19150 - DNA, 296 bp, Homo sapiens; identical to SEQ ID NO: 8321
  chr6:6546926-6547222
  hyper

SEQ ID NO: 19151 - DNA, 123 bp, Homo sapiens; identical to SEQ ID NO: 8322
  chr6:7726824-7726947
  hyper

SEQ ID NO: 19152 - DNA, 377 bp, Homo sapiens
  chr6:7727322-7727699
  hyper
ggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagc

SEQ ID NO: 19153 - DNA, 696 bp, Homo sapiens
  chr6:7728142-7728838
  hyper
tccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgctt

SEQ ID NO: 19154 - DNA, 142 bp, Homo sapiens; identical to SEQ ID NO: 8328
  chr6:10383858-10384000
  hyper

SEQ ID NO: 19155 - DNA, 30 bp, Homo sapiens; identical to SEQ ID NO: 8329
  chr6:10384438-10384468
  hyper

SEQ ID NO: 19156 - DNA, 59 bp, Homo sapiens; identical to SEQ ID NO: 8334
  chr6:10391337-10391396
  hyper

SEQ ID NO: 19157 - DNA, 30 bp, Homo sapiens; identical to SEQ ID NO: 8335
  chr6:10411311-10411341
  hyper

SEQ ID NO: 19158 - DNA, 44 bp, Homo sapiens; identical to SEQ ID NO: 8336
  chr6:10411992-10412036
  hyper

SEQ ID NO: 19159 - DNA, 9 bp, Homo sapiens
  chr6:10419077-10419086
  hyper
tctcctaca

SEQ ID NO: 19160 - DNA, 26 bp, Homo sapiens
  chr6:10419506-10419532
  hyper
gctctcctgggcgctgccaggcgcgc

SEQ ID NO: 19161 - DNA, 38 bp, Homo sapiens; identical to SEQ ID NO: 8345
  chr6:10420118-10420156
  hyper

SEQ ID NO: 19162 - DNA, 26 bp, Homo sapiens
  chr6:10422635-10422661
  hyper
cgctgccaccacgaagcaggttcact

SEQ ID NO: 19163 - DNA, 141 bp, Homo sapiens; identical to SEQ ID NO: 8349
  chr6:10423946-10424087
  hyper

SEQ ID NO: 19164 - DNA, 7 bp, Homo sapiens
  chr6:10882057-10882064
  hyper
gttctga

SEQ ID NO: 19165 - DNA, 35 bp, Homo sapiens; identical to SEQ ID NO: 8354
  chr6:10886917-10886952
  hyper

SEQ ID NO: 19166 - DNA, 184 bp, Homo sapiens
  chr6:11043878-11044062
  hyper
cccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttc

SEQ ID NO: 19167 - DNA, 18 bp, Homo sapiens
  chr6:12750364-12750382
  hyper
gggcgaggttggctggcg

SEQ ID NO: 19168 - DNA, 101 bp, Homo sapiens; identical to SEQ ID NO: 8361
  chr6:13013581-13013682
  hyper

SEQ ID NO: 19169 - DNA, 36 bp, Homo sapiens; identical to SEQ ID NO: 8362
  chr6:13013897-13013933
  hyper

SEQ ID NO: 19170 - DNA, 147 bp, Homo sapiens; identical to SEQ ID NO: 8363
  chr6:13925376-13925523
  hyper

SEQ ID NO: 19171 - DNA, 30 bp, Homo sapiens; identical to SEQ ID NO: 8364
  chr6:18122697-18122727
  hyper

SEQ ID NO: 19172 - DNA, 347 bp, Homo sapiens; identical to SEQ ID NO: 8365
  chr6:18277573-18277920
  hyper

SEQ ID NO: 19173 - DNA, 102 bp, Homo sapiens; identical to SEQ ID NO: 2771
  chr6:19691895-19691997
  hyper

SEQ ID NO: 19174 - DNA, 23 bp, Homo sapiens
  chr6:21665043-21665066
  hyper
gtgaagcgcggggcgggggaggc

SEQ ID NO: 19175 - DNA, 113 bp, Homo sapiens; identical to SEQ ID NO: 8369
  chr6:21665754-21665867
  hyper

SEQ ID NO: 19176 - DNA, 32 bp, Homo sapiens; identical to SEQ ID NO: 8370
  chr6:24126437-24126469
  hyper

SEQ ID NO: 19177 - DNA, 63 bp, Homo sapiens
  chr6:24494766-24494829
  hyper
gggcaggcaccagcgcatctatggaccgcgcacaaattccggggatgccgaatttgggggatg

SEQ ID NO: 19178 - DNA, 30 bp, Homo sapiens; identical to SEQ ID NO: 8372
  chr6:26020909-26020939
  hyper

SEQ ID NO: 19179 - DNA, 51 bp, Homo sapiens; identical to SEQ ID NO: 8373
  chr6:26087615-26087666
  hyper

SEQ ID NO: 19180 - DNA, 66 bp, Homo sapiens; identical to SEQ ID NO: 8374
  chr6:26088186-26088252
  hyper

SEQ ID NO: 19181 - DNA, 30 bp, Homo sapiens; identical to SEQ ID NO: 8375
  chr6:26172122-26172152
  hyper

SEQ ID NO: 19182 - DNA, 74 bp, Homo sapiens
  chr6:26184021-26184095
  hyper
gcatgcctgagccagcgaaatccgctcccgccccgaagaagggctccaagaaggccgtgaccaaggcgcagaag

SEQ ID NO: 19183 - DNA, 38 bp, Homo sapiens; identical to SEQ ID NO: 8379
  chr6:26199182-26199220
  hyper

SEQ ID NO: 19184 - DNA, 25 bp, Homo sapiens
  chr6:26200129-26200154
  hyper
gcaccaaggccgtcaccaagtacac

SEQ ID NO: 19185 - DNA, 71 bp, Homo sapiens; identical to SEQ ID NO: 8381
  chr6:26205142-26205213
  hyper

SEQ ID NO: 19186 - DNA, 30 bp, Homo sapiens; identical to SEQ ID NO: 8382
  chr6:26205682-26205712
  hyper

SEQ ID NO: 19187 - DNA, 449 bp, Homo sapiens; identical to SEQ ID NO: 8383
  chr6:26234025-26234474
  hyper

SEQ ID NO: 19188 - DNA, 30 bp, Homo sapiens; identical to SEQ ID NO: 8384
  chr6:26234702-26234732
  hyper

SEQ ID NO: 19189 - DNA, 122 bp, Homo sapiens; identical to SEQ ID NO: 8385
  chr6:26234942-26235064
  hyper

SEQ ID NO: 19190 - DNA, 41 bp, Homo sapiens; identical to SEQ ID NO: 2776
  chr6:26250098-26250139
  hyper

SEQ ID NO: 19191 - DNA, 269 bp, Homo sapiens
  chr6:26250199-26250468
  hyper
ggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttg

SEQ ID NO: 19192 - DNA, 14 bp, Homo sapiens
  chr6:26250826-26250840
  hyper
gtgccataggaatg

SEQ ID NO: 19193 - DNA, 175 bp, Homo sapiens
  chr6:26251641-26251816
  hyper
ttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaa

SEQ ID NO: 19194 - DNA, 35 bp, Homo sapiens
  chr6:26271371-26271406
  hyper
tcttgaagtcctgagcgatttctcgcaccaggcgt

SEQ ID NO: 19195 - DNA, 92 bp, Homo sapiens
  chr6:26272617-26272709
  hyper
gcaccgcctccaggtacaccggcgcaccggcccggacccgcttggcgtagttgcccttgcggaggaggcggtgcactcggcccacagaaaac

SEQ ID NO: 19196 - DNA, 159 bp, Homo sapiens; identical to SEQ ID NO: 8394
  chr6:26273111-26273270
  hyper

SEQ ID NO: 19197 - DNA, 180 bp, Homo sapiens; identical to SEQ ID NO: 8395
  chr6:26273570-26273750
  hyper

SEQ ID NO: 19198 - DNA, 101 bp, Homo sapiens; identical to SEQ ID NO: 8396
  chr6:26322530-26322631
  hyper

SEQ ID NO: 19199 - DNA, 30 bp, Homo sapiens; identical to SEQ ID NO: 8399
  chr6:26331781-26331811
  hyper

SEQ ID NO: 19200 - DNA, 6 bp, Homo sapiens
  chr6:26332172-26332178
  hyper
cacaac

SEQ ID NO: 19201 - DNA, 122 bp, Homo sapiens
  chr6:26550872-26550994
  hyper
taggcttgggagttccgcgcctctcggtgtcgcctggggggcgtgctccggttggcgcactgattcccagttgggtaggggaggcttgactgagctcccacccggaatttcaccttagacct

SEQ ID NO: 19202 - DNA, 25 bp, Homo sapiens
  chr6:26551034-26551059
  hyper
ctagtcctctttagtggagttccgg

SEQ ID NO: 19203 - DNA, 166 bp, Homo sapiens; identical to SEQ ID NO: 8404
  chr6:26577722-26577888
  hyper

SEQ ID NO: 19204 - DNA, 15 bp, Homo sapiens
  chr6:27064667-27064682
  hyper
gctggctcccaggtg

SEQ ID NO: 19205 - DNA, 70 bp, Homo sapiens
  chr6:27065198-27065268
  hyper
aacacccaagtccagccaacttccctttcaactctcctggaattcaggtccctggcgttggagaggaaaa

SEQ ID NO: 19206 - DNA, 275 bp, Homo sapiens; identical to SEQ ID NO: 8408
  chr6:27100686-27100961
  hyper

SEQ ID NO: 19207 - DNA, 8 bp, Homo sapiens
  chr6:27228172-27228180
  hyper
gaagagcc

SEQ ID NO: 19208 - DNA, 64 bp, Homo sapiens
  chr6:27228395-27228459
  hyper
aagttgttgttgtttgagaccaagtgagccaccgcacccagccaagaatcggctgtttaagaaa

SEQ ID NO: 19209 - DNA, 16 bp, Homo sapiens
  chr6:27243064-27243080
  hyper
acgctgggtgcagctc

SEQ ID NO: 19210 - DNA, 15 bp, Homo sapiens
  chr6:27247724-27247739
  hyper
cgaaccaagtccttg

SEQ ID NO: 19211 - DNA, 18 bp, Homo sapiens
  chr6:27256079-27256097
  hyper
cctttctaggaatcccgg

SEQ ID NO: 19212 - DNA, 59 bp, Homo sapiens
  chr6:27256173-27256232
  hyper
agagattgtcagttatccaactgtcaatagagccgccgctccagcgagtttaatttagg

SEQ ID NO: 19213 - DNA, 50 bp, Homo sapiens
  chr6:27279795-27279845
  hyper
gtggggcagggtgggcgcggtggacgaactgaacccgatgaacttggtga

SEQ ID NO: 19214 - DNA, 508 bp, Homo sapiens
  chr6:27280012-27280520
  hyper
ctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcagga

SEQ ID NO: 19215 - DNA, 33 bp, Homo sapiens; identical to SEQ ID NO: 8419
  chr6:27471362-27471395
  hyper

SEQ ID NO: 19216 - DNA, 36 bp, Homo sapiens
  chr6:27534341-27534377
  hyper
aaaacgctgcgctccctccggcgagggacaagagca

SEQ ID NO: 19217 - DNA, 30 bp, Homo sapiens; identical to SEQ ID NO: 8425
  chr6:27572883-27572913
  hyper

SEQ ID NO: 19218 - DNA, 201 bp, Homo sapiens
  chr6:27573392-27573593
  hyper
agggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaa

SEQ ID NO: 19219 - DNA, 66 bp, Homo sapiens
  chr6:27598672-27598738
  hyper
agagatgctggactgcgaatgcaggcgcgctgcaggcgaggctgggagggccgccaggagcgctgc

SEQ ID NO: 19220 - DNA, 20 bp, Homo sapiens
  chr6:27635245-27635265
  hyper
aagaatgaaaaacatcgaag

SEQ ID NO: 19221 - DNA, 30 bp, Homo sapiens; identical to SEQ ID NO: 8430
  chr6:27636385-27636415
  hyper

SEQ ID NO: 19222 - DNA, 15 bp, Homo sapiens
  chr6:27647697-27647712
  hyper
acctgtcttaaagtt

SEQ ID NO: 19223 - DNA, 34 bp, Homo sapiens; identical to SEQ ID NO: 8432
  chr6:27648814-27648848
  hyper

SEQ ID NO: 19224 - DNA, 239 bp, Homo sapiens; identical to SEQ ID NO: 8433
  chr6:27661759-27661998
  hyper

SEQ ID NO: 19225 - DNA, 225 bp, Homo sapiens; identical to SEQ ID NO: 8434
  chr6:27774914-27775139
  hyper

SEQ ID NO: 19226 - DNA, 120 bp, Homo sapiens; identical to SEQ ID NO: 8435
  chr6:27782468-27782588
  hyper

SEQ ID NO: 19227 - DNA, 64 bp, Homo sapiens; identical to SEQ ID NO: 8436
  chr6:27834196-27834260
  hyper

SEQ ID NO: 19228 - DNA, 19 bp, Homo sapiens
  chr6:27834835-27834854
  hyper
tcttcggagtcttcttcac

SEQ ID NO: 19229 - DNA, 37 bp, Homo sapiens
  chr6:27839689-27839726
  hyper
ctctcccctcggatgcggcgcgcaagctggatgtctt

SEQ ID NO: 19230 - DNA, 461 bp, Homo sapiens
  chr6:27840082-27840543
  hyper
gttcgtgccatggctaagtagacgtacctactcaacacaaatgagagaaaaaaactgatcatcccggtatttatagctgccctcgcgttctgattggacagtagactgtgccatgccacgtctcacacacggaattggctcccagtttaatctgctagtgaaagggagacattccgcctctgttttgggtcaagaaacgtaaaatggttttgctagctaaagaaaaacaaaaacggaaacaaaaaaaaatcccccaaaagtctaggatttttcatgcatcaaaatcctgtttaaatataagcttgataaatctaaacttgccttgcactattttaattacgaggtgtcattactgatttgacaaaaagttaaagaacgtaaaggaaaagtgaaactagagtaaatttgtaaatggaggcattgaaggggatatgaaattcgagcgttgtggtatgccagta

SEQ ID NO: 19231 - DNA, 49 bp, Homo sapiens; identical to SEQ ID NO: 8440
  chr6:27858327-27858376
  hyper

SEQ ID NO: 19232 - DNA, 70 bp, Homo sapiens
  chr6:28176212-28176282
  hyper
agcttagagcatggggtcgcaaccacccagagccttcagaccagtgagcactttccgcacaggtttgaat

SEQ ID NO: 19233 - DNA, 55 bp, Homo sapiens
  chr6:28367054-28367109
  hyper
gcttccctctaacctcgtggtctgtgattataatctgaagtgaggaaggcccagg

SEQ ID NO: 19234 - DNA, 41 bp, Homo sapiens
  chr6:28367774-28367815
  hyper
tgatcttaagacagggaaatcccttgcgtctccattcactt

SEQ ID NO: 19235 - DNA, 39 bp, Homo sapiens
  chr6:28411353-28411392
  hyper
ctctgtggtcgtcactctgaatcccgtctgtagtcttaa

SEQ ID NO: 19236 - DNA, 28 bp, Homo sapiens
  chr6:28415091-28415119
  hyper
cgttcccctttatcggctctattgccag

SEQ ID NO: 19237 - DNA, 30 bp, Homo sapiens; identical to SEQ ID NO: 8452
  chr6:28457825-28457855
  hyper

SEQ ID NO: 19238 - DNA, 76 bp, Homo sapiens; identical to SEQ ID NO: 8453
  chr6:34433517-34433593
  hyper

SEQ ID NO: 19239 - DNA, 71 bp, Homo sapiens; identical to SEQ ID NO: 8454
  chr6:35181353-35181424
  hyper

SEQ ID NO: 19240 - DNA, 53 bp, Homo sapiens; identical to SEQ ID NO: 8456
  chr6:36806954-36807007
  hyper

SEQ ID NO: 19241 - DNA, 127 bp, Homo sapiens; identical to SEQ ID NO: 8457
  chr6:36808176-36808303
  hyper

SEQ ID NO: 19242 - DNA, 272 bp, Homo sapiens
  chr6:37664187-37664459
  hyper
agtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttg

SEQ ID NO: 19243 - DNA, 27 bp, Homo sapiens
  chr6:37673293-37673320
  hyper
aaagggggtggggggcgggaaatctgg

SEQ ID NO: 19244 - DNA, 80 bp, Homo sapiens; identical to SEQ ID NO: 8460
  chr6:39016550-39016630
  hyper

SEQ ID NO: 19245 - DNA, 251 bp, Homo sapiens; identical to SEQ ID NO: 8461
  chr6:39016678-39016929
  hyper

SEQ ID NO: 19246 - DNA, 173 bp, Homo sapiens
  chr6:39281133-39281306
  hyper
tccgaagactcggagtaaagcgggttcagccagagagcggccctgcgtccgccctcctctcgaacccgggtctgcgcacgtcgagccccctctctgcgttgagggtggccccgaccagcacgcctcgggcccaatccacccaccctccgggacaaacgcgccttcccccaggc

SEQ ID NO: 19247 - DNA, 208 bp, Homo sapiens
  chr6:39281616-39281824
  hyper
ctcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatc

SEQ ID NO: 19248 - DNA, 99 bp, Homo sapiens
  chr6:39281875-39281974
  hyper
agcgccgggcggtccagacacgtgaagttctgcaacagctcccacttgtcgcgctggaagctgcggctggagtcctgcgccgcgcggccctccagcgtc

SEQ ID NO: 19249 - DNA, 30 bp, Homo sapiens; identical to SEQ ID NO: 8464
  chr6:39902189-39902219
  hyper

SEQ ID NO: 19250 - DNA, 64 bp, Homo sapiens
  chr6:40554589-40554653
  hyper
agttcccggttccctcgggtgcgttcagccccgcgccgagctcccgcggacacccgggatcgca

SEQ ID NO: 19251 - DNA, 38 bp, Homo sapiens
  chr6:40554699-40554737
  hyper
ccccggctgggtggcaccgaggccggctccgcggggcg

SEQ ID NO: 19252 - DNA, 27 bp, Homo sapiens
  chr6:41337045-41337072
  hyper
gccagggagtggaaacgccggaggtcc

SEQ ID NO: 19253 - DNA, 81 bp, Homo sapiens
  chr6:41337128-41337209
  hyper
ccgggaccctatccatgtcccattccgggcaccttcctcaaaagtaggggtgggaggggcataagccggtcaagtatttcc

SEQ ID NO: 19254 - DNA, 126 bp, Homo sapiens
  chr6:41339838-41339964
  hyper
gaacttttctctcctccttcttccctcgctctgcctctctcggggcggtctccggggactgtctctcacatccattctcctctcctccttgatttatgctgcagagtggaacgaccttccctgacc

SEQ ID NO: 19255 - DNA, 28 bp, Homo sapiens
  chr6:41342779-41342807
  hyper
gggtccttcaaaaagcgccactttggag

SEQ ID NO: 19256 - DNA, 187 bp, Homo sapiens
  chr6:41342837-41343024
  hyper
tcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttc

SEQ ID NO: 19257 - DNA, 32 bp, Homo sapiens; identical to SEQ ID NO: 8472
  chr6:41343650-41343682
  hyper

SEQ ID NO: 19258 - DNA, 27 bp, Homo sapiens
  chr6:41606542-41606569
  hyper
ccagcgcagccccgggcccaggtagga

SEQ ID NO: 19259 - DNA, 31 bp, Homo sapiens
  chr6:42879523-42879554
  hyper
tagggacacctgccccgctccctccccctcc

SEQ ID NO: 19260 - DNA, 63 bp, Homo sapiens
  chr6:43613067-43613130
  hyper
gaggcccccgggacgggctccccagagggtggctacctggaggcagggcggggtgggcgggtc

SEQ ID NO: 19261 - DNA, 57 bp, Homo sapiens; identical to SEQ ID NO: 8480
  chr6:45387985-45388042
  hyper

SEQ ID NO: 19262 - DNA, 30 bp, Homo sapiens; identical to SEQ ID NO: 8481
  chr6:45388359-45388389
  hyper

SEQ ID NO: 19263 - DNA, 369 bp, Homo sapiens; identical to SEQ ID NO: 8482
  chr6:45391172-45391541
  hyper

SEQ ID NO: 19264 - DNA, 388 bp, Homo sapiens
  chr6:46702594-46702982
  hyper
gagagaaaaaaaagaaaagaaaactccatgtgttccctgcctgtcctgattctccccccagctctgagctcttagggttgcttcctttcgggaaaaggtttggaagaactggtgtctaataccgtcatcctctccctctccccgcaaggatcctagcgctgtttccgagggctgcagggactgtgagcccaggaccggccagcagagcgggtgcgactcagcgagcccaccccggccggtcgccgctccggggtcccgacctccagcgcggcgaccgtgcccttcctcccactcccgcctcgcccccggggcccctcctcactcaggcgcggcgcggagctgctcgcgggaactggggtccctgggcgcgttccaccgcgcaccaacg

SEQ ID NO: 19265 - DNA, 227 bp, Homo sapiens
  chr6:46703123-46703350
  hyper
gcctagcgcggccttgtggccccgaccctctcctcccctggtgatgctggaggaggtaccggggaggagcgtgtgtggccccggcctctcactagcagcggcggctcccgacgctagcctgctcgagcgcacccagcaccctccccaagaccatggcccgcacctggacccgcggttaacttagcccgccgcggagagagccaggcaatgcctgggtggtgtcgtgc

SEQ ID NO: 19266 - DNA, 89 bp, Homo sapiens
  chr6:46703436-46703525
  hyper
caccgtgttctctgaatacactgaattactccgagcatctatagttggcaatgccctgcgcattttccgcactccgatacactttacac

SEQ ID NO: 19267 - DNA, 9 bp, Homo sapiens
  chr6:50674363-50674372
  hyper
gttaccagg

SEQ ID NO: 19268 - DNA, 95 bp, Homo sapiens
  chr6:50681604-50681699
  hyper
aggagctatctgatccgggcaaaaccattacaatttagatatctacctatagaacattttttttttcctttaaaaattggaaaatacaagaagtt

SEQ ID NO: 19269 - DNA, 122 bp, Homo sapiens
  chr6:50681942-50682064
  hyper
tgtctttcgggggaagttaaggaaggaaaggggagaaagttcgttatgacatctgtcgccagggagggcaactctctgccacgttaagaaacatttgccataatgagcgggaaaacataatc

SEQ ID NO: 19270 - DNA, 211 bp, Homo sapiens
  chr6:50682448-50682659
  hyper
cgcggccccggagtcagttgcaaacctggatcccaacgccaagctccctgcacaagttgggcaggggctgtgtgtgtgtctgtgtgtgtgtgtctgtgcgtgtgtgtgcgtgtgtggtgtcacccgcacctatatagggtgggggattttttttccgctctctcgactgtgaggacgaggccgcccacccccagttcgcctgtttgcaaag

SEQ ID NO: 19271 - DNA, 49 bp, Homo sapiens; identical to SEQ ID NO: 8491
  chr6:50690631-50690680
  hyper

SEQ ID NO: 19272 - DNA, 174 bp, Homo sapiens
  chr6:50691909-50692083
  hyper
ctcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatc

SEQ ID NO: 19273 - DNA, 31 bp, Homo sapiens
  chr6:50692481-50692512
  hyper
tgtgtgtgtgtgtcggcggggggacctgtct

SEQ ID NO: 19274 - DNA, 26 bp, Homo sapiens
  chr6:50788352-50788378
  hyper
tccttaacaggcgggataatggtaaa

SEQ ID NO: 19275 - DNA, 10 bp, Homo sapiens
  chr6:50791177-50791187
  hyper
cccaaggacc

SEQ ID NO: 19276 - DNA, 25 bp, Homo sapiens
  chr6:50803867-50803892
  hyper
cgtcccaggccgtttgtctctgctc

SEQ ID NO: 19277 - DNA, 30 bp, Homo sapiens; identical to SEQ ID NO: 8504
  chr6:50811838-50811868
  hyper

SEQ ID NO: 19278 - DNA, 214 bp, Homo sapiens
  chr6:50818706-50818920
  hyper
taggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtca

SEQ ID NO: 19279 - DNA, 8 bp, Homo sapiens
  chr6:50819000-50819008
  hyper
tttggggg

SEQ ID NO: 19280 - DNA, 82 bp, Homo sapiens
  chr6:55443946-55444028
  hyper
gcgcccctccggtgcactggctgtgaggaccagagctgttctgcgcactgcggcggcgccgagagggcggggagtggggcgt

SEQ ID NO: 19281 - DNA, 89 bp, Homo sapiens
  chr6:56112173-56112262
  hyper
tgtctccttacctggcgcagtgtccaggctcggggttgccgtcgcagccagctgagtgttgcgccagggggacaggtatgttccaggca

SEQ ID NO: 19282 - DNA, 55 bp, Homo sapiens; identical to SEQ ID NO: 8509
  chr6:56716640-56716695
  hyper

SEQ ID NO: 19283 - DNA, 280 bp, Homo sapiens
  chr6:56818937-56819217
  hyper
taaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttga

SEQ ID NO: 19284 - DNA, 59 bp, Homo sapiens; identical to SEQ ID NO: 8511
  chr6:56820782-56820841
  hyper

SEQ ID NO: 19285 - DNA, 19 bp, Homo sapiens
  chr6:58147428-58147447
  hyper
gaaaaccgcatctcccgaa

SEQ ID NO: 19286 - DNA, 31 bp, Homo sapiens
  chr6:58147480-58147511
  hyper
tctcttgtcattctccgggatgtaaaagact

SEQ ID NO: 19287 - DNA, 28 bp, Homo sapiens
  chr6:58147762-58147790
  hyper
acaggcccggcggcggagccctgctccc

SEQ ID NO: 19288 - DNA, 68 bp, Homo sapiens
  chr6:62996146-62996214
  hyper
aaccactcattggtggtggtgccaggagaggcggggcgctggcagaaggccgcgggctctcattgggc

SEQ ID NO: 19289 - DNA, 181 bp, Homo sapiens; identical to SEQ ID NO: 563
  chr6:62996215-62996396
  hyper

SEQ ID NO: 19290 - DNA, 30 bp, Homo sapiens; identical to SEQ ID NO: 8518
  chr6:69345066-69345096
  hyper

SEQ ID NO: 19291 - DNA, 30 bp, Homo sapiens; identical to SEQ ID NO: 8519
  chr6:69345341-69345371
  hyper

SEQ ID NO: 19292 - DNA, 174 bp, Homo sapiens; identical to SEQ ID NO: 8520
  chr6:69942843-69943017
  hyper

SEQ ID NO: 19293 - DNA, 45 bp, Homo sapiens
  chr6:70993015-70993060
  hyper
ccctgccgccgcacaggcgaggactgagcacgcagctctgcctcc

SEQ ID NO: 19294 - DNA, 190 bp, Homo sapiens; identical to SEQ ID NO: 8524
  chr6:71666491-71666681
  hyper

SEQ ID NO: 19295 - DNA, 90 bp, Homo sapiens
  chr6:71666698-71666788
  hyper
cgcagcggaagcctgctctcagtcccttgctcttgtcttctcagaacctctccggatccagcagcaagatcccaaagcaaggaaagaaag

SEQ ID NO: 19296 - DNA, 21 bp, Homo sapiens
  chr6:72129768-72129789
  hyper
ccgcagcccgaggtgcgggag

SEQ ID NO: 19297 - DNA, 22 bp, Homo sapiens
  chr6:72130023-72130045
  hyper
gggggctgggcgagccgggaga

SEQ ID NO: 19298 - DNA, 60 bp, Homo sapiens
  chr6:72596060-72596120
  hyper
tgtaggggtagcggccggggcacgcgtggctcggacccggggagtgggcgggtgggtgcc

SEQ ID NO: 19299 - DNA, 2 bp, Homo sapiens
  chr6:72596980-72596982
  hyper
gg

SEQ ID NO: 19300 - DNA, 30 bp, Homo sapiens; identical to SEQ ID NO: 8533
  chr6:73330633-73330663
  hyper

SEQ ID NO: 19301 - DNA, 211 bp, Homo sapiens
  chr6:73331304-73331515
  hyper
cggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagc

SEQ ID NO: 19302 - DNA, 681 bp, Homo sapiens; identical to SEQ ID NO: 8540
  chr6:74019413-74020094
  hyper

SEQ ID NO: 19303 - DNA, 63 bp, Homo sapiens; identical to SEQ ID NO: 8541
  chr6:74405916-74405979
  hyper

SEQ ID NO: 19304 - DNA, 30 bp, Homo sapiens; identical to SEQ ID NO: 8542
  chr6:75914569-75914599
  hyper

SEQ ID NO: 19305 - DNA, 72 bp, Homo sapiens; identical to SEQ ID NO: 8543
  chr6:75915049-75915121
  hyper

SEQ ID NO: 19306 - DNA, 36 bp, Homo sapiens; identical to SEQ ID NO: 8544
  chr6:75915170-75915206
  hyper

SEQ ID NO: 19307 - DNA, 90 bp, Homo sapiens; identical to SEQ ID NO: 8545
  chr6:75915711-75915801
  hyper

SEQ ID NO: 19308 - DNA, 153 bp, Homo sapiens; identical to SEQ ID NO: 8546
  chr6:75916306-75916459
  hyper

SEQ ID NO: 19309 - DNA, 30 bp, Homo sapiens; identical to SEQ ID NO: 8549
  chr6:78176103-78176133
  hyper

SEQ ID NO: 19310 - DNA, 14 bp, Homo sapiens
  chr6:78176820-78176834
  hyper
ggaggaaccaaaga

SEQ ID NO: 19311 - DNA, 42 bp, Homo sapiens; identical to SEQ ID NO: 8552
  chr6:79620753-79620795
  hyper

SEQ ID NO: 19312 - DNA, 257 bp, Homo sapiens
  chr6:80656673-80656930
  hyper
cagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctac

SEQ ID NO: 19313 - DNA, 53 bp, Homo sapiens
  chr6:80657180-80657233
  hyper
ccaagcggaaggcgtcgtcaaggttcccgggagaaagacgaggaggtggagga

SEQ ID NO: 19314 - DNA, 70 bp, Homo sapiens; identical to SEQ ID NO: 8554
  chr6:80657499-80657569
  hyper

SEQ ID NO: 19315 - DNA, 7 bp, Homo sapiens
  chr6:84417429-84417436
  hyper
attatgg

SEQ ID NO: 19316 - DNA, 31 bp, Homo sapiens
  chr6:84418281-84418312
  hyper
gccgaggcccatcgcccgggccccttccccc

SEQ ID NO: 19317 - DNA, 74 bp, Homo sapiens
  chr6:84418570-84418644
  hyper
ctgagcggcgccgcccgccgcaggatgagcggagcccgggccgccgagggaagccgcgccggtggatgtgtgcg

SEQ ID NO: 19318 - DNA, 55 bp, Homo sapiens
  chr6:84419102-84419157
  hyper
ggcacgcactgggctcgcgcaccacgcacacctgcccgccgactgcggggggagc

SEQ ID NO: 19319 - DNA, 53 bp, Homo sapiens
  chr6:84562820-84562873
  hyper
cggaaattggctgctcgggcgaatgttgtttttctccgcagccatgtgtcgaa

SEQ ID NO: 19320 - DNA, 43 bp, Homo sapiens
  chr6:84563242-84563285
  hyper
gcgctgctctgcgcctcccagcttcccccgtctctccctcctg

SEQ ID NO: 19321 - DNA, 73 bp, Homo sapiens
  chr6:84563416-84563489
  hyper
cgcaggcttctggagaccctgggtggacgccggaggcaagaaagaagaggagacgccgaaccacgccgcggag

SEQ ID NO: 19322 - DNA, 311 bp, Homo sapiens
  chr6:84563542-84563853
  hyper
gaccagggctctcgggacgcagggcctgagagagacatgcgagacaccgggtcctgcctctcgcttaacatcccgcctgccggtggccataaaggtgccgacgcggcggatgtgtcctctggagcgatgggccacaggcacccagccgggagcgaggctgctgagagccctggggttacattcccagcgggcacgaggaacactgggtcgtgcacgtttccactttctagaaggaggtgggtgataactggattcacttcctttcctctccagatgcccgatggccctggaatgaccgcagcctcaggaaa

SEQ ID NO: 19323 - DNA, 30 bp, Homo sapiens; identical to SEQ ID NO: 8564
  chr6:85471966-85471996
  hyper

SEQ ID NO: 19324 - DNA, 6 bp, Homo sapiens
  chr6:85472401-85472407
  hyper
cttggg

SEQ ID NO: 19325 - DNA, 225 bp, Homo sapiens
  chr6:85473703-85473928
  hyper
aacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctc

SEQ ID NO: 19326 - DNA, 109 bp, Homo sapiens
  chr6:85474485-85474594
  hyper
gatgtgccagccacacggacgctgaactctgtctctctgacgtccgtagctgagtccagccccgtagtctccagctttcctcaccaggacctggaaaggcggaagttcc

SEQ ID NO: 19327 - DNA, 110 bp, Homo sapiens
  chr6:85477028-85477138
  hyper
gggcgtcgaatctctcttgggcatgggagggaaagacattccgagttggctgggcggagtggcagccttgagagtgacgagtgacagcaaagcctcgtcctagcaaggcc

SEQ ID NO: 19328 - DNA, 29 bp, Homo sapiens
  chr6:85483316-85483345
  hyper
tcagggagcgcggaacgcgggtttctgtt

SEQ ID NO: 19329 - DNA, 13 bp, Homo sapiens
  chr6:85484920-85484933
  hyper
agatagactaagt

SEQ ID NO: 19330 - DNA, 83 bp, Homo sapiens; identical to SEQ ID NO: 8575
  chr6:86159807-86159890
  hyper

SEQ ID NO: 19331 - DNA, 130 bp, Homo sapiens
  chr6:87861962-87862092
  hyper
gcgccccgatagtggcgcacgctctccgccatccccgggcctcgcgctttcacctcgcgtgctggggcgagggcggggctgcggggtgtactgggtcgggggtaggaaggacctgccaggccttagccct

SEQ ID NO: 19332 - DNA, 30 bp, Homo sapiens; identical to SEQ ID NO: 8577
  chr6:88875485-88875515
  hyper

SEQ ID NO: 19333 - DNA, 103 bp, Homo sapiens; identical to SEQ ID NO: 8578
  chr6:88875796-88875899
  hyper

SEQ ID NO: 19334 - DNA, 175 bp, Homo sapiens; identical to SEQ ID NO: 2852
  chr6:88876302-88876477
  hyper

SEQ ID NO: 19335 - DNA, 111 bp, Homo sapiens; identical to SEQ ID NO: 2853
  chr6:88876630-88876741
  hyper

SEQ ID NO: 19336 - DNA, 221 bp, Homo sapiens
  chr6:88876742-88876963
  hyper
ccaggcgccttctccagcgcccgccgccctttcccggcgagaccactcgggcgcgccccgcccgccggtccccgatgcaaacagttgggctccgtaggcggctggctccgcgcctcccggcccggcgcgccccctccccggccacccggggccccgctcctcgcaccttttcgctggaggaggacgccccactccagggccggactgggggctctgggact

SEQ ID NO: 19337 - DNA, 155 bp, Homo sapiens; identical to SEQ ID NO: 8583
  chr6:90143450-90143605
  hyper

SEQ ID NO: 19338 - DNA, 350 bp, Homo sapiens; identical to SEQ ID NO: 8584
  chr6:91004829-91005179
  hyper

SEQ ID NO: 19339 - DNA, 106 bp, Homo sapiens; identical to SEQ ID NO: 8585
  chr6:91005208-91005314
  hyper

SEQ ID NO: 19340 - DNA, 629 bp, Homo sapiens
  chr6:91320320-91320949
  hyper
ttatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcag

SEQ ID NO: 19341 - DNA, 43 bp, Homo sapiens; identical to SEQ ID NO: 8587
  chr6:94126380-94126423
  hyper

SEQ ID NO: 19342 - DNA, 110 bp, Homo sapiens; identical to SEQ ID NO: 8588
  chr6:94126643-94126753
  hyper

SEQ ID NO: 19343 - DNA, 36 bp, Homo sapiens; identical to SEQ ID NO: 8589
  chr6:94127088-94127124
  hyper

SEQ ID NO: 19344 - DNA, 116 bp, Homo sapiens
  chr6:94127544-94127660
  hyper
gggttcagcatctatacaggttgcagatgtggaaagtggggtcagaaggtcaggctgaaagaaggactagaatttggcgccgggtttgaggggggcttgagcgaactaagaggagt

SEQ ID NO: 19345 - DNA, 39 bp, Homo sapiens; identical to SEQ ID NO: 8591
  chr6:94128439-94128478
  hyper

SEQ ID NO: 19346 - DNA, 36 bp, Homo sapiens; identical to SEQ ID NO: 8592
  chr6:94128713-94128749
  hyper

SEQ ID NO: 19347 - DNA, 37 bp, Homo sapiens
  chr6:94129182-94129219
  hyper
cgatcggctgctccacgtttagctttttttaatttcc

SEQ ID NO: 19348 - DNA, 149 bp, Homo sapiens
  chr6:94129257-94129406
  hyper
caagtctccgactgcagaccggccgcttgctccacactccaataatatcaattagggggggagggggcggggctccgagctgagagcctccgccactcgggctgagtggcaggcacagccggcctgccaggaggcgattcccagggcca

SEQ ID NO: 19349 - DNA, 32 bp, Homo sapiens; identical to SEQ ID NO: 8594
  chr6:94129782-94129814
  hyper

SEQ ID NO: 19350 - DNA, 93 bp, Homo sapiens; identical to SEQ ID NO: 8595
  chr6:96463220-96463313
  hyper

SEQ ID NO: 19351 - DNA, 30 bp, Homo sapiens; identical to SEQ ID NO: 8598
  chr6:99273871-99273901
  hyper

SEQ ID NO: 19352 - DNA, 128 bp, Homo sapiens
  chr6:99279612-99279740
  hyper
ctcagagccgcggtgcgagcccagcctggcccgcccggtgattggccgcgcttgggggtgggggtggggtgcagagactgaggccccgggtaggctatttctttgtgtactcccggggatttattggg

SEQ ID NO: 19353 - DNA, 41 bp, Homo sapiens
  chr6:99280516-99280557
  hyper
cggccagagtggccccgcgcttgcgctgggacggagcgaca

SEQ ID NO: 19354 - DNA, 93 bp, Homo sapiens
  chr6:99281385-99281478
  hyper
taccagcggtaggagcacggggaatcgcgcacgcaggccctccgcgcggcttcccggagcggcctttggcgactgcgccgcccctacaaggcc

SEQ ID NO: 19355 - DNA, 95 bp, Homo sapiens; identical to SEQ ID NO: 8605
  chr6:99282778-99282873
  hyper

SEQ ID NO: 19356 - DNA, 98 bp, Homo sapiens; identical to SEQ ID NO: 8606
  chr6:99283408-99283506
  hyper

SEQ ID NO: 19357 - DNA, 75 bp, Homo sapiens
  chr6:99290398-99290473
  hyper
cctagctcggccgcgcggggaggagagagacagggaaaggagcggggcactccctgcactcccagccccggcctt

SEQ ID NO: 19358 - DNA, 104 bp, Homo sapiens
  chr6:99292417-99292521
  hyper
ggctcctttaagcatatttccgtgaatctgtttcttgtgctttaatgttactattaattgataagatcagctcatcaaacatactatttcgatagggaattgta

SEQ ID NO: 19359 - DNA, 21 bp, Homo sapiens
  chr6:100038661-100038682
  hyper
cttcctcccactgtgcgagct

SEQ ID NO: 19360 - DNA, 190 bp, Homo sapiens
  chr6:100038964-100039154
  hyper
tctaagaaggcataaactcggcctgagacgtgggggggagacactgcagagaagaggccaagttccagcgcagaaggggggttccgcggggccctgggattgaggagacaggagcgagccttccctttccgtcctctcaggaaaacagcctgacctgctggcacgtccacccccaacagaagagggaccc

SEQ ID NO: 19361 - DNA, 19 bp, Homo sapiens
  chr6:100054917-100054936
  hyper
gagccgccagagcgccagc

SEQ ID NO: 19362 - DNA, 52 bp, Homo sapiens; identical to SEQ ID NO: 8620
  chr6:100055281-100055333
  hyper

SEQ ID NO: 19363 - DNA, 235 bp, Homo sapiens
  chr6:100061076-100061311
  hyper
gtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgagg

SEQ ID NO: 19364 - DNA, 33 bp, Homo sapiens
  chr6:100061419-100061452
  hyper
ggcggcggccgctcacggcgacccctaccggga

SEQ ID NO: 19365 - DNA, 190 bp, Homo sapiens
  chr6:100061988-100062178
  hyper
cggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcac

SEQ ID NO: 19366 - DNA, 84 bp, Homo sapiens
  chr6:100062586-100062670
  hyper
cgaccagagcgaccccgaggttgggggcggcggggagcgcgacttgtaacgagtcttcccgggaaggggcggggtgaggacaga

SEQ ID NO: 19367 - DNA, 34 bp, Homo sapiens
  chr6:100062910-100062944
  hyper
cctgaaccgcccaggcggtctgctcttggtgttc

SEQ ID NO: 19368 - DNA, 20 bp, Homo sapiens
  chr6:100063068-100063088
  hyper
tttcacgttagcatttcatt

SEQ ID NO: 19369 - DNA, 39 bp, Homo sapiens; identical to SEQ ID NO: 8624
  chr6:100067144-100067183
  hyper

SEQ ID NO: 19370 - DNA, 30 bp, Homo sapiens; identical to SEQ ID NO: 8625
  chr6:100067397-100067427
  hyper

SEQ ID NO: 19371 - DNA, 2 bp, Homo sapiens
  chr6:100441306-100441308
  hyper
cg

SEQ ID NO: 19372 - DNA, 132 bp, Homo sapiens
  chr6:100441966-100442098
  hyper
caggttgggagccagccccacctccatttccaaagcgggggtccaggcacaggaacagccaaacgcccgaaccagcggggttacctttgccacttcatccaatccgagcatcgggtgcgtcgtgctcttttc

SEQ ID NO: 19373 - DNA, 43 bp, Homo sapiens
  chr6:100906016-100906059
  hyper
gcccgagttggagccagccgcgaaaagacggcagaaacccaag

SEQ ID NO: 19374 - DNA, 18 bp, Homo sapiens
  chr6:100912403-100912421
  hyper
gggtgggaggcgccgcgg

SEQ ID NO: 19375 - DNA, 30 bp, Homo sapiens; identical to SEQ ID NO: 8634
  chr6:100915720-100915750
  hyper

SEQ ID NO: 19376 - DNA, 238 bp, Homo sapiens; identical to SEQ ID NO: 8636
  chr6:101841128-101841366
  hyper

SEQ ID NO: 19377 - DNA, 54 bp, Homo sapiens; identical to SEQ ID NO: 8637
  chr6:101841599-101841653
  hyper

SEQ ID NO: 19378 - DNA, 24 bp, Homo sapiens
  chr6:105401596-105401620
  hyper
cggccgcctggggagcgacctgcc

SEQ ID NO: 19379 - DNA, 55 bp, Homo sapiens
  chr6:105404519-105404574
  hyper
taaatatgaaattagcgttccaagcaggtttactgccatggaatagctgaattct

SEQ ID NO: 19380 - DNA, 264 bp, Homo sapiens
  chr6:105405772-105406036
  hyper
gcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaat

SEQ ID NO: 19381 - DNA, 30 bp, Homo sapiens; identical to SEQ ID NO: 8644
  chr6:105406435-105406465
  hyper

SEQ ID NO: 19382 - DNA, 83 bp, Homo sapiens; identical to SEQ ID NO: 587
  chr6:105584133-105584216
  hyper

SEQ ID NO: 19383 - DNA, 47 bp, Homo sapiens
  chr6:105584217-105584264
  hyper
ctctcccggggccctctgacctcgctccttaaaggaggagggtccgt

SEQ ID NO: 19384 - DNA, 13 bp, Homo sapiens
  chr6:105585554-105585567
  hyper
ggggtcaggcctc

SEQ ID NO: 19385 - DNA, 420 bp, Homo sapiens; identical to SEQ ID NO: 8649
  chr6:105627657-105628077
  hyper

SEQ ID NO: 19386 - DNA, 47 bp, Homo sapiens; identical to SEQ ID NO: 8652
  chr6:106434211-106434258
  hyper

SEQ ID NO: 19387 - DNA, 141 bp, Homo sapiens
  chr6:106442979-106443120
  hyper
cctcatcctcctccccattcccttgccttcttttaggtcttcggttcgtgacaagtgcataggttaggcttgcacggaagagggtcggggcaggtgccagctcagggcacctacccggcgttgtcacgttccctttgggat

SEQ ID NO: 19388 - DNA, 75 bp, Homo sapiens
  chr6:106960833-106960908
  hyper
tggagcttctgacgccgacggcttgaagcccaggaaccatttcggcgtgggcaggtcgacagtgaccactaaagt

SEQ ID NO: 19389 - DNA, 34 bp, Homo sapiens; identical to SEQ ID NO: 8655
  chr6:108434966-108435000
  hyper

SEQ ID NO: 19390 - DNA, 261 bp, Homo sapiens
  chr6:108436526-108436787
  hyper
cagggctttggatgccggggattttgaggacccattcaaagctccgagggggcggaggctcaagcaagccagggaaaaggtcccctaagcctcagagcctgggctgcgccccagacaaagtgcctaatgcagagtaggctcttaataggtttgcattggatctaaacgaaagctagtgaaattcgtacatgattctaatgagagatgacggccaggtgttctcagcagcccctggccctcacggggcgacctgaaagttcc

SEQ ID NO: 19391 - DNA, 15 bp, Homo sapiens
  chr6:108438142-108438157
  hyper
gcagcccaactgggg

SEQ ID NO: 19392 - DNA, 53 bp, Homo sapiens; identical to SEQ ID NO: 8659
  chr6:108438779-108438832
  hyper

SEQ ID NO: 19393 - DNA, 13 bp, Homo sapiens
  chr6:108440078-108440091
  hyper
cctcatattcttg

SEQ ID NO: 19394 - DNA, 6 bp, Homo sapiens
  chr6:108440961-108440967
  hyper
ctggtg

SEQ ID NO: 19395 - DNA, 416 bp, Homo sapiens
  chr6:108478874-108479290
  hyper
gtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctg

SEQ ID NO: 19396 - DNA, 31 bp, Homo sapiens
  chr6:108479665-108479696
  hyper
ggcccatgatctggagcgctcaacttgggag

SEQ ID NO: 19397 - DNA, 37 bp, Homo sapiens
  chr6:108484872-108484909
  hyper
gagtagaaggcagcccgcactaaggctccaggcttat

SEQ ID NO: 19398 - DNA, 152 bp, Homo sapiens
  chr6:108485513-108485665
  hyper
aaagaaccccataatcgcgtccgcgttatgggggtggtggtggtaggtggctgaagcaagtggatttctggcgtgaaccagaacctgaggattccaaacggagcctggcatcttattgtgtttctcaaatcctgcccgaaattcctcccctc

SEQ ID NO: 19399 - DNA, 102 bp, Homo sapiens
  chr6:108485905-108486007
  hyper
ggtcgcggcgccccactaaggaggacacaggctctggtgtgtgtggtgtgcgagaccccgagctcgaggccgagccaaggctgggcagaaagttgcaatcac

SEQ ID NO: 19400 - DNA, 150 bp, Homo sapiens
  chr6:108486008-108486158
  hyper
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtc

SEQ ID NO: 19401 - DNA, 38 bp, Homo sapiens; identical to SEQ ID NO: 8666
  chr6:108487419-108487457
  hyper

SEQ ID NO: 19402 - DNA, 28 bp, Homo sapiens
  chr6:108488416-108488444
  hyper
atgctttgcaccccgtttctagctattt

SEQ ID NO: 19403 - DNA, 18 bp, Homo sapiens
  chr6:108490960-108490978
  hyper
cacaatctcccctcccgc

SEQ ID NO: 19404 - DNA, 19 bp, Homo sapiens
  chr6:108492251-108492270
  hyper
tcaagtttgtctcctcgcg

SEQ ID NO: 19405 - DNA, 90 bp, Homo sapiens
  chr6:108492451-108492541
  hyper
gctcattgtaggaaactgacacttgctcaaggaaaaaaagtttgggtataaaatcacttcattatttgcttttaccgcagcttcggtgct

SEQ ID NO: 19406 - DNA, 257 bp, Homo sapiens
  chr6:108495951-108496208
  hyper
ctccacaccgtttccccgcccgggtgccggctccgggtctccagcctaaaggccctggggaccgctgacctcctgctctctgttccagggaggctgtccggtggacaagacgcacagaaaccagtgcagggcgtgtcggctgaagaagtgtttggaagtcaacatgaacaaagacggtaatcagtgcatccctttattccaatgttgattgagtagtaagtaaattatatgtacagaaaatacatggcactcctatg

SEQ ID NO: 19407 - DNA, 39 bp, Homo sapiens; identical to SEQ ID NO: 8676
  chr6:110299546-110299585
  hyper

SEQ ID NO: 19408 - DNA, 183 bp, Homo sapiens
  chr6:110678940-110679123
  hyper
atagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctgg

SEQ ID NO: 19409 - DNA, 252 bp, Homo sapiens
  chr6:110679414-110679666
  hyper
ccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctgga

SEQ ID NO: 19410 - DNA, 103 bp, Homo sapiens; identical to SEQ ID NO: 8679
  chr6:111409667-111409770
  hyper

SEQ ID NO: 19411 - DNA, 30 bp, Homo sapiens; identical to SEQ ID NO: 8680
  chr6:114663242-114663272
  hyper

SEQ ID NO: 19412 - DNA, 55 bp, Homo sapiens; identical to SEQ ID NO: 2904
  chr6:117586007-117586062
  hyper

SEQ ID NO: 19413 - DNA, 36 bp, Homo sapiens; identical to SEQ ID NO: 8684
  chr6:117586401-117586437
  hyper

SEQ ID NO: 19414 - DNA, 30 bp, Homo sapiens; identical to SEQ ID NO: 8685
  chr6:117587193-117587223
  hyper

SEQ ID NO: 19415 - DNA, 25 bp, Homo sapiens
  chr6:117587577-117587602
  hyper
ttttcctttgcgaagttctgggagc

SEQ ID NO: 19416 - DNA, 205 bp, Homo sapiens
  chr6:117591206-117591411
  hyper
gcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtt

SEQ ID NO: 19417 - DNA, 75 bp, Homo sapiens; identical to SEQ ID NO: 8688
  chr6:117591753-117591828
  hyper

SEQ ID NO: 19418 - DNA, 39 bp, Homo sapiens; identical to SEQ ID NO: 8689
  chr6:117592099-117592138
  hyper

SEQ ID NO: 19419 - DNA, 81 bp, Homo sapiens
  chr6:118228151-118228232
  hyper
aactccacagggaggatctattcccagcccccttatccccctaaaaaacacccaaaccaaaacaatcaccacaacctagac

SEQ ID NO: 19420 - DNA, 96 bp, Homo sapiens
  chr6:118228651-118228747
  hyper
gcggcggcggcggcacgggcgcgagggtgcgcgcactgggactggagaggagtgagtggcgggctgggcggcggcggccgtagccgcgggtgcctc

SEQ ID NO: 19421 - DNA, 41 bp, Homo sapiens
  chr6:118228828-118228869
  hyper
aaccggcacacgatgcacccggctgcgttctgatcgccgcc

SEQ ID NO: 19422 - DNA, 284 bp, Homo sapiens
  chr6:118228870-118229154
  hyper
cgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcc

SEQ ID NO: 19423 - DNA, 6 bp, Homo sapiens
  chr6:118229818-118229824
  hyper
atgagg

SEQ ID NO: 19424 - DNA, 45 bp, Homo sapiens; identical to SEQ ID NO: 8696
  chr6:119399159-119399204
  hyper

SEQ ID NO: 19425 - DNA, 40 bp, Homo sapiens
  chr6:121758632-121758672
  hyper
ttcccgagaatgaggcggggcggctcaaggggaaagggca

SEQ ID NO: 19426 - DNA, 35 bp, Homo sapiens; identical to SEQ ID NO: 2910
  chr6:123316972-123317007
  hyper

SEQ ID NO: 19427 - DNA, 125 bp, Homo sapiens
  chr6:123317589-123317714
  hyper
cttctctcccgaaggcgaaaatggcagggccaggcgagaacctgggacagcggtggccctagccctgcgatcctcacccctcctgctaggagaggctgcgggctgcccgcggacgatgtggccgc

SEQ ID NO: 19428 - DNA, 82 bp, Homo sapiens
  chr6:123317715-123317797
  hyper
gctgctcccgagcgcatcttcggcccgggtccccgccgccacccctcttctctgctccttccatcccgcccagaggagttga

SEQ ID NO: 19429 - DNA, 38 bp, Homo sapiens
  chr6:123317833-123317871
  hyper
ggctgatggatgccagggagtgccgcattgcttagcga

SEQ ID NO: 19430 - DNA, 121 bp, Homo sapiens
  chr6:124124311-124124432
  hyper
ccgctctggatgcctcggttgcacccctgttccatgaccccagcttccttccctaaccctcctcttggtcccttctcccccgagcgcgcgcgcacacacacactcggttcgctcccgcgga

SEQ ID NO: 19431 - DNA, 137 bp, Homo sapiens
  chr6:124124466-124124603
  hyper
aaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttg

SEQ ID NO: 19432 - DNA, 47 bp, Homo sapiens; identical to SEQ ID NO: 8703
  chr6:125282746-125282793
  hyper

SEQ ID NO: 19433 - DNA, 269 bp, Homo sapiens; identical to SEQ ID NO: 8704
  chr6:125283133-125283402
  hyper

SEQ ID NO: 19434 - DNA, 206 bp, Homo sapiens
  chr6:125283925-125284131
  hyper
gtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctg

SEQ ID NO: 19435 - DNA, 33 bp, Homo sapiens; identical to SEQ ID NO: 8706
  chr6:125475551-125475584
  hyper

SEQ ID NO: 19436 - DNA, 94 bp, Homo sapiens; identical to SEQ ID NO: 8707
  chr6:125684588-125684682
  hyper

SEQ ID NO: 19437 - DNA, 24 bp, Homo sapiens
  chr6:126068068-126068092
  hyper
cgttccctcattctttctcttttc

SEQ ID NO: 19438 - DNA, 33 bp, Homo sapiens; identical to SEQ ID NO: 8709
  chr6:126069106-126069139
  hyper

SEQ ID NO: 19439 - DNA, 225 bp, Homo sapiens; identical to SEQ ID NO: 8710
  chr6:126069350-126069575
  hyper

SEQ ID NO: 19440 - DNA, 51 bp, Homo sapiens; identical to SEQ ID NO: 8711
  chr6:126069805-126069856
  hyper

SEQ ID NO: 19441 - DNA, 42 bp, Homo sapiens; identical to SEQ ID NO: 8712
  chr6:126071276-126071318
  hyper

SEQ ID NO: 19442 - DNA, 23 bp, Homo sapiens
  chr6:127439250-127439273
  hyper
gggagagggtagttgcgcgccgg

SEQ ID NO: 19443 - DNA, 58 bp, Homo sapiens
  chr6:127439321-127439379
  hyper
cggccaccgacagccgggtgcgcctagcttgaggccgcggagaggagccgaactggga

SEQ ID NO: 19444 - DNA, 34 bp, Homo sapiens
  chr6:127439453-127439487
  hyper
tctggaggggctcttcgcacgcactgctttcccc

SEQ ID NO: 19445 - DNA, 147 bp, Homo sapiens
  chr6:127439838-127439985
  hyper
acgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccg

SEQ ID NO: 19446 - DNA, 65 bp, Homo sapiens
  chr6:127440127-127440192
  hyper
ggataatttgaaagtacaatagttggtttccctgtccacccgccccacttcgcttgccatcacag

SEQ ID NO: 19447 - DNA, 431 bp, Homo sapiens
  chr6:127441123-127441554
  hyper
tccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctc

SEQ ID NO: 19448 - DNA, 175 bp, Homo sapiens
  chr6:127442104-127442279
  hyper
ctcctcccagggtctggcctggggaattgagtctcagggtcagtgggcatagggagcccgggctggagcgcaacccactctgctttccatccgctcttccagcccgtgcccattgggcgtcccagagcacgctctctcctttacccccaccgaggacccccgggctgggagccac

SEQ ID NO: 19449 - DNA, 329 bp, Homo sapiens; identical to SEQ ID NO: 8721
  chr6:127836715-127837044
  hyper

SEQ ID NO: 19450 - DNA, 223 bp, Homo sapiens; identical to SEQ ID NO: 8722
  chr6:127837399-127837622
  hyper

SEQ ID NO: 19451 - DNA, 12 bp, Homo sapiens
  chr6:127840681-127840693
  hyper
cccacagagatc

SEQ ID NO: 19452 - DNA, 105 bp, Homo sapiens
  chr6:130686429-130686534
  hyper
ctcatcgaagacccccgtgcttcagttccctctgtcttccatttcccccgcccatggttctcgcccccccaagccgttctccggaaccccttgccgggccggcgg

SEQ ID NO: 19453 - DNA, 136 bp, Homo sapiens
  chr6:130687057-130687193
  hyper
ccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 19454 - DNA, 120 bp, Homo sapiens; identical to SEQ ID NO: 2918
  chr6:130687224-130687344
  hyper

SEQ ID NO: 19455 - DNA, 166 bp, Homo sapiens; identical to SEQ ID NO: 8727
  chr6:130687620-130687786
  hyper

SEQ ID NO: 19456 - DNA, 285 bp, Homo sapiens
  chr6:132722196-132722481
  hyper
tgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggt

SEQ ID NO: 19457 - DNA, 24 bp, Homo sapiens
  chr6:133563058-133563082
  hyper
cttggaggccgggtgccccacgcc

SEQ ID NO: 19458 - DNA, 97 bp, Homo sapiens
  chr6:133563918-133564015
  hyper
gtcatctcttccctgcttgggaggatagtgtttcccttcaccaccacccctctttctccttcctatgaagacaacggatttgcgcctggggtgagag

SEQ ID NO: 19459 - DNA, 30 bp, Homo sapiens; identical to SEQ ID NO: 8732
  chr6:134175985-134176015
  hyper

SEQ ID NO: 19460 - DNA, 97 bp, Homo sapiens; identical to SEQ ID NO: 8736
  chr6:134216904-134217001
  hyper

SEQ ID NO: 19461 - DNA, 30 bp, Homo sapiens; identical to SEQ ID NO: 8737
  chr6:134217399-134217429
  hyper

SEQ ID NO: 19462 - DNA, 281 bp, Homo sapiens; identical to SEQ ID NO: 8738
  chr6:134499571-134499852
  hyper

SEQ ID NO: 19463 - DNA, 95 bp, Homo sapiens; identical to SEQ ID NO: 8739
  chr6:134638851-134638946
  hyper

SEQ ID NO: 19464 - DNA, 21 bp, Homo sapiens
  chr6:137241907-137241928
  hyper
ggcaacgtgatgcagcgctaa

SEQ ID NO: 19465 - DNA, 44 bp, Homo sapiens; identical to SEQ ID NO: 8742
  chr6:137242390-137242434
  hyper

SEQ ID NO: 19466 - DNA, 86 bp, Homo sapiens; identical to SEQ ID NO: 8746
  chr6:137808768-137808854
  hyper

SEQ ID NO: 19467 - DNA, 33 bp, Homo sapiens
  chr6:137809108-137809141
  hyper
gcccctgtcctcctgcggtgcgagaaacccgac

SEQ ID NO: 19468 - DNA, 30 bp, Homo sapiens; identical to SEQ ID NO: 8750
  chr6:137814359-137814389
  hyper

SEQ ID NO: 19469 - DNA, 77 bp, Homo sapiens
  chr6:137815662-137815739
  hyper
tttagcaaggattcctattcatattcattgtggggccgccctgggacacctctgctccgaaccgctaggagccccca

SEQ ID NO: 19470 - DNA, 13 bp, Homo sapiens
  chr6:137816459-137816472
  hyper
cttcctggacctt

SEQ ID NO: 19471 - DNA, 198 bp, Homo sapiens; identical to SEQ ID NO: 8756
  chr6:137818062-137818260
  hyper

SEQ ID NO: 19472 - DNA, 180 bp, Homo sapiens
  chr6:137819368-137819548
  hyper
agcgaacccccacccccacccccgcaagagtccagtagcaaatgtcgctagctgacctgccgaagagctactgtgagaggcaggtcaatcagcaacgtccaggggctcctctcgctcatcaagcagcaaacttgaccagcagaaactttggccgagaccgaaaggcgggaggctgccctg

SEQ ID NO: 19473 - DNA, 30 bp, Homo sapiens; identical to SEQ ID NO: 8760
  chr6:142409862-142409892
  hyper

SEQ ID NO: 19474 - DNA, 148 bp, Homo sapiens; identical to SEQ ID NO: 8761
  chr6:146349536-146349684
  hyper

SEQ ID NO: 19475 - DNA, 71 bp, Homo sapiens
  chr6:146755496-146755567
  hyper
ggtgctggcaggccccggtggtcccgggaacgggctgcggtccctgtacccgcccccgccacctccgcagc

SEQ ID NO: 19476 - DNA, 12 bp, Homo sapiens
  chr6:146755649-146755661
  hyper
gaggtttaagct

SEQ ID NO: 19477 - DNA, 134 bp, Homo sapiens; identical to SEQ ID NO: 8763
  chr6:149069231-149069365
  hyper

SEQ ID NO: 19478 - DNA, 30 bp, Homo sapiens; identical to SEQ ID NO: 8764
  chr6:150284761-150284791
  hyper

SEQ ID NO: 19479 - DNA, 152 bp, Homo sapiens; identical to SEQ ID NO: 8768
  chr6:150311146-150311298
  hyper

SEQ ID NO: 19480 - DNA, 170 bp, Homo sapiens; identical to SEQ ID NO: 8769
  chr6:150311893-150312063
  hyper

SEQ ID NO: 19481 - DNA, 15 bp, Homo sapiens
  chr6:150359438-150359453
  hyper
cgggagaaagggaga

SEQ ID NO: 19482 - DNA, 135 bp, Homo sapiens
  chr6:151561857-151561992
  hyper
aggtacgggcgtgccgggccacctgcgccgggaggcgcgggtctttgggggtgggggtgggggtgggggggtccctccgatttccgccgagagaacttcccagcccatccagccgcatctgcaaactcaggagtg

SEQ ID NO: 19483 - DNA, 10 bp, Homo sapiens
  chr6:151562056-151562066
  hyper
cgcggcgggg

SEQ ID NO: 19484 - DNA, 113 bp, Homo sapiens; identical to SEQ ID NO: 8775
  chr6:151815244-151815357
  hyper

SEQ ID NO: 19485 - DNA, 78 bp, Homo sapiens
  chr6:152622937-152623015
  hyper
gaacatggagccactcgccaggctccagtcaaagagcaaagccgcggggacccactggatccttaccatgaccacaga

SEQ ID NO: 19486 - DNA, 90 bp, Homo sapiens; identical to SEQ ID NO: 8777
  chr6:152957532-152957622
  hyper

SEQ ID NO: 19487 - DNA, 209 bp, Homo sapiens
  chr6:152958076-152958285
  hyper
gttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagag

SEQ ID NO: 19488 - DNA, 259 bp, Homo sapiens
  chr6:153450977-153451236
  hyper
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtc

SEQ ID NO: 19489 - DNA, 80 bp, Homo sapiens
  chr6:153451810-153451890
  hyper
tcgttcccaaccaaccgcacaaaacccgcaacacctcgcgtccccgcggggtctcccgcgcccctggcccggccctcccg

SEQ ID NO: 19490 - DNA, 129 bp, Homo sapiens
  chr6:153452584-153452713
  hyper
ggccccgcccgacctcgcgcgctcgcctgggcgcggcgcccaccgtgcggaggggctcggccgggactctcggcttcggtgacgcccgtccggagcttcgcgggaggcccggagtcccgagagcttccc

SEQ ID NO: 19491 - DNA, 9 bp, Homo sapiens
  chr6:153452746-153452755
  hyper
aactccact

SEQ ID NO: 19492 - DNA, 66 bp, Homo sapiens
  chr6:154360584-154360650
  hyper
agcggcgaaaggaagcggctgaggcgcttggaacccgaaaagtctcggtgctcctggctacctcgc

SEQ ID NO: 19493 - DNA, 65 bp, Homo sapiens
  chr6:155316265-155316330
  hyper
ttgaattgttttatttgtgttgttccaaagaaagcgcgagggacatggtccgggaccagccggga

SEQ ID NO: 19494 - DNA, 30 bp, Homo sapiens; identical to SEQ ID NO: 8786
  chr6:158430625-158430655
  hyper

SEQ ID NO: 19495 - DNA, 53 bp, Homo sapiens; identical to SEQ ID NO: 8787
  chr6:158957871-158957924
  hyper

SEQ ID NO: 19496 - DNA, 263 bp, Homo sapiens
  chr6:159590986-159591249
  hyper
gtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgc

SEQ ID NO: 19497 - DNA, 10 bp, Homo sapiens
  chr6:159654913-159654923
  hyper
gaccacaggt

SEQ ID NO: 19498 - DNA, 187 bp, Homo sapiens; identical to SEQ ID NO: 8792
  chr6:161351859-161352046
  hyper

SEQ ID NO: 19499 - DNA, 136 bp, Homo sapiens; identical to SEQ ID NO: 8794
  chr6:166074525-166074661
  hyper

SEQ ID NO: 19500 - DNA, 163 bp, Homo sapiens; identical to SEQ ID NO: 8795
  chr6:166074962-166075125
  hyper

SEQ ID NO: 19501 - DNA, 30 bp, Homo sapiens; identical to SEQ ID NO: 8796
  chr6:166075459-166075489
  hyper

SEQ ID NO: 19502 - DNA, 39 bp, Homo sapiens; identical to SEQ ID NO: 8798
  chr6:166077961-166078000
  hyper

SEQ ID NO: 19503 - DNA, 116 bp, Homo sapiens; identical to SEQ ID NO: 8799
  chr6:166218546-166218662
  hyper

SEQ ID NO: 19504 - DNA, 40 bp, Homo sapiens
  chr6:166267542-166267582
  hyper
ctggacccagacagacgcgcggggtcctagggaagagccc

SEQ ID NO: 19505 - DNA, 30 bp, Homo sapiens; identical to SEQ ID NO: 8801
  chr6:166400601-166400631
  hyper

SEQ ID NO: 19506 - DNA, 30 bp, Homo sapiens; identical to SEQ ID NO: 8802
  chr6:166400920-166400950
  hyper

SEQ ID NO: 19507 - DNA, 105 bp, Homo sapiens
  chr6:166402546-166402651
  hyper
aggggactgctgcgcggattccccatccgcacccggctcgcggggaatccgtgggcttgcactcgccagaaagagctgctgcaggagcagccggatggtgaggcc

SEQ ID NO: 19508 - DNA, 8 bp, Homo sapiens
  chr6:166579715-166579723
  hyper
tttacaag

SEQ ID NO: 19509 - DNA, 200 bp, Homo sapiens
  chr6:166580144-166580344
  hyper
agtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctc

SEQ ID NO: 19510 - DNA, 18 bp, Homo sapiens
  chr6:166583078-166583096
  hyper
ctcatttgctcctgacgc

SEQ ID NO: 19511 - DNA, 88 bp, Homo sapiens; identical to SEQ ID NO: 8811
  chr6:166583152-166583240
  hyper

SEQ ID NO: 19512 - DNA, 91 bp, Homo sapiens; identical to SEQ ID NO: 8812
  chr6:166666972-166667063
  hyper

SEQ ID NO: 19513 - DNA, 34 bp, Homo sapiens; identical to SEQ ID NO: 8813
  chr6:168841594-168841628
  hyper

SEQ ID NO: 19514 - DNA, 80 bp, Homo sapiens; identical to SEQ ID NO: 8814
  chr6:168842084-168842164
  hyper

SEQ ID NO: 19515 - DNA, 57 bp, Homo sapiens; identical to SEQ ID NO: 8815
  chr6:169653992-169654049
  hyper

SEQ ID NO: 19516 - DNA, 71 bp, Homo sapiens; identical to SEQ ID NO: 8816
  chr6:170605686-170605757
  hyper

SEQ ID NO: 19517 - DNA, 85 bp, Homo sapiens; identical to SEQ ID NO: 8817
  chr7:330501-330586
  hyper

SEQ ID NO: 19518 - DNA, 134 bp, Homo sapiens
  chr7:751986-752120
  hyper
gcatccccggggggcctcccaggcccggggctcccggcgcagaccccagcccggccccgcgtacctggatgcgcggcgcccgaggccaggaggcggctgcgcggggacgcggggcgcggggacggctggcgagc

SEQ ID NO: 19519 - DNA, 41 bp, Homo sapiens
  chr7:752221-752262
  hyper
cccgtctccccccgaccgcctccccgcggggcccccaaccc

SEQ ID NO: 19520 - DNA, 25 bp, Homo sapiens
  chr7:1263736-1263761
  hyper
ttgtttaccaggctccgaggaggac

SEQ ID NO: 19521 - DNA, 214 bp, Homo sapiens
  chr7:1263960-1264174
  hyper
ccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagaca

SEQ ID NO: 19522 - DNA, 149 bp, Homo sapiens; identical to SEQ ID NO: 8821
  chr7:1265323-1265472
  hyper

SEQ ID NO: 19523 - DNA, 68 bp, Homo sapiens
  chr7:1269237-1269305
  hyper
ccagctgggcccaagcgcaggaggccggtcctcacggtgcgcccgggaagggaagggccgagcggcct

SEQ ID NO: 19524 - DNA, 113 bp, Homo sapiens; identical to SEQ ID NO: 8823
  chr7:1270162-1270275
  hyper

SEQ ID NO: 19525 - DNA, 334 bp, Homo sapiens; identical to SEQ ID NO: 8824
  chr7:1272630-1272964
  hyper

SEQ ID NO: 19526 - DNA, 127 bp, Homo sapiens
  chr7:1274514-1274641
  hyper
aagtctctgtgtggccgcgacaaagaatccgtattaacgcgccctcctggggagggcaggactgcccgagcttccgcggggctcagacggatttgactgtgtgtgtttggtggctggcggttgagtg

SEQ ID NO: 19527 - DNA, 137 bp, Homo sapiens
  chr7:1274677-1274814
  hyper
gctccccaggacaaggactgcagagaggatggaagagacgcgatgggcccagcctctccttccggcctggtggtcgcctcttgcctccccacctgccttggccggtggcccaggccaaggaccgcaggtttgggaag

SEQ ID NO: 19528 - DNA, 41 bp, Homo sapiens; identical to SEQ ID NO: 8827
  chr7:1276444-1276485
  hyper

SEQ ID NO: 19529 - DNA, 124 bp, Homo sapiens; identical to SEQ ID NO: 8828
  chr7:1277174-1277298
  hyper

SEQ ID NO: 19530 - DNA, 30 bp, Homo sapiens; identical to SEQ ID NO: 8829
  chr7:1280395-1280425
  hyper

SEQ ID NO: 19531 - DNA, 37 bp, Homo sapiens
  chr7:1282644-1282681
  hyper
cggcttctgctgattctttctgcggcctgataataag

SEQ ID NO: 19532 - DNA, 94 bp, Homo sapiens; identical to SEQ ID NO: 8833
  chr7:1283626-1283720
  hyper

SEQ ID NO: 19533 - DNA, 27 bp, Homo sapiens
  chr7:1286084-1286111
  hyper
agggcgggcagaggccgggctgggagg

SEQ ID NO: 19534 - DNA, 30 bp, Homo sapiens
  chr7:1288552-1288582
  hyper
tctgagggagctttccgtgggatggctggg

SEQ ID NO: 19535 - DNA, 122 bp, Homo sapiens; identical to SEQ ID NO: 8836
  chr7:1289414-1289536
  hyper

SEQ ID NO: 19536 - DNA, 124 bp, Homo sapiens; identical to SEQ ID NO: 2955
  chr7:1408647-1408771
  hyper

SEQ ID NO: 19537 - DNA, 34 bp, Homo sapiens; identical to SEQ ID NO: 2956
  chr7:1408874-1408908
  hyper

SEQ ID NO: 19538 - DNA, 603 bp, Homo sapiens; identical to SEQ ID NO: 8839
  chr7:1704139-1704742
  hyper

SEQ ID NO: 19539 - DNA, 91 bp, Homo sapiens; identical to SEQ ID NO: 8840
  chr7:1706301-1706392
  hyper

SEQ ID NO: 19540 - DNA, 128 bp, Homo sapiens; identical to SEQ ID NO: 8841
  chr7:1707040-1707168
  hyper

SEQ ID NO: 19541 - DNA, 45 bp, Homo sapiens
  chr7:1709093-1709138
  hyper
ccgagcgtggagtcccgaggctcctgccgggggtccaggctgccc

SEQ ID NO: 19542 - DNA, 209 bp, Homo sapiens
  chr7:1709235-1709444
  hyper
aggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgct

SEQ ID NO: 19543 - DNA, 21 bp, Homo sapiens
  chr7:1709902-1709923
  hyper
gaggaatttcaatcccgggag

SEQ ID NO: 19544 - DNA, 289 bp, Homo sapiens; identical to SEQ ID NO: 8844
  chr7:1709955-1710244
  hyper

SEQ ID NO: 19545 - DNA, 19 bp, Homo sapiens
  chr7:1710324-1710343
  hyper
cgtccgcaccctgcccggc

SEQ ID NO: 19546 - DNA, 36 bp, Homo sapiens; identical to SEQ ID NO: 8847
  chr7:3083169-3083205
  hyper

SEQ ID NO: 19547 - DNA, 190 bp, Homo sapiens
  chr7:3340254-3340444
  hyper
aaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcg

SEQ ID NO: 19548 - DNA, 142 bp, Homo sapiens
  chr7:3340473-3340615
  hyper
gcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtcccca

SEQ ID NO: 19549 - DNA, 30 bp, Homo sapiens; identical to SEQ ID NO: 8849
  chr7:3341956-3341986
  hyper

SEQ ID NO: 19550 - DNA, 199 bp, Homo sapiens
  chr7:4998388-4998587
  hyper
cacccagcgaggaggcgcgggcgccccggttactccatcccagcgagaagacgaggctgcctgggtcctggttttctcgggcgggggtcaggggtccgccgatcccctctagcgctccgggcggcggggcccgagaaccaaggtggcctccgcggcccccgccgccgcgcgcccctccctccctccccgcggacctccg

SEQ ID NO: 19551 - DNA, 66 bp, Homo sapiens
  chr7:6566347-6566413
  hyper
cctgagacaccacctcgtcgaagcgcgcccggtgcttcttggggatgaagatcctgccggcgagga

SEQ ID NO: 19552 - DNA, 244 bp, Homo sapiens; identical to SEQ ID NO: 8854
  chr7:6570454-6570698
  hyper

SEQ ID NO: 19553 - DNA, 26 bp, Homo sapiens
  chr7:6570933-6570959
  hyper
tgggacccttttggtcgctctggggt

SEQ ID NO: 19554 - DNA, 47 bp, Homo sapiens
  chr7:6571130-6571177
  hyper
catgcaatattttccggaggggatgccctttacgctgggcctccagg

SEQ ID NO: 19555 - DNA, 297 bp, Homo sapiens; identical to SEQ ID NO: 8856
  chr7:6654798-6655095
  hyper

SEQ ID NO: 19556 - DNA, 129 bp, Homo sapiens
  chr7:6703959-6704088
  hyper
agggcccgctgagtcggggccgctcgtgggccgcctggctgccgcctggggcctccggccgctgcgtcccgcggcttctgggaaccgtgcgcgctcacaggcggacttgggcctcgaacaaggttcctg

SEQ ID NO: 19557 - DNA, 282 bp, Homo sapiens
  chr7:8473674-8473956
  hyper
ctccagagcgtccccgggtggccgggcagcaccagggacagcgcccgggactccactggggaccggctcctgggcttcccagcgtcgcgggtagaggtacagctgctccgtgtgccgcaggctccagattctcgccaccccacccctccctcagaaactcggactgctctcgtctgccgtgtggttctcttttcttccgaaaggccagtgtcttatctctccacttcaagtccagaggacttgctcagtctcctccccttaagtcatttccaccatcctcag

SEQ ID NO: 19558 - DNA, 40 bp, Homo sapiens
  chr7:8475057-8475097
  hyper
ggaccgcgcgcttgctggtctcaggcgctggatttactcg

SEQ ID NO: 19559 - DNA, 54 bp, Homo sapiens; identical to SEQ ID NO: 8865
  chr7:8475348-8475402
  hyper

SEQ ID NO: 19560 - DNA, 53 bp, Homo sapiens; identical to SEQ ID NO: 8866
  chr7:8476668-8476721
  hyper

SEQ ID NO: 19561 - DNA, 40 bp, Homo sapiens
  chr7:8482016-8482056
  hyper
cctcgccatcacccccgccgccctaatggattctgaagcg

SEQ ID NO: 19562 - DNA, 102 bp, Homo sapiens
  chr7:8482921-8483023
  hyper
cccaacttctccccctacccagtctcccattctttcacagttcattaaatctacccctcccccgaaacagaaacgtgaaggctgtaacgaagagctagaagt

SEQ ID NO: 19563 - DNA, 4 bp, Homo sapiens
  chr7:8483950-8483954
  hyper
gaag

SEQ ID NO: 19564 - DNA, 197 bp, Homo sapiens; identical to SEQ ID NO: 8873
  chr7:11871392-11871589
  hyper

SEQ ID NO: 19565 - DNA, 98 bp, Homo sapiens; identical to SEQ ID NO: 8874
  chr7:12151205-12151303
  hyper

SEQ ID NO: 19566 - DNA, 23 bp, Homo sapiens
  chr7:12443294-12443317
  hyper
ggccaggaacatcagcgcgatca

SEQ ID NO: 19567 - DNA, 30 bp, Homo sapiens; identical to SEQ ID NO: 8877
  chr7:15725085-15725115
  hyper

SEQ ID NO: 19568 - DNA, 34 bp, Homo sapiens
  chr7:15725949-15725983
  hyper
agaggattgggagaacgggtgcaagccttgcgcc

SEQ ID NO: 19569 - DNA, 82 bp, Homo sapiens; identical to SEQ ID NO: 8881
  chr7:18125980-18126062
  hyper

SEQ ID NO: 19570 - DNA, 2 bp, Homo sapiens
  chr7:18126082-18126084
  hyper
cg

SEQ ID NO: 19571 - DNA, 94 bp, Homo sapiens; identical to SEQ ID NO: 8883
  chr7:18126664-18126758
  hyper

SEQ ID NO: 19572 - DNA, 253 bp, Homo sapiens
  chr7:19146249-19146502
  hyper
gaggccggaggctgacaccaccagggacccaacggagggtttattctgcccagcttcacatctgggggtcaaatcgcattaaagccaaaccaccaacggggcagggagcaggtggttaactgcacaaaataaagttacagaaaaaacctcgttttgcaggcgagtgacttagtttccctctgtagctttgccgtcataaaaagcaagtccctcccctctcctgagctggaaggcggggaaaggttatcagcgg

SEQ ID NO: 19573 - DNA, 24 bp, Homo sapiens
  chr7:19146558-19146582
  hyper
ttaggcgcgcgggctcccatcctc

SEQ ID NO: 19574 - DNA, 180 bp, Homo sapiens
  chr7:19146942-19147122
  hyper
cttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctcctta

SEQ ID NO: 19575 - DNA, 76 bp, Homo sapiens
  chr7:19147798-19147874
  hyper
tgctcccccccttcccaaatgctgttgctttttctctggcggtccccaccccctgcttcttcgttctccttcccta

SEQ ID NO: 19576 - DNA, 89 bp, Homo sapiens
  chr7:19157055-19157144
  hyper
cggaggagagagcaggaggacggacgggagggacctccgcggggagggcgcgcgggggaggcggggagggaggcgggagggggagggga

SEQ ID NO: 19577 - DNA, 30 bp, Homo sapiens; identical to SEQ ID NO: 8895
  chr7:19183647-19183677
  hyper

SEQ ID NO: 19578 - DNA, 161 bp, Homo sapiens
  chr7:19184255-19184416
  hyper
ccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctc

SEQ ID NO: 19579 - DNA, 32 bp, Homo sapiens; identical to SEQ ID NO: 8897
  chr7:19184803-19184835
  hyper

SEQ ID NO: 19580 - DNA, 30 bp, Homo sapiens; identical to SEQ ID NO: 8899
  chr7:20817170-20817200
  hyper

SEQ ID NO: 19581 - DNA, 121 bp, Homo sapiens; identical to SEQ ID NO: 8900
  chr7:20817836-20817957
  hyper

SEQ ID NO: 19582 - DNA, 148 bp, Homo sapiens
  chr7:20817982-20818130
  hyper
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaatt

SEQ ID NO: 19583 - DNA, 31 bp, Homo sapiens
  chr7:20823261-20823292
  hyper
acaaactctgggtctcgggctgccaaaagtc

SEQ ID NO: 19584 - DNA, 447 bp, Homo sapiens
  chr7:20823432-20823879
  hyper
gcctccagcctctccctctccaccgctccgctcaggcttgtcagccgagccgctcctgcccgcgcgaggcccgctgtctaccaggcactggattagtccagctctacctccagtggccgttccctctaaaagttacgcccttcacaacctggggggtggaggaggggaggacaaggaagagagaacgagaaataaaggcccgacgaggcgcgggttccggctgcaacgggttcaggcagcgttacccgtggaaagggaaagccagggcccgggacagcgatgcgtgttacttacttgtccatatcccctttacaaagttaagtcacagaaggaagaaggaagaggggcagaaacagaaagagacagagagcgagtcggatgcaatagggaaaggctggagttgaagtccggacagacagggcccaagaggacttggtgggaggaggt

SEQ ID NO: 19585 - DNA, 49 bp, Homo sapiens; identical to SEQ ID NO: 8906
  chr7:20826611-20826660
  hyper

SEQ ID NO: 19586 - DNA, 41 bp, Homo sapiens; identical to SEQ ID NO: 8907
  chr7:20827412-20827453
  hyper

SEQ ID NO: 19587 - DNA, 130 bp, Homo sapiens
  chr7:20830700-20830830
  hyper
gcgtccctggcctgcgcctctcccagaatgggaagacgacccccaaccccttgactagtgtgcggggtcctcgcacgcggacgtgttggctactaaataaagcgtgaagagggatcgctgggtagctgag

SEQ ID NO: 19588 - DNA, 30 bp, Homo sapiens; identical to SEQ ID NO: 8909
  chr7:20833089-20833119
  hyper

SEQ ID NO: 19589 - DNA, 30 bp, Homo sapiens; identical to SEQ ID NO: 8910
  chr7:20836099-20836129
  hyper

SEQ ID NO: 19590 - DNA, 30 bp, Homo sapiens; identical to SEQ ID NO: 8911
  chr7:20836810-20836840
  hyper

SEQ ID NO: 19591 - DNA, 50 bp, Homo sapiens; identical to SEQ ID NO: 8912
  chr7:20838460-20838510
  hyper

SEQ ID NO: 19592 - DNA, 40 bp, Homo sapiens
  chr7:21582868-21582908
  hyper
agcccaggtggcagcccgggaggcgcgagacttcagagaa

SEQ ID NO: 19593 - DNA, 31 bp, Homo sapiens
  chr7:22589325-22589356
  hyper
tttcccaggtggtgccgtggtggccgtgggg

SEQ ID NO: 19594 - DNA, 476 bp, Homo sapiens; identical to SEQ ID NO: 8918
  chr7:23508261-23508737
  hyper

SEQ ID NO: 19595 - DNA, 220 bp, Homo sapiens; identical to SEQ ID NO: 8919
  chr7:23509018-23509238
  hyper

SEQ ID NO: 19596 - DNA, 30 bp, Homo sapiens; identical to SEQ ID NO: 8920
  chr7:23509641-23509671
  hyper

SEQ ID NO: 19597 - DNA, 406 bp, Homo sapiens; identical to SEQ ID NO: 8921
  chr7:23513721-23514127
  hyper

SEQ ID NO: 19598 - DNA, 36 bp, Homo sapiens; identical to SEQ ID NO: 8922
  chr7:23514666-23514702
  hyper

SEQ ID NO: 19599 - DNA, 23 bp, Homo sapiens
  chr7:24796567-24796590
  hyper
tgcacacacgcccccgagccggg

SEQ ID NO: 19600 - DNA, 301 bp, Homo sapiens; identical to SEQ ID NO: 8924
  chr7:24797253-24797554
  hyper

SEQ ID NO: 19601 - DNA, 80 bp, Homo sapiens
  chr7:25896441-25896521
  hyper
cagtgtgggtgagagcgcagtctgtgaccaccagcgcttctgactcagcggaaaacgccggcaaacaggactacacctca

SEQ ID NO: 19602 - DNA, 74 bp, Homo sapiens
  chr7:25896864-25896938
  hyper
gctagagaggagtaaatccttctgtcgtccccgttctgccgcccccgcgatgatttatgcgtcctttttattat

SEQ ID NO: 19603 - DNA, 30 bp, Homo sapiens; identical to SEQ ID NO: 8927
  chr7:25902574-25902604
  hyper

SEQ ID NO: 19604 - DNA, 281 bp, Homo sapiens; identical to SEQ ID NO: 8928
  chr7:26415803-26416084
  hyper

SEQ ID NO: 19605 - DNA, 61 bp, Homo sapiens
  chr7:27135266-27135327
  hyper
acacccccaggttcccggaagtctggtaggtagccggctgggggtggcgatggtggtggtg

SEQ ID NO: 19606 - DNA, 34 bp, Homo sapiens
  chr7:27135979-27136013
  hyper
cgttcaatgaaagatgaactggcgagaggtgaga

SEQ ID NO: 19607 - DNA, 219 bp, Homo sapiens
  chr7:27190372-27190591
  hyper
gggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggcc

SEQ ID NO: 19608 - DNA, 71 bp, Homo sapiens
  chr7:27204416-27204487
  hyper
tcgagagaaacctggcgggccagcagatccgggaggccggcgtggaggcggcggcggatttgaagggagga

SEQ ID NO: 19609 - DNA, 80 bp, Homo sapiens; identical to SEQ ID NO: 8941
  chr7:27209584-27209664
  hyper

SEQ ID NO: 19610 - DNA, 85 bp, Homo sapiens
  chr7:27212899-27212984
  hyper
ctgatccttctcctccttgtgtctgcctgtctgcccgcctgactgcagccctctgcagccctgcttacccagggaatccttctcc

SEQ ID NO: 19611 - DNA, 448 bp, Homo sapiens; identical to SEQ ID NO: 8945
  chr7:27219396-27219844
  hyper

SEQ ID NO: 19612 - DNA, 27 bp, Homo sapiens
  chr7:27223166-27223193
  hyper
cagcttctgcctccccggccagccttc

SEQ ID NO: 19613 - DNA, 59 bp, Homo sapiens; identical to SEQ ID NO: 8947
  chr7:27223221-27223280
  hyper

SEQ ID NO: 19614 - DNA, 64 bp, Homo sapiens
  chr7:27223696-27223760
  hyper
tcaaaagctcccgaagcccttgcagggggaatttacaggcgcccacctccggctccccagcctg

SEQ ID NO: 19615 - DNA, 93 bp, Homo sapiens
  chr7:27223976-27224069
  hyper
ataaaaatttaacagcggtgctgcgctagatttccaactcccctttcataaagcgcagggcgctgcctttatacgtactggagccgccggcct

SEQ ID NO: 19616 - DNA, 18 bp, Homo sapiens
  chr7:27232962-27232980
  hyper
ctccgagttcacacccca

SEQ ID NO: 19617 - DNA, 32 bp, Homo sapiens; identical to SEQ ID NO: 8952
  chr7:27239141-27239173
  hyper

SEQ ID NO: 19618 - DNA, 214 bp, Homo sapiens
  chr7:27239234-27239448
  hyper
gctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggcc

SEQ ID NO: 19619 - DNA, 162 bp, Homo sapiens; identical to SEQ ID NO: 8954
  chr7:27239668-27239830
  hyper

SEQ ID NO: 19620 - DNA, 30 bp, Homo sapiens; identical to SEQ ID NO: 8956
  chr7:27240997-27241027
  hyper

SEQ ID NO: 19621 - DNA, 24 bp, Homo sapiens
  chr7:27252795-27252819
  hyper
tttttctttctctcccggattgtt

SEQ ID NO: 19622 - DNA, 270 bp, Homo sapiens; identical to SEQ ID NO: 8960
  chr7:27252895-27253165
  hyper

SEQ ID NO: 19623 - DNA, 18 bp, Homo sapiens
  chr7:27279453-27279471
  hyper
cgccgggcctggagcggc

SEQ ID NO: 19624 - DNA, 282 bp, Homo sapiens
  chr7:27283013-27283295
  hyper
aaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 19625 - DNA, 30 bp, Homo sapiens; identical to SEQ ID NO: 8968
  chr7:27289482-27289512
  hyper

SEQ ID NO: 19626 - DNA, 44 bp, Homo sapiens; identical to SEQ ID NO: 8969
  chr7:27289813-27289857
  hyper

SEQ ID NO: 19627 - DNA, 173 bp, Homo sapiens; identical to SEQ ID NO: 667
  chr7:27290946-27291119
  hyper

SEQ ID NO: 19628 - DNA, 23 bp, Homo sapiens
  chr7:28449253-28449276
  hyper
ttgtaaacattttggcggaccag

SEQ ID NO: 19629 - DNA, 26 bp, Homo sapiens
  chr7:28450015-28450041
  hyper
cggcagattctcggcagaatcacttg

SEQ ID NO: 19630 - DNA, 217 bp, Homo sapiens
  chr7:28996623-28996840
  hyper
cggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagcc

SEQ ID NO: 19631 - DNA, 8 bp, Homo sapiens
  chr7:28997128-28997136
  hyper
caagggag

SEQ ID NO: 19632 - DNA, 21 bp, Homo sapiens
  chr7:28997625-28997646
  hyper
ccacgagcaggaggcgcaagg

SEQ ID NO: 19633 - DNA, 377 bp, Homo sapiens
  chr7:28997676-28998053
  hyper
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggag

SEQ ID NO: 19634 - DNA, 36 bp, Homo sapiens
  chr7:28998119-28998155
  hyper
gcaccttctcgctcgcggtcccggacggggagggcg

SEQ ID NO: 19635 - DNA, 332 bp, Homo sapiens; identical to SEQ ID NO: 3015
  chr7:29185865-29186197
  hyper

SEQ ID NO: 19636 - DNA, 43 bp, Homo sapiens; identical to SEQ ID NO: 8981
  chr7:29604285-29604328
  hyper

SEQ ID NO: 19637 - DNA, 95 bp, Homo sapiens; identical to SEQ ID NO: 8982
  chr7:29846202-29846297
  hyper

SEQ ID NO: 19638 - DNA, 78 bp, Homo sapiens
  chr7:30721202-30721280
  hyper
gggaacttcaggcaacgggaacctacaatgagggaaggaggtttacactccaagaggaggaagtatttccttctcccc

SEQ ID NO: 19639 - DNA, 88 bp, Homo sapiens; identical to SEQ ID NO: 8984
  chr7:30722026-30722114
  hyper

SEQ ID NO: 19640 - DNA, 175 bp, Homo sapiens
  chr7:30722115-30722290
  hyper
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagc

SEQ ID NO: 19641 - DNA, 39 bp, Homo sapiens; identical to SEQ ID NO: 8986
  chr7:31092310-31092349
  hyper

SEQ ID NO: 19642 - DNA, 15 bp, Homo sapiens
  chr7:31092684-31092699
  hyper
ctacccttaggtgga

SEQ ID NO: 19643 - DNA, 167 bp, Homo sapiens; identical to SEQ ID NO: 8988
  chr7:31092713-31092880
  hyper

SEQ ID NO: 19644 - DNA, 109 bp, Homo sapiens
  chr7:31092894-31093003
  hyper
cggaggggctggggttggggatgccagggcttcagtggtccccagaagaaacgccctgcggggtctgtggggaaacgcaccggccttcccaggttgaagtgggcccgct

SEQ ID NO: 19645 - DNA, 57 bp, Homo sapiens
  chr7:31093133-31093190
  hyper
gaccctcaggagggaacccagccggaagccgattgcatttcacgtggagctgaggag

SEQ ID NO: 19646 - DNA, 39 bp, Homo sapiens; identical to SEQ ID NO: 8990
  chr7:32110353-32110392
  hyper

SEQ ID NO: 19647 - DNA, 23 bp, Homo sapiens
  chr7:32110772-32110795
  hyper
gccaccaccgacctgcggagctg

SEQ ID NO: 19648 - DNA, 178 bp, Homo sapiens
  chr7:32338410-32338588
  hyper
cggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctc

SEQ ID NO: 19649 - DNA, 85 bp, Homo sapiens
  chr7:32338930-32339015
  hyper
acaaggaagtcgggaaaatcgccacgcccacttccttctagccactgcccccagcactggcctggagccccgatagtgtttcttc

SEQ ID NO: 19650 - DNA, 42 bp, Homo sapiens
  chr7:32467419-32467461
  hyper
gtaaggaaactcacccgctgcgctgcggcttcgtggccagca

SEQ ID NO: 19651 - DNA, 30 bp, Homo sapiens; identical to SEQ ID NO: 8997
  chr7:32468472-32468502
  hyper

SEQ ID NO: 19652 - DNA, 199 bp, Homo sapiens
  chr7:33943759-33943958
  hyper
cttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcg

SEQ ID NO: 19653 - DNA, 123 bp, Homo sapiens; identical to SEQ ID NO: 8999
  chr7:33944250-33944373
  hyper

SEQ ID NO: 19654 - DNA, 81 bp, Homo sapiens; identical to SEQ ID NO: 9000
  chr7:33944751-33944832
  hyper

SEQ ID NO: 19655 - DNA, 66 bp, Homo sapiens; identical to SEQ ID NO: 9001
  chr7:33945406-33945472
  hyper

SEQ ID NO: 19656 - DNA, 529 bp, Homo sapiens
  chr7:35225280-35225809
  hyper
aagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtg

SEQ ID NO: 19657 - DNA, 149 bp, Homo sapiens
  chr7:35226044-35226193
  hyper
cgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttg

SEQ ID NO: 19658 - DNA, 185 bp, Homo sapiens
  chr7:35293293-35293478
  hyper
agggagacaaagacccgaaacacagctcaaagtttccgagagcagtcacagcggggccagggactccagaagtgtcagctccaacgactccagagctgcacactggcctctattccccaccgcaaagccccagagccgcagagacttcgaaggcagccggagaggagagggcccaccgagcacta

SEQ ID NO: 19659 - DNA, 39 bp, Homo sapiens
  chr7:35294536-35294575
  hyper
cagacccctctggttttacaaaggcggctgtgacgagga

SEQ ID NO: 19660 - DNA, 51 bp, Homo sapiens
  chr7:37487113-37487164
  hyper
ggtcaaggcaggtcccgacccgcctccaacttcaaatggccccctaggcgg

SEQ ID NO: 19661 - DNA, 116 bp, Homo sapiens
  chr7:37488141-37488257
  hyper
aaacaaaagtgtctccgcggcgcccggagtcccccggagcaggacgcctcctcccggccccagtcccggccccctcccctgccgcgccgaggtcagcgagtcggggcgcggcgcca

SEQ ID NO: 19662 - DNA, 342 bp, Homo sapiens
  chr7:37488578-37488920
  hyper
aactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatcctttt

SEQ ID NO: 19663 - DNA, 27 bp, Homo sapiens
  chr7:37488992-37489019
  hyper
tgtttgttttgacgctgtgcctctacc

SEQ ID NO: 19664 - DNA, 133 bp, Homo sapiens
  chr7:37955745-37955878
  hyper
catagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactc

SEQ ID NO: 19665 - DNA, 54 bp, Homo sapiens
  chr7:37956439-37956493
  hyper
cctatttatcccgacacctcccctgacgtgggctcggaacgctcccttggcagc

SEQ ID NO: 19666 - DNA, 72 bp, Homo sapiens; identical to SEQ ID NO: 9018
  chr7:37960465-37960537
  hyper

SEQ ID NO: 19667 - DNA, 396 bp, Homo sapiens; identical to SEQ ID NO: 9019
  chr7:37960562-37960958
  hyper

SEQ ID NO: 19668 - DNA, 44 bp, Homo sapiens; identical to SEQ ID NO: 9021
  chr7:38671120-38671164
  hyper

SEQ ID NO: 19669 - DNA, 64 bp, Homo sapiens; identical to SEQ ID NO: 9023
  chr7:39453541-39453605
  hyper

SEQ ID NO: 19670 - DNA, 30 bp, Homo sapiens; identical to SEQ ID NO: 9024
  chr7:39454074-39454104
  hyper

SEQ ID NO: 19671 - DNA, 35 bp, Homo sapiens
  chr7:42267677-42267712
  hyper
cggcggcggcgcggtgggttcattagcgggcgcgc

SEQ ID NO: 19672 - DNA, 42 bp, Homo sapiens; identical to SEQ ID NO: 9026
  chr7:42275797-42275839
  hyper

SEQ ID NO: 19673 - DNA, 50 bp, Homo sapiens; identical to SEQ ID NO: 9027
  chr7:42276128-42276178
  hyper

SEQ ID NO: 19674 - DNA, 261 bp, Homo sapiens
  chr7:42276634-42276895
  hyper
cggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcc

SEQ ID NO: 19675 - DNA, 47 bp, Homo sapiens; identical to SEQ ID NO: 9029
  chr7:42277420-42277467
  hyper

SEQ ID NO: 19676 - DNA, 73 bp, Homo sapiens; identical to SEQ ID NO: 9030
  chr7:42277748-42277821
  hyper

SEQ ID NO: 19677 - DNA, 215 bp, Homo sapiens
  chr7:43152700-43152915
  hyper
agcctgggtcgcgccgccgcccggtccgggccggcatccccgggtggcgaccccggcttgggtactgcaggcgcacccggccctcctgcggggtacggagagaaacaaagaagcccccaagcgggttcgcagcgcctcccccgcccctcagcgccctcccagtggcgaggaggtgtcaggggagggggcggagagacctacgtaatcccccttcc

SEQ ID NO: 19678 - DNA, 244 bp, Homo sapiens
  chr7:43153237-43153481
  hyper
agacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtctt

SEQ ID NO: 19679 - DNA, 41 bp, Homo sapiens; identical to SEQ ID NO: 9034
  chr7:44144029-44144070
  hyper

SEQ ID NO: 19680 - DNA, 102 bp, Homo sapiens
  chr7:44364736-44364838
  hyper
agagctgggcagggccgcgcgcgctgaggtcaggcagccaggcccggggccgggggctcgcgggtcggggccgcgcggggccgtgcgcttgggcccggagcc

SEQ ID NO: 19681 - DNA, 179 bp, Homo sapiens
  chr7:44364903-44365082
  hyper
gtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcc

SEQ ID NO: 19682 - DNA, 66 bp, Homo sapiens; identical to SEQ ID NO: 9036
  chr7:44365117-44365183
  hyper

SEQ ID NO: 19683 - DNA, 250 bp, Homo sapiens
  chr7:45613535-45613785
  hyper
ccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaagga

SEQ ID NO: 19684 - DNA, 443 bp, Homo sapiens
  chr7:45613898-45614341
  hyper
ggtcgccgccgaggaccacggtcggggcgcgggcgggctccagtgcgcaggcgcggcgggcgggaggggacgcgctccgggcgcgcgcgcggggcagccggcgccccaactccgcccgccccgcgccccgcgccccggcgcctcgccgcccgccgcccgcccgccccggcgccgccgcccgcgccccggcgccccgggccggcgaggggcgcgcccgcggccgcggccgctgcatggcgctgagatggcgggggcgccgcgcggcggaggcggcggcggaggcggcgcgggcgagcccgggggcgccgagcgggcggccgggacaagccgccggcgcgggctccgggcgtgcgacgaggagttcgcttgcccagagctggaggcgctgttccgcggctacacgctgcggctggagcaggcggccacgctgaaggcgctggccg

SEQ ID NO: 19685 - DNA, 263 bp, Homo sapiens
  chr7:45614474-45614737
  hyper
ccggtccctgcaggtgccccagctgcagcaggtcggccagctggcgctgctcttcagcctcaccttcgcgctgctctgctgtcctttcgcgctgggcggccccgcccggggttccgccggggccgctggggggccagcgaccgccgaacaaggggtttggcagctccttttggtcaccttcgtgtcctatgccttgctgcccgtgcgcagcctgctggccataggctttgggctcgtggtggctgcgtcgcacttgctggtca

SEQ ID NO: 19686 - DNA, 87 bp, Homo sapiens; identical to SEQ ID NO: 9039
  chr7:45928490-45928577
  hyper

SEQ ID NO: 19687 - DNA, 322 bp, Homo sapiens
  chr7:45960794-45961116
  hyper
acagtacacggcgcgaagctgtggaatccaggcaggaagcggctgatcctcagcgcccagccgcagtgctcgcatctgggcggcccgggcgcgccggccgctatatagaagccggggtggcccaggacacgccccggaacggcgcgcccaggagtgggggttgggaggggggcgggtcggcgcaggcacggctgcgggggcccgtgcttcgccctgagcagccggggccgagctcgggggcgtgcagctcgagactcgcccgggcacctgctcctcgtgcgcacgcccggagcccgggtcaccttgtcgtctacaagaacca

SEQ ID NO: 19688 - DNA, 55 bp, Homo sapiens
  chr7:45961778-45961833
  hyper
gtattactgtattctcgatgcgttgggattctagcttatctctgcaatctaaaca

SEQ ID NO: 19689 - DNA, 69 bp, Homo sapiens
  chr7:45961888-45961957
  hyper
cggccttctctggcactcgagtttcttcagttttgtctgcgcaccccctcccttcggtgaccaacagag

SEQ ID NO: 19690 - DNA, 713 bp, Homo sapiens; identical to SEQ ID NO: 9043
  chr7:48074975-48075688
  hyper

SEQ ID NO: 19691 - DNA, 12 bp, Homo sapiens
  chr7:49813994-49814006
  hyper
agagaggctgga

SEQ ID NO: 19692 - DNA, 29 bp, Homo sapiens
  chr7:50343234-50343263
  hyper
gccggagcctgaacccgggagccaagggg

SEQ ID NO: 19693 - DNA, 89 bp, Homo sapiens
  chr7:50343401-50343490
  hyper
ggtgcagggtggcgggcccggcggcgcgcgtccccctccccctcctggcggcccgcacgtgtcgcccgcgccgcgcccccacgggttac

SEQ ID NO: 19694 - DNA, 232 bp, Homo sapiens
  chr7:50343994-50344226
  hyper
agggaccgccagcgtgcgtcaccccaaagtttgcggggtggcagggcgcgcgctctggccacccgccgctctgggcggcagctggtggcaacgcaagggcgcggcgggggcggccggcgcggagggggccaggtacggggcccgcgggcggcgctgtgcgcgcggggcagccggtcggccgggagcgcgaaagcctggtctgagccggctgggggcggggagtgtggcggag

SEQ ID NO: 19695 - DNA, 247 bp, Homo sapiens
  chr7:50344491-50344738
  hyper
gccccaaagcgcgacgcacaaatccacgtgagtgttttcaaattgaatttcaataggaaaacttggggtaactggtgaatttaaaaaaaaaaaaacacagtaaagaaaagcggtaaggttggtagaccctggtgtcgctcaggtccgcctctcttttctgaggacagtgagagagttcacttctgtcaagcgtctgttgctctgcactgtgccagcaggtgcaggaccaggccgacatgggacactt

SEQ ID NO: 19696 - DNA, 71 bp, Homo sapiens; identical to SEQ ID NO: 9054
  chr7:54614037-54614108
  hyper

SEQ ID NO: 19697 - DNA, 72 bp, Homo sapiens; identical to SEQ ID NO: 9055
  chr7:54732296-54732368
  hyper

SEQ ID NO: 19698 - DNA, 34 bp, Homo sapiens
  chr7:64349056-64349090
  hyper
gtcttcggggtgagaggtccggctcctggaggac

SEQ ID NO: 19699 - DNA, 37 bp, Homo sapiens; identical to SEQ ID NO: 9057
  chr7:64407804-64407841
  hyper

SEQ ID NO: 19700 - DNA, 282 bp, Homo sapiens; identical to SEQ ID NO: 9058
  chr7:64700367-64700649
  hyper

SEQ ID NO: 19701 - DNA, 174 bp, Homo sapiens
  chr7:64712510-64712684
  hyper
cgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgt

SEQ ID NO: 19702 - DNA, 215 bp, Homo sapiens; identical to SEQ ID NO: 9060
  chr7:64734490-64734705
  hyper

SEQ ID NO: 19703 - DNA, 112 bp, Homo sapiens
  chr7:64974270-64974382
  hyper
cgggggctaaaagccgcaaaaagccgcggaggggggagcgaaaagcagtgggagctggggcaaaaaaccacaaaaagccgaggcagcggcggcagaaaacctcggcagcggg

SEQ ID NO: 19704 - DNA, 28 bp, Homo sapiens
  chr7:64974422-64974450
  hyper
aaagccgcggtggcaaaaatgcgcggcg

SEQ ID NO: 19705 - DNA, 480 bp, Homo sapiens; identical to SEQ ID NO: 3051
  chr7:64974510-64974990
  hyper

SEQ ID NO: 19706 - DNA, 56 bp, Homo sapiens; identical to SEQ ID NO: 9064
  chr7:65446028-65446084
  hyper

SEQ ID NO: 19707 - DNA, 30 bp, Homo sapiens
  chr7:65508965-65508995
  hyper
cagcctgctaagtcccgggtcggataccag

SEQ ID NO: 19708 - DNA, 144 bp, Homo sapiens
  chr7:69062375-69062519
  hyper
gcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatc

SEQ ID NO: 19709 - DNA, 333 bp, Homo sapiens
  chr7:69062635-69062968
  hyper
tccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcc

SEQ ID NO: 19710 - DNA, 82 bp, Homo sapiens
  chr7:69065045-69065127
  hyper
gtctgtctgtctgtctgtctgtctgtctaggctgaggtcttattgttggtggggggagctgggggcgcgggcagacaggcag

SEQ ID NO: 19711 - DNA, 30 bp, Homo sapiens; identical to SEQ ID NO: 9068
  chr7:70596147-70596177
  hyper

SEQ ID NO: 19712 - DNA, 62 bp, Homo sapiens
  chr7:71217046-71217108
  hyper
aacgtttcgcagcaccgggtccaaggaagtgcaatacaacagcaaaatgcaatggccgcagc

SEQ ID NO: 19713 - DNA, 45 bp, Homo sapiens
  chr7:71800631-71800676
  hyper
gggaactgcaggcaccgcttcacccaggagctacgggcttcgacc

SEQ ID NO: 19714 - DNA, 35 bp, Homo sapiens
  chr7:71802637-71802672
  hyper
ccagggggaaggcggggcgccgaagtggaggggcc

SEQ ID NO: 19715 - DNA, 138 bp, Homo sapiens; identical to SEQ ID NO: 9076
  chr7:76145381-76145519
  hyper

SEQ ID NO: 19716 - DNA, 17 bp, Homo sapiens
  chr7:79081775-79081792
  hyper
gtcccttcttttcttcg

SEQ ID NO: 19717 - DNA, 202 bp, Homo sapiens
  chr7:79083190-79083392
  hyper
cgcgccgggtggggagccacggagggcttcgccgctgcctccctccctccctccgcagcttgacccggtagtgaaggcagagagagaggcaggctgggtccgcctggcagcctacgggaggaggcgggagccgggaaggaggggagcctaggcccggcgtggggaggccggcaggaagggcctcgagcccagtgcggacctt

SEQ ID NO: 19718 - DNA, 5 bp, Homo sapiens
  chr7:82072503-82072508
  hyper
tccag

SEQ ID NO: 19719 - DNA, 45 bp, Homo sapiens; identical to SEQ ID NO: 9081
  chr7:83278225-83278270
  hyper

SEQ ID NO: 19720 - DNA, 46 bp, Homo sapiens; identical to SEQ ID NO: 9082
  chr7:84814651-84814697
  hyper

SEQ ID NO: 19721 - DNA, 71 bp, Homo sapiens; identical to SEQ ID NO: 9084
  chr7:84816281-84816352
  hyper

SEQ ID NO: 19722 - DNA, 177 bp, Homo sapiens
  chr7:86273541-86273718
  hyper
ggcttttcgtataaaaatcctctcgtctaggtaccctggctcactgaagactctgcagatatacccttataagagggagggtgggggagggaaaagaacgagagagggaggaaagaatgaaaaggagaggatgccaggaggtccgtgcttctgccaagagtcccaattagatgcgac

SEQ ID NO: 19723 - DNA, 13 bp, Homo sapiens
  chr7:86273719-86273732
  hyper
gcttcagcctggt

SEQ ID NO: 19724 - DNA, 3 bp, Homo sapiens
  chr7:87104813-87104816
  hyper
caa

SEQ ID NO: 19725 - DNA, 90 bp, Homo sapiens
  chr7:87230433-87230523
  hyper
attggggacatttcaacttatgtagacacgtctttcaaagttcacataagtcttcatatccatataactacaggacgtagttaagggaaa

SEQ ID NO: 19726 - DNA, 148 bp, Homo sapiens; identical to SEQ ID NO: 9091
  chr7:87257340-87257488
  hyper

SEQ ID NO: 19727 - DNA, 41 bp, Homo sapiens; identical to SEQ ID NO: 9092
  chr7:87258357-87258398
  hyper

SEQ ID NO: 19728 - DNA, 57 bp, Homo sapiens; identical to SEQ ID NO: 9093
  chr7:87936127-87936184
  hyper

SEQ ID NO: 19729 - DNA, 219 bp, Homo sapiens
  chr7:88388660-88388879
  hyper
tcaagcacaggtcgccgcgtccccaactccctgtcctcaccccggcccgcccgtctcctcctccgccctctcccgactgcagcgggggcagcgctttggcgctcccaaggactccccgccactctccccacaaagcagcggcggtggcggcggctgctgctggatcttcacactgcagccagcagcccaggacgcccccggccggacgatgggtacccg

SEQ ID NO: 19730 - DNA, 91 bp, Homo sapiens
  chr7:89748340-89748431
  hyper
gcaggcgctggggagagtgtggagaggctgcgtggagctgcgcgctcggggtgggggctgcactcccaatgaagcgcgtgaagggcaagcg

SEQ ID NO: 19731 - DNA, 1 bp, Homo sapiens
  chr7:90226268-90226269
  hyper
g

SEQ ID NO: 19732 - DNA, 85 bp, Homo sapiens
  chr7:90226464-90226549
  hyper
tggtattgtttaacgtatccaacctaaagggaagtgggacagttaccttgggacctattgttcggtacttcgggtcctggaaagc

SEQ ID NO: 19733 - DNA, 329 bp, Homo sapiens; identical to SEQ ID NO: 9101
  chr7:91808202-91808531
  hyper

SEQ ID NO: 19734 - DNA, 34 bp, Homo sapiens
  chr7:93204298-93204332
  hyper
cgctccagtcagggctggggctcaccctgcgagt

SEQ ID NO: 19735 - DNA, 263 bp, Homo sapiens
  chr7:93551060-93551323
  hyper
agcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggc

SEQ ID NO: 19736 - DNA, 56 bp, Homo sapiens
  chr7:93551425-93551481
  hyper
cccgagcccggttctggggcgaaaatgcctgcccttcacatcgaagatttgccaga

SEQ ID NO: 19737 - DNA, 223 bp, Homo sapiens
  chr7:94284873-94285096
  hyper
acacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaa

SEQ ID NO: 19738 - DNA, 61 bp, Homo sapiens; identical to SEQ ID NO: 9109
  chr7:94536939-94537000
  hyper

SEQ ID NO: 19739 - DNA, 24 bp, Homo sapiens
  chr7:96625974-96625998
  hyper
gagcctgacaggtcccgggtccca

SEQ ID NO: 19740 - DNA, 35 bp, Homo sapiens
  chr7:96626051-96626086
  hyper
taagtaactcaaacccgacccggcaagcgtggccc

SEQ ID NO: 19741 - DNA, 118 bp, Homo sapiens; identical to SEQ ID NO: 9114
  chr7:96627308-96627426
  hyper

SEQ ID NO: 19742 - DNA, 106 bp, Homo sapiens
  chr7:96635239-96635345
  hyper
agggtggaggaaacccgggagaaggctttctccagcccccaaagtttttgatgatgaccatgactacgatggctgacggcttggaaggccaggactcgtccaaatc

SEQ ID NO: 19743 - DNA, 104 bp, Homo sapiens; identical to SEQ ID NO: 9117
  chr7:96635486-96635590
  hyper

SEQ ID NO: 19744 - DNA, 114 bp, Homo sapiens
  chr7:96635619-96635733
  hyper
cgctcgctcgccgcctacccctacatgagccactcgcagcacagcccttacctccagtcctaccacaacagcagcgcagccgcccagacgcgaggggacgacacaggtgagagg

SEQ ID NO: 19745 - DNA, 15 bp, Homo sapiens
  chr7:96636645-96636660
  hyper
cgcaccccagagagc

SEQ ID NO: 19746 - DNA, 36 bp, Homo sapiens; identical to SEQ ID NO: 9121
  chr7:96642045-96642081
  hyper

SEQ ID NO: 19747 - DNA, 157 bp, Homo sapiens; identical to SEQ ID NO: 9122
  chr7:96645902-96646059
  hyper

SEQ ID NO: 19748 - DNA, 41 bp, Homo sapiens; identical to SEQ ID NO: 9125
  chr7:96652088-96652129
  hyper

SEQ ID NO: 19749 - DNA, 30 bp, Homo sapiens; identical to SEQ ID NO: 9128
  chr7:96656812-96656842
  hyper

SEQ ID NO: 19750 - DNA, 69 bp, Homo sapiens
  chr7:97361029-97361098
  hyper
ggacggaaaagttaccgaagtccaaggaatgagtcactttgctcaaatttgatgagtaatatcaggtgt

SEQ ID NO: 19751 - DNA, 94 bp, Homo sapiens
  chr7:97362198-97362292
  hyper
ttcccgggttccccacgggattttgtgcccacgattcaagtttcttcccgagggctgcaccgtccggcccaggaactccctgcagtagggatgc

SEQ ID NO: 19752 - DNA, 98 bp, Homo sapiens
  chr7:97362607-97362705
  hyper
agtcgtctgtaaagcgttgtcacccttccccaccggagccccagccccagatcccacacacctgtgtgcatttagggcggtgaggactctacaaagcc

SEQ ID NO: 19753 - DNA, 222 bp, Homo sapiens; identical to SEQ ID NO: 3078
  chr7:97362706-97362928
  hyper

SEQ ID NO: 19754 - DNA, 29 bp, Homo sapiens
  chr7:98245856-98245885
  hyper
cgtgactttgtccctaactccgggtgtcc

SEQ ID NO: 19755 - DNA, 258 bp, Homo sapiens
  chr7:98246868-98247126
  hyper
gcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcg

SEQ ID NO: 19756 - DNA, 127 bp, Homo sapiens; identical to SEQ ID NO: 9137
  chr7:99149251-99149378
  hyper

SEQ ID NO: 19757 - DNA, 15 bp, Homo sapiens
  chr7:99155799-99155814
  hyper
aggccccgcaatcct

SEQ ID NO: 19758 - DNA, 195 bp, Homo sapiens; identical to SEQ ID NO: 9139
  chr7:99155931-99156126
  hyper

SEQ ID NO: 19759 - DNA, 50 bp, Homo sapiens; identical to SEQ ID NO: 9140
  chr7:99156127-99156177
  hyper

SEQ ID NO: 19760 - DNA, 100 bp, Homo sapiens; identical to SEQ ID NO: 9141
  chr7:99156815-99156915
  hyper

SEQ ID NO: 19761 - DNA, 48 bp, Homo sapiens
  chr7:99177694-99177742
  hyper
cggaagggacagccagttagagtctaggcccacttaggcgatgaaggg

SEQ ID NO: 19762 - DNA, 85 bp, Homo sapiens; identical to SEQ ID NO: 9143
  chr7:99178159-99178244
  hyper

SEQ ID NO: 19763 - DNA, 30 bp, Homo sapiens; identical to SEQ ID NO: 9144
  chr7:99595151-99595181
  hyper

SEQ ID NO: 19764 - DNA, 16 bp, Homo sapiens
  chr7:100091165-100091181
  hyper
gcttctgaggggagac

SEQ ID NO: 19765 - DNA, 132 bp, Homo sapiens; identical to SEQ ID NO: 9146
  chr7:100167379-100167511
  hyper

SEQ ID NO: 19766 - DNA, 32 bp, Homo sapiens; identical to SEQ ID NO: 9147
  chr7:100318466-100318498
  hyper

SEQ ID NO: 19767 - DNA, 100 bp, Homo sapiens; identical to SEQ ID NO: 9149
  chr7:100823251-100823351
  hyper

SEQ ID NO: 19768 - DNA, 56 bp, Homo sapiens
  chr7:100823380-100823436
  hyper
cggcgggcgcagacacccccggtgccaagagagaggtccctttggagcccccaaga

SEQ ID NO: 19769 - DNA, 62 bp, Homo sapiens
  chr7:100823497-100823559
  hyper
tcagcgctggggcagcgccgcagctccgttggcgacgcgggccggggcgcccatcggttcag

SEQ ID NO: 19770 - DNA, 30 bp, Homo sapiens; identical to SEQ ID NO: 9151
  chr7:100845392-100845422
  hyper

SEQ ID NO: 19771 - DNA, 52 bp, Homo sapiens; identical to SEQ ID NO: 9152
  chr7:100943301-100943353
  hyper

SEQ ID NO: 19772 - DNA, 127 bp, Homo sapiens; identical to SEQ ID NO: 9153
  chr7:101006326-101006453
  hyper

SEQ ID NO: 19773 - DNA, 34 bp, Homo sapiens
  chr7:103085842-103085876
  hyper
gcttcgagagttcagcgtgtcagagcctctatga

SEQ ID NO: 19774 - DNA, 109 bp, Homo sapiens; identical to SEQ ID NO: 9157
  chr7:103630363-103630472
  hyper

SEQ ID NO: 19775 - DNA, 47 bp, Homo sapiens; identical to SEQ ID NO: 9158
  chr7:103630841-103630888
  hyper

SEQ ID NO: 19776 - DNA, 251 bp, Homo sapiens; identical to SEQ ID NO: 3084
  chr7:103968915-103969166
  hyper

SEQ ID NO: 19777 - DNA, 50 bp, Homo sapiens
  chr7:103969167-103969217
  hyper
ctgagaggcggggggaggcggaggaccaggaggaggaggaggaggaggag

SEQ ID NO: 19778 - DNA, 181 bp, Homo sapiens
  chr7:103969341-103969522
  hyper
ctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctcca

SEQ ID NO: 19779 - DNA, 15 bp, Homo sapiens
  chr7:103969562-103969577
  hyper
cggcctctccatgat

SEQ ID NO: 19780 - DNA, 479 bp, Homo sapiens
  chr7:107301015-107301494
  hyper
ccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagc

SEQ ID NO: 19781 - DNA, 141 bp, Homo sapiens
  chr7:107301640-107301781
  hyper
gtcccgggtcaggtgcggggagggagggaatctcagtgtccccttccagccttgcaagcgcctttggcccctgccccagcccctcggtttgggggagatttcagaacgcggacagcgccctggctgcgggccataggggac

SEQ ID NO: 19782 - DNA, 30 bp, Homo sapiens; identical to SEQ ID NO: 9163
  chr7:107642639-107642669
  hyper

SEQ ID NO: 19783 - DNA, 30 bp, Homo sapiens; identical to SEQ ID NO: 9165
  chr7:108096780-108096810
  hyper

SEQ ID NO: 19784 - DNA, 57 bp, Homo sapiens; identical to SEQ ID NO: 9167
  chr7:112726853-112726910
  hyper

SEQ ID NO: 19785 - DNA, 144 bp, Homo sapiens
  chr7:113723439-113723583
  hyper
gccaggggcgggggctgaaaaggaggcggccggagaggcgaagcgagctgcgagccccgggcctgaactttcacctctcgaacccgggcccagcccattggctgcagccgaggggtccaccgagggcagcggctcctgacagga

SEQ ID NO: 19786 - DNA, 201 bp, Homo sapiens
  chr7:113724755-113724956
  hyper
ttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgac

SEQ ID NO: 19787 - DNA, 246 bp, Homo sapiens
  chr7:113725081-113725327
  hyper
gggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcct

SEQ ID NO: 19788 - DNA, 47 bp, Homo sapiens; identical to SEQ ID NO: 9171
  chr7:113726751-113726798
  hyper

SEQ ID NO: 19789 - DNA, 27 bp, Homo sapiens
  chr7:113727781-113727808
  hyper
cgccctgacacccgacctcagtgtgga

SEQ ID NO: 19790 - DNA, 77 bp, Homo sapiens; identical to SEQ ID NO: 9173
  chr7:114562200-114562277
  hyper

SEQ ID NO: 19791 - DNA, 4 bp, Homo sapiens
  chr7:114562326-114562330
  hyper
cgat

SEQ ID NO: 19792 - DNA, 372 bp, Homo sapiens; identical to SEQ ID NO: 9175
  chr7:114563009-114563381
  hyper

SEQ ID NO: 19793 - DNA, 52 bp, Homo sapiens
  chr7:115117500-115117552
  hyper
cgtctcggctgcctccgtggagatcccgagaaaagctcctgcgctccaagtt

SEQ ID NO: 19794 - DNA, 80 bp, Homo sapiens
  chr7:115117647-115117727
  hyper
ggcgggaaggcaggggacaaggcggggtcctaagggttggtggggttgagctgggggggggggggcggaaaaagagatct

SEQ ID NO: 19795 - DNA, 249 bp, Homo sapiens
  chr7:116962644-116962893
  hyper
gaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaaggg

SEQ ID NO: 19796 - DNA, 32 bp, Homo sapiens; identical to SEQ ID NO: 9179
  chr7:116964126-116964158
  hyper

SEQ ID NO: 19797 - DNA, 40 bp, Homo sapiens; identical to SEQ ID NO: 9180
  chr7:116964570-116964610
  hyper

SEQ ID NO: 19798 - DNA, 60 bp, Homo sapiens; identical to SEQ ID NO: 9183
  chr7:119913034-119913094
  hyper

SEQ ID NO: 19799 - DNA, 39 bp, Homo sapiens
  chr7:120969800-120969839
  hyper
catgatcaccgccgccgccactaccgccccgatgggcgc

SEQ ID NO: 19800 - DNA, 314 bp, Homo sapiens; identical to SEQ ID NO: 9185
  chr7:120970100-120970414
  hyper

SEQ ID NO: 19801 - DNA, 30 bp, Homo sapiens; identical to SEQ ID NO: 9186
  chr7:120970627-120970657
  hyper

SEQ ID NO: 19802 - DNA, 30 bp, Homo sapiens; identical to SEQ ID NO: 9188
  chr7:121783592-121783622
  hyper

SEQ ID NO: 19803 - DNA, 10 bp, Homo sapiens
  chr7:121940448-121940458
  hyper
gtggattctc

SEQ ID NO: 19804 - DNA, 32 bp, Homo sapiens
  chr7:121940903-121940935
  hyper
gaatggaagtatattcgtctataaacatacat

SEQ ID NO: 19805 - DNA, 17 bp, Homo sapiens
  chr7:121942170-121942187
  hyper
ttcgccagctggcgtgc

SEQ ID NO: 19806 - DNA, 15 bp, Homo sapiens
  chr7:121943974-121943989
  hyper
ccgggtggcatgggc

SEQ ID NO: 19807 - DNA, 123 bp, Homo sapiens; identical to SEQ ID NO: 706
  chr7:121944176-121944299
  hyper

SEQ ID NO: 19808 - DNA, 49 bp, Homo sapiens; identical to SEQ ID NO: 9196
  chr7:121945680-121945729
  hyper

SEQ ID NO: 19809 - DNA, 46 bp, Homo sapiens; identical to SEQ ID NO: 9197
  chr7:121946080-121946126
  hyper

SEQ ID NO: 19810 - DNA, 14 bp, Homo sapiens
  chr7:121951863-121951877
  hyper
ggctcctggaaaca

SEQ ID NO: 19811 - DNA, 88 bp, Homo sapiens; identical to SEQ ID NO: 3103
  chr7:121955425-121955513
  hyper

SEQ ID NO: 19812 - DNA, 28 bp, Homo sapiens
  chr7:121956458-121956486
  hyper
tccccatcttcaatccgaagctggggta

SEQ ID NO: 19813 - DNA, 15 bp, Homo sapiens
  chr7:121956567-121956582
  hyper
ctctccgctactgcc

SEQ ID NO: 19814 - DNA, 182 bp, Homo sapiens
  chr7:123172968-123173150
  hyper
ggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaag

SEQ ID NO: 19815 - DNA, 16 bp, Homo sapiens
  chr7:123672430-123672446
  hyper
gggagggacggggagc

SEQ ID NO: 19816 - DNA, 56 bp, Homo sapiens; identical to SEQ ID NO: 9209
  chr7:123672928-123672984
  hyper

SEQ ID NO: 19817 - DNA, 113 bp, Homo sapiens; identical to SEQ ID NO: 9210
  chr7:123673226-123673339
  hyper

SEQ ID NO: 19818 - DNA, 45 bp, Homo sapiens
  chr7:124404370-124404415
  hyper
ggccagcgcccggcccgggagtgcaattgtccacccttcgtgccc

SEQ ID NO: 19819 - DNA, 191 bp, Homo sapiens; identical to SEQ ID NO: 9212
  chr7:124404769-124404960
  hyper

SEQ ID NO: 19820 - DNA, 37 bp, Homo sapiens; identical to SEQ ID NO: 9213
  chr7:124405619-124405656
  hyper

SEQ ID NO: 19821 - DNA, 44 bp, Homo sapiens; identical to SEQ ID NO: 9214
  chr7:124405918-124405962
  hyper

SEQ ID NO: 19822 - DNA, 14 bp, Homo sapiens
  chr7:126891206-126891220
  hyper
gtctgttttcaccc

SEQ ID NO: 19823 - DNA, 730 bp, Homo sapiens; identical to SEQ ID NO: 9216
  chr7:126891633-126892363
  hyper

SEQ ID NO: 19824 - DNA, 65 bp, Homo sapiens
  chr7:127744057-127744122
  hyper
atgaagaaactgagccgaggaaaggaagcgacttggccaaggtcggagagctcattctttgcagg

SEQ ID NO: 19825 - DNA, 39 bp, Homo sapiens
  chr7:127744631-127744670
  hyper
aaagagtcccattgcttcaccgtccggagcttagtctcc

SEQ ID NO: 19826 - DNA, 36 bp, Homo sapiens; identical to SEQ ID NO: 9219
  chr7:127806571-127806607
  hyper

SEQ ID NO: 19827 - DNA, 201 bp, Homo sapiens
  chr7:127807846-127808047
  hyper
aacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccag

SEQ ID NO: 19828 - DNA, 159 bp, Homo sapiens; identical to SEQ ID NO: 3109
  chr7:127841338-127841497
  hyper

SEQ ID NO: 19829 - DNA, 41 bp, Homo sapiens; identical to SEQ ID NO: 9224
  chr7:127992478-127992519
  hyper

SEQ ID NO: 19830 - DNA, 45 bp, Homo sapiens
  chr7:128337422-128337467
  hyper
gccatgtaagcagagcggacaactctgagggcgtggctgggcggg

SEQ ID NO: 19831 - DNA, 125 bp, Homo sapiens; identical to SEQ ID NO: 3113
  chr7:128430757-128430882
  hyper

SEQ ID NO: 19832 - DNA, 400 bp, Homo sapiens
  chr7:128470497-128470897
  hyper
gagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccg

SEQ ID NO: 19833 - DNA, 25 bp, Homo sapiens
  chr7:128471032-128471057
  hyper
cgtgtccataggtcagtgccggggg

SEQ ID NO: 19834 - DNA, 90 bp, Homo sapiens; identical to SEQ ID NO: 3115
  chr7:128471125-128471215
  hyper

SEQ ID NO: 19835 - DNA, 56 bp, Homo sapiens; identical to SEQ ID NO: 9231
  chr7:128510097-128510153
  hyper

SEQ ID NO: 19836 - DNA, 65 bp, Homo sapiens
  chr7:128828130-128828195
  hyper
tggaacagaagtccccgttgacttcaggcatcccctgtctttcccatcctgagccaggagaaaag

SEQ ID NO: 19837 - DNA, 111 bp, Homo sapiens
  chr7:128828272-128828383
  hyper
actcatctctttcccccgggcgcggggcggcggcaggcggggtcaccagatccccctagcccgggcccctccaggcgccagggacgctgacgctcgcgctcttcctctctc

SEQ ID NO: 19838 - DNA, 262 bp, Homo sapiens; identical to SEQ ID NO: 9233
  chr7:128829105-128829367
  hyper

SEQ ID NO: 19839 - DNA, 8 bp, Homo sapiens
  chr7:129421701-129421709
  hyper
cccaggac

SEQ ID NO: 19840 - DNA, 45 bp, Homo sapiens
  chr7:129422115-129422160
  hyper
ggagctggactcggacggtgagggggcggcccccggggacctgat

SEQ ID NO: 19841 - DNA, 6 bp, Homo sapiens
  chr7:129423418-129423424
  hyper
tcttta

SEQ ID NO: 19842 - DNA, 64 bp, Homo sapiens
  chr7:129424591-129424655
  hyper
caggtgaaacataagcgtccaccccagaggggtcccctacccaagtcagaggagaaggtggcct

SEQ ID NO: 19843 - DNA, 59 bp, Homo sapiens
  chr7:129425887-129425946
  hyper
ggatctgaagcccagctaggcttctaattccagacagagccctacggagcccagttctc

SEQ ID NO: 19844 - DNA, 30 bp, Homo sapiens; identical to SEQ ID NO: 9240
  chr7:132260536-132260566
  hyper

SEQ ID NO: 19845 - DNA, 89 bp, Homo sapiens; identical to SEQ ID NO: 9241
  chr7:132260852-132260941
  hyper

SEQ ID NO: 19846 - DNA, 141 bp, Homo sapiens; identical to SEQ ID NO: 9242
  chr7:132261845-132261986
  hyper

SEQ ID NO: 19847 - DNA, 109 bp, Homo sapiens
  chr7:134143055-134143164
  hyper
attatcaactagctacggggtgcccagatttttctcccgagttccagacccagggcaccccgaggcggcgcctggccgaggagctccgcactgcgccttgttaacagct

SEQ ID NO: 19848 - DNA, 112 bp, Homo sapiens
  chr7:134143475-134143587
  hyper
gcccgcggtagggcgggggctcccgtgagctgctcccaaaccccactcgcaggatgctgccctgacgcccagggccaacccggggagccaaggcccccggtctctgcaaggc

SEQ ID NO: 19849 - DNA, 83 bp, Homo sapiens
  chr7:139167744-139167827
  hyper
gagcccggggagccggcgcttccttccgcggggctggcccggccctctgcgtcgcagccgctctccgtccgggctgcagccag

SEQ ID NO: 19850 - DNA, 158 bp, Homo sapiens
  chr7:139168379-139168537
  hyper
ctcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctg

SEQ ID NO: 19851 - DNA, 55 bp, Homo sapiens; identical to SEQ ID NO: 9255
  chr7:139208245-139208300
  hyper

SEQ ID NO: 19852 - DNA, 133 bp, Homo sapiens; identical to SEQ ID NO: 3130
  chr7:139208629-139208762
  hyper

SEQ ID NO: 19853 - DNA, 15 bp, Homo sapiens
  chr7:140339853-140339868
  hyper
gcccggctgctcagc

SEQ ID NO: 19854 - DNA, 40 bp, Homo sapiens; identical to SEQ ID NO: 9258
  chr7:140771769-140771809
  hyper

SEQ ID NO: 19855 - DNA, 246 bp, Homo sapiens; identical to SEQ ID NO: 9259
  chr7:140772343-140772589
  hyper

SEQ ID NO: 19856 - DNA, 335 bp, Homo sapiens
  chr7:140773228-140773563
  hyper
gggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctgg

SEQ ID NO: 19857 - DNA, 470 bp, Homo sapiens
  chr7:140773750-140774220
  hyper
ggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccag

SEQ ID NO: 19858 - DNA, 26 bp, Homo sapiens
  chr7:143580069-143580095
  hyper
ctttgtgtcgccggccctggtggctt

SEQ ID NO: 19859 - DNA, 46 bp, Homo sapiens
  chr7:145813082-145813128
  hyper
cccccgccccagctgatggaccccggccggtcggctcagtctccct

SEQ ID NO: 19860 - DNA, 33 bp, Homo sapiens; identical to SEQ ID NO: 9264
  chr7:145813544-145813577
  hyper

SEQ ID NO: 19861 - DNA, 18 bp, Homo sapiens
  chr7:149119930-149119948
  hyper
gcgccaaatggagggcgc

SEQ ID NO: 19862 - DNA, 59 bp, Homo sapiens
  chr7:149411482-149411541
  hyper
ggcgcgggcgaaagacgtgaggatgtacgggggcctggcagctgctctgtcccacccac

SEQ ID NO: 19863 - DNA, 60 bp, Homo sapiens
  chr7:149412304-149412364
  hyper
aggtcctcggacaacctctctccagctctccgccgccggtacccacggcccagtctccac

SEQ ID NO: 19864 - DNA, 36 bp, Homo sapiens
  chr7:149744469-149744505
  hyper
ccagccaccaactcccggccgccgcggctgcagaca

SEQ ID NO: 19865 - DNA, 4 bp, Homo sapiens
  chr7:149744795-149744799
  hyper
cctg

SEQ ID NO: 19866 - DNA, 65 bp, Homo sapiens; identical to SEQ ID NO: 9272
  chr7:149744950-149745015
  hyper

SEQ ID NO: 19867 - DNA, 41 bp, Homo sapiens
  chr7:149917336-149917377
  hyper
gtggcctttccccgggggatacctgacgctattggagactc

SEQ ID NO: 19868 - DNA, 34 bp, Homo sapiens
  chr7:150748158-150748192
  hyper
agaactgtgcccacccggccataggtaagggcga

SEQ ID NO: 19869 - DNA, 113 bp, Homo sapiens
  chr7:150748406-150748519
  hyper
gtgagctgcgcggggcgggcgggctcctccgagccgggggctcccgacggggcggaacggggcaggccaggccgtagccctagtgcgcacagcccgggcggaggcagcctccg

SEQ ID NO: 19870 - DNA, 165 bp, Homo sapiens; identical to SEQ ID NO: 9276
  chr7:150864232-150864397
  hyper

SEQ ID NO: 19871 - DNA, 33 bp, Homo sapiens
  chr7:151106418-151106451
  hyper
ctagaaaggggtctgcgggcgcaggagctgggg

SEQ ID NO: 19872 - DNA, 91 bp, Homo sapiens
  chr7:151107395-151107486
  hyper
cgcgcgccgggaactcatttggggcgcagctccaccgacccctcggctactcgcctccaccaggcaagccaggtcctcccatgctctgagc

SEQ ID NO: 19873 - DNA, 30 bp, Homo sapiens; identical to SEQ ID NO: 9280
  chr7:151107782-151107812
  hyper

SEQ ID NO: 19874 - DNA, 175 bp, Homo sapiens; identical to SEQ ID NO: 9281
  chr7:151145538-151145713
  hyper

SEQ ID NO: 19875 - DNA, 30 bp, Homo sapiens; identical to SEQ ID NO: 9282
  chr7:152622731-152622761
  hyper

SEQ ID NO: 19876 - DNA, 117 bp, Homo sapiens; identical to SEQ ID NO: 9283
  chr7:153446175-153446292
  hyper

SEQ ID NO: 19877 - DNA, 64 bp, Homo sapiens; identical to SEQ ID NO: 9284
  chr7:153583466-153583530
  hyper

SEQ ID NO: 19878 - DNA, 40 bp, Homo sapiens; identical to SEQ ID NO: 9289
  chr7:153750249-153750289
  hyper

SEQ ID NO: 19879 - DNA, 10 bp, Homo sapiens
  chr7:154002083-154002093
  hyper
cgctgcctcc

SEQ ID NO: 19880 - DNA, 89 bp, Homo sapiens; identical to SEQ ID NO: 9291
  chr7:154861818-154861907
  hyper

SEQ ID NO: 19881 - DNA, 41 bp, Homo sapiens
  chr7:154862266-154862307
  hyper
cgatctgggagatgctcggctctgggcggccaaacagcctt

SEQ ID NO: 19882 - DNA, 9 bp, Homo sapiens
  chr7:155164445-155164454
  hyper
ttccctgtt

SEQ ID NO: 19883 - DNA, 313 bp, Homo sapiens
  chr7:155165562-155165875
  hyper
cctctgggtaatgcttggccaagggggaagatcgagtactcccgcccacatccgcctcccccaggagggaggattccctctctgctcacccaccctgacccacgcctcccgccaggtccactgctcagacaaatctgtaggtttctgagtatccgtatctcgaaaagcttcaatgcacaaacgaggttttaagcccatcgcggcttcgcaaggggaaggggctgcttccctaaaaacaaaacacaacaaaaaaggcaagggggtactcttgcagatggactggaattagtaatttagccagggtctcttccaa

SEQ ID NO: 19884 - DNA, 250 bp, Homo sapiens
  chr7:155166784-155167034
  hyper
ccctttcttcccttcctcgtctctgcctcttttcctttcttttctccctccgcctctctgtcagctcttcccgtcgtttcctcggcacccagctccagtccaggcgctgtcccagggtaggaagaagggcgatgccccttcttccccttctctggtcccctccccagcctccggctccccaaggtgcagggctccggcgggggctgggccgggcgggtgggtttctgagccgcagcgcttggagctgggg

SEQ ID NO: 19885 - DNA, 77 bp, Homo sapiens; identical to SEQ ID NO: 9296
  chr7:155168537-155168614
  hyper

SEQ ID NO: 19886 - DNA, 202 bp, Homo sapiens; identical to SEQ ID NO: 9297
  chr7:155170276-155170478
  hyper

SEQ ID NO: 19887 - DNA, 89 bp, Homo sapiens; identical to SEQ ID NO: 9298
  chr7:155170836-155170925
  hyper

SEQ ID NO: 19888 - DNA, 78 bp, Homo sapiens; identical to SEQ ID NO: 9299
  chr7:155173869-155173947
  hyper

SEQ ID NO: 19889 - DNA, 432 bp, Homo sapiens
  chr7:155174224-155174656
  hyper
ctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggc

SEQ ID NO: 19890 - DNA, 70 bp, Homo sapiens
  chr7:155174788-155174858
  hyper
acatgtacacgaatgtgagtgtgagtgtgcatgagcgtgagcgtgcgtgtgcgtgcgagtgtgcacgagc

SEQ ID NO: 19891 - DNA, 180 bp, Homo sapiens
  chr7:155242049-155242229
  hyper
ggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcc

SEQ ID NO: 19892 - DNA, 30 bp, Homo sapiens
  chr7:155242699-155242729
  hyper
cgagccacgtcccgggacccggagagcccg

SEQ ID NO: 19893 - DNA, 244 bp, Homo sapiens
  chr7:155243102-155243346
  hyper
gtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacaccc

SEQ ID NO: 19894 - DNA, 67 bp, Homo sapiens; identical to SEQ ID NO: 9304
  chr7:155243755-155243822
  hyper

SEQ ID NO: 19895 - DNA, 149 bp, Homo sapiens
  chr7:155244031-155244180
  hyper
gaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatct

SEQ ID NO: 19896 - DNA, 37 bp, Homo sapiens; identical to SEQ ID NO: 9307
  chr7:155248008-155248045
  hyper

SEQ ID NO: 19897 - DNA, 88 bp, Homo sapiens; identical to SEQ ID NO: 9308
  chr7:155249117-155249205
  hyper

SEQ ID NO: 19898 - DNA, 25 bp, Homo sapiens
  chr7:155249900-155249925
  hyper
aaatcttaaaaatagcgatcttcct

SEQ ID NO: 19899 - DNA, 400 bp, Homo sapiens
  chr7:155250387-155250787
  hyper
cgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccg

SEQ ID NO: 19900 - DNA, 123 bp, Homo sapiens; identical to SEQ ID NO: 9311
  chr7:155251427-155251550
  hyper

SEQ ID NO: 19901 - DNA, 85 bp, Homo sapiens
  chr7:155252162-155252247
  hyper
tcatccccttccctacgatcttccaactcaggccaggccggggacgcatgccccagcccaccccagacttgtcctaccatccggt

SEQ ID NO: 19902 - DNA, 25 bp, Homo sapiens
  chr7:155253041-155253066
  hyper
cagcccaagtcgcctatcttcatgg

SEQ ID NO: 19903 - DNA, 2 bp, Homo sapiens
  chr7:155256231-155256233
  hyper
ac

SEQ ID NO: 19904 - DNA, 121 bp, Homo sapiens
  chr7:155258072-155258193
  hyper
tttggggtctttgagcgagtgatctacgcgttgaattgctgtttttccaaactttcatggcttaaaaattttttttcttctccctgtaaaagaaactcagagactggtgatctgttaccga

SEQ ID NO: 19905 - DNA, 377 bp, Homo sapiens
  chr7:155258487-155258864
  hyper
aaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagac

SEQ ID NO: 19906 - DNA, 35 bp, Homo sapiens
  chr7:155258914-155258949
  hyper
cgctggttcctctcgggcctcccgggctctgcgtg

SEQ ID NO: 19907 - DNA, 95 bp, Homo sapiens
  chr7:155260785-155260880
  hyper
cctcagcctggaaggcgtcccagagaggccccacccccagcctccacggagacccaggagggaagaagagccgggacccggtagccctgaggggc

SEQ ID NO: 19908 - DNA, 215 bp, Homo sapiens; identical to SEQ ID NO: 9326
  chr7:155264127-155264342
  hyper

SEQ ID NO: 19909 - DNA, 85 bp, Homo sapiens
  chr7:155301753-155301838
  hyper
aagatccgttaggaacgcctccgactgagctagggggatctaagaagaaagacagggcgaggaaacttgtcttaatgttaatgtt

SEQ ID NO: 19910 - DNA, 19 bp, Homo sapiens
  chr7:155301931-155301950
  hyper
gtaccgcagattgttatta

SEQ ID NO: 19911 - DNA, 14 bp, Homo sapiens
  chr7:155326527-155326541
  hyper
ggcattgtttcagc

SEQ ID NO: 19912 - DNA, 15 bp, Homo sapiens
  chr7:155580211-155580226
  hyper
cgcccgcccgctgca

SEQ ID NO: 19913 - DNA, 41 bp, Homo sapiens; identical to SEQ ID NO: 9333
  chr7:156409472-156409513
  hyper

SEQ ID NO: 19914 - DNA, 99 bp, Homo sapiens
  chr7:156795914-156796013
  hyper
gcaggggccggcgcaggtccggggcctggctctgctggaggacgggggaggggcggccctattaacagcgtcttcctttgatgtcgctcttccccgcgt

SEQ ID NO: 19915 - DNA, 40 bp, Homo sapiens
  chr7:156796494-156796534
  hyper
tttatggaaggggcccggggtgataatgagttgccagaga

SEQ ID NO: 19916 - DNA, 66 bp, Homo sapiens
  chr7:156800933-156800999
  hyper
ccgtgggcaacttagcgtccttggctctgggaaatgcaggtcatattggtggctttctatcagaag

SEQ ID NO: 19917 - DNA, 43 bp, Homo sapiens
  chr7:156801029-156801072
  hyper
aagcccaggctggcaggggattcgcagacgcagacgtgtctga

SEQ ID NO: 19918 - DNA, 271 bp, Homo sapiens
  chr7:156801601-156801872
  hyper
ggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctc

SEQ ID NO: 19919 - DNA, 24 bp, Homo sapiens
  chr7:156809199-156809223
  hyper
gtccatgttcgataatggcaggaa

SEQ ID NO: 19920 - DNA, 38 bp, Homo sapiens; identical to SEQ ID NO: 9351
  chr7:156811672-156811710
  hyper

SEQ ID NO: 19921 - DNA, 71 bp, Homo sapiens; identical to SEQ ID NO: 9355
  chr7:157129160-157129231
  hyper

SEQ ID NO: 19922 - DNA, 122 bp, Homo sapiens
  chr7:157481847-157481969
  hyper
cactttcctctgtgtcggtgaaaggaagagcttccagctccctcctccgcacaaaccttcacttcctctcttgttcgatcgcgtcctaaaatctgggatcggcgacgcaaggacagcctggt

SEQ ID NO: 19923 - DNA, 46 bp, Homo sapiens
  chr7:157483274-157483320
  hyper
gggaggaggtgggggcgtgcgccgggccgagcggcctcggggcgca

SEQ ID NO: 19924 - DNA, 83 bp, Homo sapiens; identical to SEQ ID NO: 9363
  chr7:157483738-157483821
  hyper

SEQ ID NO: 19925 - DNA, 75 bp, Homo sapiens; identical to SEQ ID NO: 9364
  chr7:157484507-157484582
  hyper

SEQ ID NO: 19926 - DNA, 24 bp, Homo sapiens
  chr7:157485503-157485527
  hyper
gcccagggcaaggcccgcaaaaac

SEQ ID NO: 19927 - DNA, 7 bp, Homo sapiens
  chr7:158938399-158938406
  hyper
cacgcgg

SEQ ID NO: 19928 - DNA, 82 bp, Homo sapiens; identical to SEQ ID NO: 9373
  chr8:495729-495811
  hyper

SEQ ID NO: 19929 - DNA, 129 bp, Homo sapiens; identical to SEQ ID NO: 3193
  chr8:687513-687642
  hyper

SEQ ID NO: 19930 - DNA, 36 bp, Homo sapiens
  chr8:4849500-4849536
  hyper
ccctccgcgcgcacacacttgcgcacagcacctctc

SEQ ID NO: 19931 - DNA, 46 bp, Homo sapiens; identical to SEQ ID NO: 9379
  chr8:4851880-4851926
  hyper

SEQ ID NO: 19932 - DNA, 68 bp, Homo sapiens; identical to SEQ ID NO: 9380
  chr8:4852501-4852569
  hyper

SEQ ID NO: 19933 - DNA, 30 bp, Homo sapiens; identical to SEQ ID NO: 9381
  chr8:6692832-6692862
  hyper

SEQ ID NO: 19934 - DNA, 15 bp, Homo sapiens
  chr8:9756486-9756501
  hyper
cgctagagtgaaatc

SEQ ID NO: 19935 - DNA, 279 bp, Homo sapiens
  chr8:9762864-9763143
  hyper
cagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttg

SEQ ID NO: 19936 - DNA, 16 bp, Homo sapiens
  chr8:9763275-9763291
  hyper
gcggagccgcctggaa

SEQ ID NO: 19937 - DNA, 197 bp, Homo sapiens; identical to SEQ ID NO: 3197
  chr8:9763565-9763762
  hyper

SEQ ID NO: 19938 - DNA, 108 bp, Homo sapiens
  chr8:9763787-9763895
  hyper
cgcttccgtttatccgtttctatcccgggaaaagggggcgcctgcccgagcccacgcgcgccgccgcatctgcagcggtcggcgccccacgctccctgaacgcccccc

SEQ ID NO: 19939 - DNA, 220 bp, Homo sapiens
  chr8:9764214-9764434
  hyper
agcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggac

SEQ ID NO: 19940 - DNA, 362 bp, Homo sapiens
  chr8:9764551-9764913
  hyper
tccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagca

SEQ ID NO: 19941 - DNA, 131 bp, Homo sapiens; identical to SEQ ID NO: 9389
  chr8:10587422-10587553
  hyper

SEQ ID NO: 19942 - DNA, 121 bp, Homo sapiens
  chr8:11204905-11205026
  hyper
gatttcggtcgcgtgcggctctgaccgcgtcgccccatccctggcggggccacgcacggacgccatggctggcgccgcggagccgggcgatgcgcgcggactctcccggggccctgactgt

SEQ ID NO: 19943 - DNA, 249 bp, Homo sapiens; identical to SEQ ID NO: 9391
  chr8:11205453-11205702
  hyper

SEQ ID NO: 19944 - DNA, 61 bp, Homo sapiens; identical to SEQ ID NO: 9392
  chr8:11206007-11206068
  hyper

SEQ ID NO: 19945 - DNA, 46 bp, Homo sapiens
  chr8:11537179-11537225
  hyper
gagccctgagtgggccgggtgctgggcgaacagtcctagccctgca

SEQ ID NO: 19946 - DNA, 24 bp, Homo sapiens
  chr8:11537259-11537283
  hyper
ttacaggggcgaggttgggatcgg

SEQ ID NO: 19947 - DNA, 50 bp, Homo sapiens; identical to SEQ ID NO: 9395
  chr8:11550672-11550722
  hyper

SEQ ID NO: 19948 - DNA, 30 bp, Homo sapiens; identical to SEQ ID NO: 9398
  chr8:11560481-11560511
  hyper

SEQ ID NO: 19949 - DNA, 59 bp, Homo sapiens
  chr8:11560793-11560852
  hyper
ctgtgattgctctattaacctttagacctgtctgagggactctccggctcgcagccccg

SEQ ID NO: 19950 - DNA, 30 bp, Homo sapiens; identical to SEQ ID NO: 9400
  chr8:11561116-11561146
  hyper

SEQ ID NO: 19951 - DNA, 27 bp, Homo sapiens
  chr8:11562169-11562196
  hyper
ggactgacgggcccgggacaggctgca

SEQ ID NO: 19952 - DNA, 146 bp, Homo sapiens; identical to SEQ ID NO: 3203
  chr8:11562235-11562381
  hyper

SEQ ID NO: 19953 - DNA, 74 bp, Homo sapiens
  chr8:11562627-11562701
  hyper
tggctggggaaagagcgtggtgggggacccgcggccgatggaatccctggggcagcgcggcccgcaccgtggag

SEQ ID NO: 19954 - DNA, 36 bp, Homo sapiens; identical to SEQ ID NO: 9405
  chr8:12808858-12808894
  hyper

SEQ ID NO: 19955 - DNA, 247 bp, Homo sapiens; identical to SEQ ID NO: 9406
  chr8:12989381-12989628
  hyper

SEQ ID NO: 19956 - DNA, 236 bp, Homo sapiens; identical to SEQ ID NO: 9407
  chr8:12991090-12991326
  hyper

SEQ ID NO: 19957 - DNA, 72 bp, Homo sapiens
  chr8:15094433-15094505
  hyper
ccccggacctgctcccgcgcctggggctagggcaggctagccgtccccggcagcgggggtacctctccagcc

SEQ ID NO: 19958 - DNA, 93 bp, Homo sapiens; identical to SEQ ID NO: 9409
  chr8:16859361-16859454
  hyper

SEQ ID NO: 19959 - DNA, 30 bp, Homo sapiens; identical to SEQ ID NO: 9410
  chr8:16884436-16884466
  hyper

SEQ ID NO: 19960 - DNA, 30 bp, Homo sapiens; identical to SEQ ID NO: 9411
  chr8:16884959-16884989
  hyper

SEQ ID NO: 19961 - DNA, 73 bp, Homo sapiens
  chr8:19797866-19797939
  hyper
ggctgaggtcagctccgggcgcccggccccgccgcgcggctgcgagcacgtggggttgacgggcgccgcgtgg

SEQ ID NO: 19962 - DNA, 149 bp, Homo sapiens; identical to SEQ ID NO: 9413
  chr8:20161245-20161394
  hyper

SEQ ID NO: 19963 - DNA, 34 bp, Homo sapiens; identical to SEQ ID NO: 9414
  chr8:20161617-20161651
  hyper

SEQ ID NO: 19964 - DNA, 32 bp, Homo sapiens; identical to SEQ ID NO: 9415
  chr8:20161666-20161698
  hyper

SEQ ID NO: 19965 - DNA, 30 bp, Homo sapiens; identical to SEQ ID NO: 9416
  chr8:22613837-22613867
  hyper

SEQ ID NO: 19966 - DNA, 59 bp, Homo sapiens
  chr8:22960723-22960782
  hyper
gaagagcgcacctggcgccgggagggggcagggagacggggacacggcagggatgcctg

SEQ ID NO: 19967 - DNA, 147 bp, Homo sapiens; identical to SEQ ID NO: 9418
  chr8:23021380-23021527
  hyper

SEQ ID NO: 19968 - DNA, 123 bp, Homo sapiens
  chr8:23260870-23260993
  hyper
aggactcacggcgctcccgcgctcccaacagcctttcgagcaggctgggggttgaaccgggttcaagcagtggacgctacagctcccgggcgcagcccccggggtccccgcccccactccgtc

SEQ ID NO: 19969 - DNA, 160 bp, Homo sapiens; identical to SEQ ID NO: 9420
  chr8:23261393-23261553
  hyper

SEQ ID NO: 19970 - DNA, 112 bp, Homo sapiens
  chr8:23560525-23560637
  hyper
ctgttgccaacgccgcgctctggcaccctggtcccgccgccgaggggcgaggccgcgttcaggccgggctctaaaagcacaggaagggacacatcagcgcccagcctaaggc

SEQ ID NO: 19971 - DNA, 36 bp, Homo sapiens
  chr8:23565024-23565060
  hyper
tctcctttatcctccttaaagcggattgcctggagc

SEQ ID NO: 19972 - DNA, 55 bp, Homo sapiens
  chr8:23572554-23572609
  hyper
acacacattgctgaccttgagggtcagacagaccctttctcgtctagtttttagc

SEQ ID NO: 19973 - DNA, 46 bp, Homo sapiens; identical to SEQ ID NO: 3213
  chr8:23583971-23584017
  hyper

SEQ ID NO: 19974 - DNA, 14 bp, Homo sapiens
  chr8:23584760-23584774
  hyper
gcccaccctgagca

SEQ ID NO: 19975 - DNA, 21 bp, Homo sapiens
  chr8:24770293-24770314
  hyper
gggtgacaagccccccgggtg

SEQ ID NO: 19976 - DNA, 213 bp, Homo sapiens; identical to SEQ ID NO: 3216
  chr8:24770912-24771125
  hyper

SEQ ID NO: 19977 - DNA, 82 bp, Homo sapiens
  chr8:24771349-24771431
  hyper
ggcgggtaaccgagacccgctcgagcttcagccgcgtcagcggctccccgtccagtggcttccgctcgcagtcgtggtcccg

SEQ ID NO: 19978 - DNA, 177 bp, Homo sapiens
  chr8:24813287-24813464
  hyper
ccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccct

SEQ ID NO: 19979 - DNA, 132 bp, Homo sapiens
  chr8:24813618-24813750
  hyper
cgcccggaagcgggatggctcggagtgcttctggcgcagcaccagcagctcggcttccaggaccttgttctgctgctccagctcgtgcacgcgctcgatgaagctggcgaagcggtcattgaggtcctggag

SEQ ID NO: 19980 - DNA, 21 bp, Homo sapiens
  chr8:24814407-24814428
  hyper
agaccccgtgacacttggatc

SEQ ID NO: 19981 - DNA, 108 bp, Homo sapiens; identical to SEQ ID NO: 9439
  chr8:24815208-24815316
  hyper

SEQ ID NO: 19982 - DNA, 150 bp, Homo sapiens
  chr8:24857626-24857776
  hyper
gtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttaca

SEQ ID NO: 19983 - DNA, 232 bp, Homo sapiens
  chr8:24857808-24858040
  hyper
acactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagct

SEQ ID NO: 19984 - DNA, 209 bp, Homo sapiens
  chr8:24858647-24858856
  hyper
gctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcct

SEQ ID NO: 19985 - DNA, 82 bp, Homo sapiens
  chr8:25901765-25901847
  hyper
gccggcctcccaggctccaggaatcgcccagcaagatgcgggaggtaggcgctcgcaggcggcgtggcgaagccaagagtgg

SEQ ID NO: 19986 - DNA, 33 bp, Homo sapiens
  chr8:25902113-25902146
  hyper
cgcgcagggcctgggcgacagatggggggacag

SEQ ID NO: 19987 - DNA, 157 bp, Homo sapiens
  chr8:25904191-25904348
  hyper
agagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcggg

SEQ ID NO: 19988 - DNA, 318 bp, Homo sapiens; identical to SEQ ID NO: 9451
  chr8:25905311-25905629
  hyper

SEQ ID NO: 19989 - DNA, 67 bp, Homo sapiens
  chr8:25905695-25905762
  hyper
cgatctcgtgcaacacaaaacctgccccgagctgtgcgggggcctggcaagcgcagctgcggccccg

SEQ ID NO: 19990 - DNA, 38 bp, Homo sapiens; identical to SEQ ID NO: 9453
  chr8:25907271-25907309
  hyper

SEQ ID NO: 19991 - DNA, 15 bp, Homo sapiens
  chr8:26372893-26372908
  hyper
cgctccccaaaccgc

SEQ ID NO: 19992 - DNA, 44 bp, Homo sapiens; identical to SEQ ID NO: 9456
  chr8:26723005-26723049
  hyper

SEQ ID NO: 19993 - DNA, 311 bp, Homo sapiens
  chr8:26723674-26723985
  hyper
gcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcg

SEQ ID NO: 19994 - DNA, 50 bp, Homo sapiens; identical to SEQ ID NO: 9458
  chr8:26724529-26724579
  hyper

SEQ ID NO: 19995 - DNA, 246 bp, Homo sapiens
  chr8:30769411-30769657
  hyper
agtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcaccta

SEQ ID NO: 19996 - DNA, 34 bp, Homo sapiens; identical to SEQ ID NO: 9460
  chr8:31496785-31496819
  hyper

SEQ ID NO: 19997 - DNA, 31 bp, Homo sapiens
  chr8:31497468-31497499
  hyper
cgacagccagaagcccgcacgcacctcgcac

SEQ ID NO: 19998 - DNA, 211 bp, Homo sapiens; identical to SEQ ID NO: 9462
  chr8:31497750-31497961
  hyper

SEQ ID NO: 19999 - DNA, 135 bp, Homo sapiens; identical to SEQ ID NO: 9463
  chr8:32404798-32404933
  hyper

SEQ ID NO: 20000 - DNA, 37 bp, Homo sapiens; identical to SEQ ID NO: 9464
  chr8:32405476-32405513
  hyper

SEQ ID NO: 20001 - DNA, 66 bp, Homo sapiens
  chr8:32406532-32406598
  hyper
cctaccgggcgcctacgcccagagctcagggcaagggacagcagtcccggccgcaccctcccagag

SEQ ID NO: 20002 - DNA, 14 bp, Homo sapiens
  chr8:32406914-32406928
  hyper
cagtcctgtgctac

SEQ ID NO: 20003 - DNA, 53 bp, Homo sapiens; identical to SEQ ID NO: 9466
  chr8:32406929-32406982
  hyper

SEQ ID NO: 20004 - DNA, 176 bp, Homo sapiens; identical to SEQ ID NO: 9467
  chr8:33371806-33371982
  hyper

SEQ ID NO: 20005 - DNA, 43 bp, Homo sapiens; identical to SEQ ID NO: 9469
  chr8:35093236-35093279
  hyper

SEQ ID NO: 20006 - DNA, 12 bp, Homo sapiens
  chr8:37655798-37655810
  hyper
ttcgcgcaaaga

SEQ ID NO: 20007 - DNA, 116 bp, Homo sapiens
  chr8:37656081-37656197
  hyper
cgggcccccgcggccgccgcttcctttcctgtcccaaatccagcctaagagccgcttccctttccctgtcctcctgaccccagtggcaaccgtttctccaccgccccttgcccgca

SEQ ID NO: 20008 - DNA, 25 bp, Homo sapiens
  chr8:38008209-38008234
  hyper
ggcctgagcctcatccgctgagagc

SEQ ID NO: 20009 - DNA, 41 bp, Homo sapiens
  chr8:38008557-38008598
  hyper
tgcaaaggaaggggtcaaggatagagcgattgcctcacact

SEQ ID NO: 20010 - DNA, 158 bp, Homo sapiens; identical to SEQ ID NO: 9476
  chr8:38323407-38323565
  hyper

SEQ ID NO: 20011 - DNA, 111 bp, Homo sapiens
  chr8:38323800-38323911
  hyper
cagccgagaggggaccgcgggctccgggcagggcaggcgctcccgcagctccagctataacacaagggagagaaagcaacgctttggttccagaaacttccatcgtcaagg

SEQ ID NO: 20012 - DNA, 214 bp, Homo sapiens
  chr8:38323941-38324155
  hyper
cccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtct

SEQ ID NO: 20013 - DNA, 229 bp, Homo sapiens
  chr8:41166745-41166974
  hyper
cgcaaacttccagggacctccggggacaaaaggcgcagtccccagcgttgcccggctccgcggccgcaagctgctgcccggtccccccggccagtggcggccctcggcctgcggtcggaggcggcgcgggcggggaggcggcgctgcgggctgggtgcgccccggctcccggaggtgcggcgagcaggaaggcgcggggcggcgggcgcgcggcactgactccggaggc

SEQ ID NO: 20014 - DNA, 88 bp, Homo sapiens
  chr8:41167035-41167123
  hyper
atcagctcccggcggggcgagccgcactcgttaccacgtccgtcaccggcgcgggagccaatcgcctccctcgcgagcgggttcggtt

SEQ ID NO: 20015 - DNA, 378 bp, Homo sapiens; identical to SEQ ID NO: 9484
  chr8:41503901-41504279
  hyper

SEQ ID NO: 20016 - DNA, 11 bp, Homo sapiens
  chr8:41624550-41624561
  hyper
ctccacgctcc

SEQ ID NO: 20017 - DNA, 103 bp, Homo sapiens; identical to SEQ ID NO: 9486
  chr8:41624633-41624736
  hyper

SEQ ID NO: 20018 - DNA, 54 bp, Homo sapiens; identical to SEQ ID NO: 9487
  chr8:41625007-41625061
  hyper

SEQ ID NO: 20019 - DNA, 144 bp, Homo sapiens; identical to SEQ ID NO: 9488
  chr8:41686308-41686452
  hyper

SEQ ID NO: 20020 - DNA, 56 bp, Homo sapiens
  chr8:41733449-41733505
  hyper
ccagaggggccggcgcgcgcccgggcgcacactcgcacacctgcccgcgcgcacac

SEQ ID NO: 20021 - DNA, 14 bp, Homo sapiens
  chr8:41733640-41733654
  hyper
agagctcggagcgg

SEQ ID NO: 20022 - DNA, 92 bp, Homo sapiens; identical to SEQ ID NO: 9490
  chr8:41733684-41733776
  hyper

SEQ ID NO: 20023 - DNA, 268 bp, Homo sapiens
  chr8:41753325-41753593
  hyper
ggaagggcaggagcccgactctcgttcagagacacctgggaaagacgctctcttcgtcagagtgggtcacctagggagaagccgggcagagctgcccccccccggcccgctccccggagcctgcagccgcgtttacccaaaccagctctcctggaaagccagcgggtgcggcgcgcccgagcagggcagcccaccacccgcagccggcagccaaggccgggaaagttggtcctagagcagcgcgggcctgccgggtgctgtccaaggt

SEQ ID NO: 20024 - DNA, 382 bp, Homo sapiens
  chr8:41753770-41754152
  hyper
cgggcgccgcgccccaccgcgtcccgggccgcccgacccctgcccccagcagccacttgcaggtgccgcggtcgctgggctttcaccgccgccccctcctaccttcttctttcggtcacgggagcggtttctccgcttcctgttggattcctccttctccttctgctcctggagggcctgcgcctcgatgtctttgattttcttcagctgtttggccgcttgagccatggcgggtcacggcgctcccgtccccgcctcctggacccctagcgctcagcgatccccgaggcgacaccccctaagaaggggaagggggtctctgctccacagaggggacagcgttcgtggcgccccgagggccggctgctgcggggtcgcggga

SEQ ID NO: 20025 - DNA, 293 bp, Homo sapiens
  chr8:41754885-41755178
  hyper
ttgcccctttcagaccatgtgggcctttcatttgcatatttccgaattatagatgaaaacgtatccaggatcaagtgaattgttttcctttgagtcctcttgggacagaaaaggaagtaggtccccgctccagccccgcccgtcccccatccccggcgctcccgcgcacgcctccctggggacgccgcctgcgcccgtgccccgcggggaagagctgcacttgggtccgcagcgccagcccagcctgcggcaggcggagggggcctagggctcagccaaccaccccgtcacgc

SEQ ID NO: 20026 - DNA, 40 bp, Homo sapiens; identical to SEQ ID NO: 9494
  chr8:42009967-42010007
  hyper

SEQ ID NO: 20027 - DNA, 36 bp, Homo sapiens; identical to SEQ ID NO: 9495
  chr8:43102519-43102555
  hyper

SEQ ID NO: 20028 - DNA, 3 bp, Homo sapiens
  chr8:49293614-49293617
  hyper
atc

SEQ ID NO: 20029 - DNA, 1 bp, Homo sapiens
  chr8:49468668-49468669
  hyper
t

SEQ ID NO: 20030 - DNA, 64 bp, Homo sapiens
  chr8:49469127-49469191
  hyper
gcagtcttgctttgaatttaaacagcgaagaagccagagggtcctgttccgtatggggggaggg

SEQ ID NO: 20031 - DNA, 34 bp, Homo sapiens; identical to SEQ ID NO: 9501
  chr8:49647817-49647851
  hyper

SEQ ID NO: 20032 - DNA, 189 bp, Homo sapiens; identical to SEQ ID NO: 9502
  chr8:49782697-49782886
  hyper

SEQ ID NO: 20033 - DNA, 30 bp, Homo sapiens; identical to SEQ ID NO: 9503
  chr8:49834319-49834349
  hyper

SEQ ID NO: 20034 - DNA, 30 bp, Homo sapiens; identical to SEQ ID NO: 9504
  chr8:49834685-49834715
  hyper

SEQ ID NO: 20035 - DNA, 25 bp, Homo sapiens
  chr8:50822308-50822333
  hyper
acagcgaccgcggcctgcaatgtgc

SEQ ID NO: 20036 - DNA, 30 bp, Homo sapiens; identical to SEQ ID NO: 9506
  chr8:50822561-50822591
  hyper

SEQ ID NO: 20037 - DNA, 36 bp, Homo sapiens; identical to SEQ ID NO: 9507
  chr8:50823108-50823144
  hyper

SEQ ID NO: 20038 - DNA, 15 bp, Homo sapiens
  chr8:50824293-50824308
  hyper
ctgcagccacaggga

SEQ ID NO: 20039 - DNA, 20 bp, Homo sapiens
  chr8:50824352-50824372
  hyper
cgccacgggcagctgggcta

SEQ ID NO: 20040 - DNA, 49 bp, Homo sapiens; identical to SEQ ID NO: 9511
  chr8:53477121-53477170
  hyper

SEQ ID NO: 20041 - DNA, 30 bp, Homo sapiens; identical to SEQ ID NO: 9514
  chr8:53853779-53853809
  hyper

SEQ ID NO: 20042 - DNA, 21 bp, Homo sapiens
  chr8:54789257-54789278
  hyper
cctaactggagaagccgctgg

SEQ ID NO: 20043 - DNA, 19 bp, Homo sapiens
  chr8:54789613-54789632
  hyper
aacatgagctggagacgcc

SEQ ID NO: 20044 - DNA, 214 bp, Homo sapiens
  chr8:54790077-54790291
  hyper
tccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaa

SEQ ID NO: 20045 - DNA, 397 bp, Homo sapiens
  chr8:54792237-54792634
  hyper
ccaactgacccgctccgctggggctagcagtagggagggtggcaaggtcgggaaggccgggacgtggctgggcaagtcctaggacgggacattggcggctcccgggacaccgcccctccccgcgggaagacactccaagctactttttcctgggccatttcctttccatggtccaagaaaacgggagggagccctcgctcttccccgaggctgcctttcaaactctcagcgtgtcgctctcctccgcctactccgagcctcccccaaacgcgcctccgcctgctcccagcgctcgctctcccactcccctgccctctcggcaggcaagggaggaaatgacgtgatgttatttttgtgtcaggtcagtttccagcttcagcttagccctccgggctcc

SEQ ID NO: 20046 - DNA, 368 bp, Homo sapiens
  chr8:54792760-54793128
  hyper
tactcctttccccggactccggagtccctggagaaggggacgcggagggcgactgccgagggtctcagcgggatctggagtcaggggttagttcccccccttatcccccgctcggttgctgggtggggcctccgcgctctggctagctgggagggggcgagggccgctttccagggcgggaagaccggaggcctaggctgcgccggggtggggcggggacagagctcagagaggcgccccgggccggggagaaggtagggggctgccctccagagacgcgcagtccacagacgcgaagctctggggaccaagcgccccctccatgcctgccgcccacccccgctccttcctcccgctcccttcattca

SEQ ID NO: 20047 - DNA, 161 bp, Homo sapiens; identical to SEQ ID NO: 9524
  chr8:54793349-54793510
  hyper

SEQ ID NO: 20048 - DNA, 126 bp, Homo sapiens; identical to SEQ ID NO: 9525
  chr8:54793756-54793882
  hyper

SEQ ID NO: 20049 - DNA, 50 bp, Homo sapiens
  chr8:54794167-54794217
  hyper
ccagggcaggggcaccgaggggcagggtgaggaagtggacgccccacgcg

SEQ ID NO: 20050 - DNA, 57 bp, Homo sapiens
  chr8:54794327-54794384
  hyper
agttaacgtgcaggcgccgccgggattttcctggaacaaacccgggcacttgatctt

SEQ ID NO: 20051 - DNA, 66 bp, Homo sapiens
  chr8:54794647-54794713
  hyper
tccccacacccagctcgggcggaggagccctgagagaagcggctagctgagagtggggtgggcgtt

SEQ ID NO: 20052 - DNA, 23 bp, Homo sapiens
  chr8:55366165-55366188
  hyper
aagagggaagtggaccgggaaca

SEQ ID NO: 20053 - DNA, 6 bp, Homo sapiens
  chr8:55371172-55371178
  hyper
cgaccc

SEQ ID NO: 20054 - DNA, 29 bp, Homo sapiens
  chr8:55379202-55379231
  hyper
ctcttagcttggtgccggggcccgcccgg

SEQ ID NO: 20055 - DNA, 108 bp, Homo sapiens; identical to SEQ ID NO: 3262
  chr8:55380036-55380144
  hyper

SEQ ID NO: 20056 - DNA, 26 bp, Homo sapiens
  chr8:56014131-56014157
  hyper
ccgagcccgggcgcccgagttacacc

SEQ ID NO: 20057 - DNA, 247 bp, Homo sapiens
  chr8:56014376-56014623
  hyper
cgttccgaaatcccgggagtgggggccttcgactgtcaccctcaggcccccttggccgctcctcccggcccttgggacccgccagggcagtcccccaacccccgcccgccgctcctctcggtcccggcccctcctccgggtccctcctcctccctcgcccctcccgagccagggtgggagcgacggcagctggaagagaagggatgaggtcatcctctccctcggagtcagctggtggaggagagga

SEQ ID NO: 20058 - DNA, 4 bp, Homo sapiens
  chr8:56015034-56015038
  hyper
ggtg

SEQ ID NO: 20059 - DNA, 13 bp, Homo sapiens
  chr8:56015619-56015632
  hyper
attgcaagacggt

SEQ ID NO: 20060 - DNA, 27 bp, Homo sapiens
  chr8:57026141-57026168
  hyper
ggctattggaccctgcgggcgtgcgcg

SEQ ID NO: 20061 - DNA, 109 bp, Homo sapiens
  chr8:57026213-57026322
  hyper
ctacgttgagctcagcccagaaactccgccgagatgctagtcggttcttggtgcacttgttcacttgctttatggccacaggaacaccgcggtaagtcgccttgtacac

SEQ ID NO: 20062 - DNA, 2 bp, Homo sapiens
  chr8:57026501-57026503
  hyper
cg

SEQ ID NO: 20063 - DNA, 9 bp, Homo sapiens
  chr8:57026547-57026556
  hyper
ttgcagggg

SEQ ID NO: 20064 - DNA, 180 bp, Homo sapiens; identical to SEQ ID NO: 9555
  chr8:57232591-57232771
  hyper

SEQ ID NO: 20065 - DNA, 23 bp, Homo sapiens
  chr8:57359636-57359659
  hyper
ccccctcgcgggtccccgtgggc

SEQ ID NO: 20066 - DNA, 30 bp, Homo sapiens
  chr8:57360540-57360570
  hyper
tttccaggccctctgcgccctctgcaaagg

SEQ ID NO: 20067 - DNA, 15 bp, Homo sapiens
  chr8:57360791-57360806
  hyper
cggggcatcacggta

SEQ ID NO: 20068 - DNA, 29 bp, Homo sapiens
  chr8:58907390-58907419
  hyper
agagagactgctgggcgggggttgggatt

SEQ ID NO: 20069 - DNA, 215 bp, Homo sapiens
  chr8:58907483-58907698
  hyper
cgcggagctaagccggctctgcgcctgcagcttccccgcccggcccgggtctccgttgagcccggcctcactggcccaggcggaccccgtccggctttctgggctgccgggggaggcgcagcgccgctgcctgccccgcgccccctctgcgctcggcttggctgcacgtcccgggctcggctaggaggctgggcacggggccggggctggagccg

SEQ ID NO: 20070 - DNA, 106 bp, Homo sapiens
  chr8:58907835-58907941
  hyper
tctaatctcggtgttaaatactttatgagagtatcaataccacctaatcctttgctgagaattactgctagaaatgtagattctgaggttccgaaagtttgttttt

SEQ ID NO: 20071 - DNA, 37 bp, Homo sapiens; identical to SEQ ID NO: 9563
  chr8:60030268-60030305
  hyper

SEQ ID NO: 20072 - DNA, 71 bp, Homo sapiens; identical to SEQ ID NO: 9564
  chr8:60030539-60030610
  hyper

SEQ ID NO: 20073 - DNA, 65 bp, Homo sapiens; identical to SEQ ID NO: 9565
  chr8:60030824-60030889
  hyper

SEQ ID NO: 20074 - DNA, 61 bp, Homo sapiens; identical to SEQ ID NO: 9566
  chr8:60031205-60031266
  hyper

SEQ ID NO: 20075 - DNA, 75 bp, Homo sapiens; identical to SEQ ID NO: 9567
  chr8:60031479-60031554
  hyper

SEQ ID NO: 20076 - DNA, 89 bp, Homo sapiens; identical to SEQ ID NO: 9568
  chr8:60032140-60032229
  hyper

SEQ ID NO: 20077 - DNA, 190 bp, Homo sapiens
  chr8:60032490-60032680
  hyper
tcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctct

SEQ ID NO: 20078 - DNA, 391 bp, Homo sapiens; identical to SEQ ID NO: 9570
  chr8:61193203-61193594
  hyper

SEQ ID NO: 20079 - DNA, 30 bp, Homo sapiens
  chr8:62200776-62200806
  hyper
ggcgtttcagcacttcggtatgtggacagc

SEQ ID NO: 20080 - DNA, 171 bp, Homo sapiens; identical to SEQ ID NO: 9572
  chr8:63160730-63160901
  hyper

SEQ ID NO: 20081 - DNA, 27 bp, Homo sapiens
  chr8:63161631-63161658
  hyper
catgggctgctgcaccggacgctgctc

SEQ ID NO: 20082 - DNA, 32 bp, Homo sapiens; identical to SEQ ID NO: 9574
  chr8:63998517-63998549
  hyper

SEQ ID NO: 20083 - DNA, 82 bp, Homo sapiens; identical to SEQ ID NO: 9575
  chr8:65281329-65281411
  hyper

SEQ ID NO: 20084 - DNA, 124 bp, Homo sapiens
  chr8:65286558-65286682
  hyper
cctagaatggagccccggccagccgcgggccgggccccttggttttcaggacttattcttgccggggttggctcgcacgccagcatcgcgccttcggtgcgtcttttatctccatctcaaatat

SEQ ID NO: 20085 - DNA, 21 bp, Homo sapiens
  chr8:65286942-65286963
  hyper
agaaagtagccttctcgtgcc

SEQ ID NO: 20086 - DNA, 74 bp, Homo sapiens
  chr8:65289049-65289123
  hyper
tttagttttagacaacgtattcaaagtacttgagaagaatatgcaatgacattttttccgtgtcctaatcagga

SEQ ID NO: 20087 - DNA, 112 bp, Homo sapiens
  chr8:65289241-65289353
  hyper
gataagattaaacataaacctaaaccttggcctcgggggaaggcaggctgcggggttgagaagaggagatgcagattagctctgcttttgctgcttgcgcacataattaaga

SEQ ID NO: 20088 - DNA, 22 bp, Homo sapiens
  chr8:65289592-65289614
  hyper
gagaggctggaagctcgacgtc

SEQ ID NO: 20089 - DNA, 30 bp, Homo sapiens; identical to SEQ ID NO: 9585
  chr8:65291776-65291806
  hyper

SEQ ID NO: 20090 - DNA, 146 bp, Homo sapiens
  chr8:65493433-65493579
  hyper
gcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 20091 - DNA, 149 bp, Homo sapiens; identical to SEQ ID NO: 3283
  chr8:65493806-65493955
  hyper

SEQ ID NO: 20092 - DNA, 66 bp, Homo sapiens
  chr8:65498500-65498566
  hyper
gcaaatgatcatcttcgatagagctctctagttacccgtgcttctccctccctatggtatgtgttt

SEQ ID NO: 20093 - DNA, 7 bp, Homo sapiens
  chr8:65499750-65499757
  hyper
tccacgc

SEQ ID NO: 20094 - DNA, 30 bp, Homo sapiens; identical to SEQ ID NO: 9597
  chr8:67089781-67089811
  hyper

SEQ ID NO: 20095 - DNA, 5 bp, Homo sapiens
  chr8:67344533-67344538
  hyper
caagg

SEQ ID NO: 20096 - DNA, 89 bp, Homo sapiens
  chr8:67940875-67940964
  hyper
ccccggtgggtccttcccctgtgaggcggcggccgggcgctgatgggcactgacggtggtcactaggccgactccgactagagtcctgt

SEQ ID NO: 20097 - DNA, 33 bp, Homo sapiens
  chr8:68864545-68864578
  hyper
cgccgccgggggccgggcagcagcgggcgcgcg

SEQ ID NO: 20098 - DNA, 38 bp, Homo sapiens
  chr8:68864765-68864803
  hyper
tgtcggtgagtgtccccggcagacgcagggggacgtcc

SEQ ID NO: 20099 - DNA, 37 bp, Homo sapiens; identical to SEQ ID NO: 9609
  chr8:68865398-68865435
  hyper

SEQ ID NO: 20100 - DNA, 10 bp, Homo sapiens
  chr8:69244500-69244510
  hyper
aggcccttgc

SEQ ID NO: 20101 - DNA, 125 bp, Homo sapiens; identical to SEQ ID NO: 9614
  chr8:69244511-69244636
  hyper

SEQ ID NO: 20102 - DNA, 34 bp, Homo sapiens; identical to SEQ ID NO: 9615
  chr8:70404830-70404864
  hyper

SEQ ID NO: 20103 - DNA, 21 bp, Homo sapiens
  chr8:70744839-70744860
  hyper
agcttctgcagtggccggcgc

SEQ ID NO: 20104 - DNA, 270 bp, Homo sapiens
  chr8:70744925-70745195
  hyper
tttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttga

SEQ ID NO: 20105 - DNA, 30 bp, Homo sapiens; identical to SEQ ID NO: 9617
  chr8:70945287-70945317
  hyper

SEQ ID NO: 20106 - DNA, 21 bp, Homo sapiens
  chr8:70983226-70983247
  hyper
ctcctccgacctcagggatct

SEQ ID NO: 20107 - DNA, 16 bp, Homo sapiens
  chr8:70984978-70984994
  hyper
tcgcctcttgtcccaa

SEQ ID NO: 20108 - DNA, 32 bp, Homo sapiens
  chr8:72273966-72273998
  hyper
gctcctggatgggtacgcgcgggggctctcag

SEQ ID NO: 20109 - DNA, 101 bp, Homo sapiens
  chr8:72274033-72274134
  hyper
agcgcctctgcaggggaaagctcggcgcagggggcaggcgcctggccgctgccgcaggctcgggctgccgagcgactgagcgaaaacgtgttccccaggaa

SEQ ID NO: 20110 - DNA, 78 bp, Homo sapiens; identical to SEQ ID NO: 810
  chr8:72460433-72460511
  hyper

SEQ ID NO: 20111 - DNA, 86 bp, Homo sapiens
  chr8:72755176-72755262
  hyper
ccgttcacgcttcttcctggactttgcccgcaggataatttggtgaaactcatctgactttgaggttctgtcgtttagttcccttc

SEQ ID NO: 20112 - DNA, 196 bp, Homo sapiens
  chr8:72755470-72755666
  hyper
ctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaa

SEQ ID NO: 20113 - DNA, 15 bp, Homo sapiens
  chr8:73163646-73163661
  hyper
ccggacttcagaacc

SEQ ID NO: 20114 - DNA, 46 bp, Homo sapiens; identical to SEQ ID NO: 9640
  chr8:73448786-73448832
  hyper

SEQ ID NO: 20115 - DNA, 153 bp, Homo sapiens; identical to SEQ ID NO: 3315
  chr8:73449802-73449955
  hyper

SEQ ID NO: 20116 - DNA, 38 bp, Homo sapiens
  chr8:73450026-73450064
  hyper
cggggagaggctccccggagggagcggggaatcccaca

SEQ ID NO: 20117 - DNA, 16 bp, Homo sapiens
  chr8:73450100-73450116
  hyper
gcggggtctgtgggag

SEQ ID NO: 20118 - DNA, 7 bp, Homo sapiens
  chr8:77585698-77585705
  hyper
agaaaat

SEQ ID NO: 20119 - DNA, 62 bp, Homo sapiens
  chr8:77586278-77586340
  hyper
acagtcaattggaaggagcccgagtcagggagcaattgctaggacttcggacagagagggca

SEQ ID NO: 20120 - DNA, 66 bp, Homo sapiens
  chr8:77590466-77590532
  hyper
gcagtcccgccgccgcttcagcccaacagccctcctcacgctggcgcgctccgaggccaagccctg

SEQ ID NO: 20121 - DNA, 333 bp, Homo sapiens
  chr8:77593376-77593709
  hyper
ggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcac

SEQ ID NO: 20122 - DNA, 29 bp, Homo sapiens
  chr8:77594619-77594648
  hyper
agaggctggggtgaacgctggggctgggg

SEQ ID NO: 20123 - DNA, 453 bp, Homo sapiens; identical to SEQ ID NO: 9654
  chr8:79428468-79428921
  hyper

SEQ ID NO: 20124 - DNA, 23 bp, Homo sapiens
  chr8:80523960-80523983
  hyper
actgggcacattttacggtattg

SEQ ID NO: 20125 - DNA, 224 bp, Homo sapiens
  chr8:80524029-80524253
  hyper
agacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagc

SEQ ID NO: 20126 - DNA, 132 bp, Homo sapiens
  chr8:80524318-80524450
  hyper
tgctgcatcttcattcgaaagggggtcgggtggggagcgcagcgtgacacccaggagcccaaccctgcggggacagcggcgccacgccccgcgctccccgctcccgactccccgccgcggcttccaagagag

SEQ ID NO: 20127 - DNA, 101 bp, Homo sapiens
  chr8:80524845-80524946
  hyper
tgccttgagtgcccacggttctggcgctcagtggccccggggtgaaaaggcagggtggggcctggggtcctgtggcagctggaagcacgtgtcccccggga

SEQ ID NO: 20128 - DNA, 288 bp, Homo sapiens
  chr8:80525020-80525308
  hyper
tccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccc

SEQ ID NO: 20129 - DNA, 39 bp, Homo sapiens; identical to SEQ ID NO: 9657
  chr8:80525530-80525569
  hyper

SEQ ID NO: 20130 - DNA, 80 bp, Homo sapiens
  chr8:80803593-80803673
  hyper
actctcaaatgccaccggcacattcttttaaaaaaaaatgaaaggaaagaaagaaagaaaaagaaaataagagaggaaaa

SEQ ID NO: 20131 - DNA, 29 bp, Homo sapiens
  chr8:81478156-81478185
  hyper
cgtctttcctcctatcgtatgttacggtt

SEQ ID NO: 20132 - DNA, 5 bp, Homo sapiens
  chr8:81478350-81478355
  hyper
cacaa

SEQ ID NO: 20133 - DNA, 448 bp, Homo sapiens; identical to SEQ ID NO: 9660
  chr8:82192848-82193296
  hyper

SEQ ID NO: 20134 - DNA, 30 bp, Homo sapiens; identical to SEQ ID NO: 9661
  chr8:82193521-82193551
  hyper

SEQ ID NO: 20135 - DNA, 325 bp, Homo sapiens
  chr8:89339064-89339389
  hyper
aattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgat

SEQ ID NO: 20136 - DNA, 261 bp, Homo sapiens
  chr8:89339745-89340006
  hyper
cgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcgcgcgcgcgcgcacacacacacac

SEQ ID NO: 20137 - DNA, 52 bp, Homo sapiens
  chr8:89340345-89340397
  hyper
cctggggagcggcccaaccctggtcctggagagcggtcggcattcctgagga

SEQ ID NO: 20138 - DNA, 30 bp, Homo sapiens; identical to SEQ ID NO: 9667
  chr8:89340928-89340958
  hyper

SEQ ID NO: 20139 - DNA, 32 bp, Homo sapiens; identical to SEQ ID NO: 9668
  chr8:91094254-91094286
  hyper

SEQ ID NO: 20140 - DNA, 59 bp, Homo sapiens
  chr8:91997947-91998006
  hyper
caggcgctgctttccccttggtgcatttagtgggtgtcgggattcgggttggcagggag

SEQ ID NO: 20141 - DNA, 30 bp, Homo sapiens; identical to SEQ ID NO: 9673
  chr8:93115382-93115412
  hyper

SEQ ID NO: 20142 - DNA, 36 bp, Homo sapiens; identical to SEQ ID NO: 9674
  chr8:93115823-93115859
  hyper

SEQ ID NO: 20143 - DNA, 77 bp, Homo sapiens
  chr8:97157008-97157085
  hyper
cgcagtgataggcctcgtactccaggggcgcgataatccagtcgtcccagcccagctccttgaagttcacgtgcagg

SEQ ID NO: 20144 - DNA, 77 bp, Homo sapiens
  chr8:97158066-97158143
  hyper
gccctttgtggtctcaagcctgggccgcgtttcccctagacctcctctgggctgggctggctcgttctcgttgacgt

SEQ ID NO: 20145 - DNA, 122 bp, Homo sapiens
  chr8:97169716-97169838
  hyper
cccttgggggacccccggctccaccgagccaggccagccccactcgacggcgatttaaacatcccttaggcaaggcgccaagttagcgctgctggcccagctctaggcgggccgctgctctt

SEQ ID NO: 20146 - DNA, 4 bp, Homo sapiens
  chr8:97170334-97170338
  hyper
tgtc

SEQ ID NO: 20147 - DNA, 291 bp, Homo sapiens; identical to SEQ ID NO: 822
  chr8:97170377-97170668
  hyper

SEQ ID NO: 20148 - DNA, 10 bp, Homo sapiens
  chr8:97171119-97171129
  hyper
gaacctcgct

SEQ ID NO: 20149 - DNA, 233 bp, Homo sapiens
  chr8:97172200-97172433
  hyper
gctgcctcccgtcctccacgtttcccccaccagccaccaacaagcggcaaccacgctgccttctgcaaaagaggaagaaggaaagaagggagagagaaagaaagggggggaaaggaagggaggtttagagactggaatagaatccgcagccacattcagaaacttactcgagcttgagaaaaacaatttaagaaaagtaaaaaggaagtgtccagagcaggaagggaattcac

SEQ ID NO: 20150 - DNA, 68 bp, Homo sapiens
  chr8:97173458-97173526
  hyper
gcggcggcgcccccaagagacagcttggagcaggcgcctctgctgcaggctgcgtgctgcctcggggc

SEQ ID NO: 20151 - DNA, 13 bp, Homo sapiens
  chr8:97173527-97173540
  hyper
gtggtaccctccc

SEQ ID NO: 20152 - DNA, 30 bp, Homo sapiens; identical to SEQ ID NO: 9688
  chr8:97505645-97505675
  hyper

SEQ ID NO: 20153 - DNA, 262 bp, Homo sapiens
  chr8:97507284-97507546
  hyper
gttgcaccgcggggcgtcagggacgggaggacattttcataggagttacacgggagtgccgcaagcagggcgaggcggggtacgtgtgacacggcgctcggcttcgggtcgcctggccgctgggggacagaggcttccctcccgccacgctcgccctctctggccctggcggggcgcttctggggccgggaggagtctcgtctccggcggagcgcctgccggcacccagcttccctcccccgccctggcggtgggaacttga

SEQ ID NO: 20154 - DNA, 15 bp, Homo sapiens
  chr8:97507680-97507695
  hyper
cgggccaggtggaag

SEQ ID NO: 20155 - DNA, 7 bp, Homo sapiens
  chr8:98289818-98289825
  hyper
cagtcca

SEQ ID NO: 20156 - DNA, 87 bp, Homo sapiens
  chr8:98290260-98290347
  hyper
ccgcgggcgctcccacccccatctcgcgcggactcgctttaggtctcggcgagtttctctgatatgcgctcgcgggggtgctgccat

SEQ ID NO: 20157 - DNA, 94 bp, Homo sapiens; identical to SEQ ID NO: 9694
  chr8:99076589-99076683
  hyper

SEQ ID NO: 20158 - DNA, 240 bp, Homo sapiens; identical to SEQ ID NO: 9695
  chr8:99076759-99076999
  hyper

SEQ ID NO: 20159 - DNA, 91 bp, Homo sapiens; identical to SEQ ID NO: 9696
  chr8:99439283-99439374
  hyper

SEQ ID NO: 20160 - DNA, 36 bp, Homo sapiens
  chr8:99952815-99952851
  hyper
gcagacgcgggaaggcccccgcgccatccgtgggag

SEQ ID NO: 20161 - DNA, 74 bp, Homo sapiens
  chr8:99954416-99954490
  hyper
tcagcccccagtgggcgcagaggtggcccaggagggcccgcggacggtgctgcgctgcgctcagcctccgggcc

SEQ ID NO: 20162 - DNA, 30 bp, Homo sapiens; identical to SEQ ID NO: 9703
  chr8:99960111-99960141
  hyper

SEQ ID NO: 20163 - DNA, 18 bp, Homo sapiens
  chr8:99961822-99961840
  hyper
ctgcgggatcacaggtga

SEQ ID NO: 20164 - DNA, 30 bp, Homo sapiens; identical to SEQ ID NO: 9709
  chr8:101118014-101118044
  hyper

SEQ ID NO: 20165 - DNA, 59 bp, Homo sapiens
  chr8:101822047-101822106
  hyper
ctacgacagcgaggggcccgggaagcccgcggaaacgcaggaggcggccaggagaggca

SEQ ID NO: 20166 - DNA, 174 bp, Homo sapiens; identical to SEQ ID NO: 9712
  chr8:104152775-104152949
  hyper

SEQ ID NO: 20167 - DNA, 182 bp, Homo sapiens
  chr8:104153267-104153449
  hyper
cgggcggcctgcactcgggtaagtggccgggcccctgcagaccctcgcccgcccgctaccccgggcgccttggcccgggcactgagagaggagccggttccctgaggaattgatggcgcggcgggggtggctgggaggaagcagaggcaggacctgcccactgatcagtggacagatgcaag

SEQ ID NO: 20168 - DNA, 349 bp, Homo sapiens; identical to SEQ ID NO: 9714
  chr8:104511157-104511506
  hyper

SEQ ID NO: 20169 - DNA, 100 bp, Homo sapiens
  chr8:104512023-104512123
  hyper
gggaggggcggctgccgcccgcggggcgcccgcggtgcccgggcctgggcagcgaggaggtgacgccgcccccgcgggatgagcccgggaggcggagggg

SEQ ID NO: 20170 - DNA, 57 bp, Homo sapiens
  chr8:104513405-104513462
  hyper
aggccacgagggctgcggccagcgccggccgcccgggctgttttaggggtgtctgag

SEQ ID NO: 20171 - DNA, 120 bp, Homo sapiens
  chr8:105235249-105235369
  hyper
cctgtgtttgaggagcgttaaaaaaaactgtgaacctgaggaaagggaaagtgactaccagaaatttaccggtttacttatctgagatgcctaactcactgcatctaattagtcaccact

SEQ ID NO: 20172 - DNA, 155 bp, Homo sapiens; identical to SEQ ID NO: 9720
  chr8:105600526-105600681
  hyper

SEQ ID NO: 20173 - DNA, 87 bp, Homo sapiens; identical to SEQ ID NO: 9721
  chr8:105601174-105601261
  hyper

SEQ ID NO: 20174 - DNA, 30 bp, Homo sapiens; identical to SEQ ID NO: 9722
  chr8:105602021-105602051
  hyper

SEQ ID NO: 20175 - DNA, 30 bp, Homo sapiens; identical to SEQ ID NO: 9723
  chr8:106330435-106330465
  hyper

SEQ ID NO: 20176 - DNA, 63 bp, Homo sapiens; identical to SEQ ID NO: 9724
  chr8:106331011-106331074
  hyper

SEQ ID NO: 20177 - DNA, 77 bp, Homo sapiens
  chr8:106331083-106331160
  hyper
cggcggcggcggcggcgggagccgagggagcggcagccgcgaccgcgggcaccgcgggagccccagcggcagcagcc

SEQ ID NO: 20178 - DNA, 505 bp, Homo sapiens; identical to SEQ ID NO: 9726
  chr8:107283327-107283832
  hyper

SEQ ID NO: 20179 - DNA, 140 bp, Homo sapiens; identical to SEQ ID NO: 9727
  chr8:107284082-107284222
  hyper

SEQ ID NO: 20180 - DNA, 245 bp, Homo sapiens
  chr8:109094595-109094840
  hyper
gaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagg

SEQ ID NO: 20181 - DNA, 117 bp, Homo sapiens; identical to SEQ ID NO: 3359
  chr8:110703765-110703882
  hyper

SEQ ID NO: 20182 - DNA, 30 bp, Homo sapiens; identical to SEQ ID NO: 9734
  chr8:110704224-110704254
  hyper

SEQ ID NO: 20183 - DNA, 52 bp, Homo sapiens; identical to SEQ ID NO: 9735
  chr8:110986212-110986264
  hyper

SEQ ID NO: 20184 - DNA, 115 bp, Homo sapiens
  chr8:110986328-110986443
  hyper
cggggttggcatcgtcgcaaagctccagagggctgggcacggcggccagggccccggggcggcggtaggaagccaccaccacggccagcttgccaaggcgcgtgtgcgggaagca

SEQ ID NO: 20185 - DNA, 85 bp, Homo sapiens; identical to SEQ ID NO: 9737
  chr8:110986934-110987019
  hyper

SEQ ID NO: 20186 - DNA, 202 bp, Homo sapiens; identical to SEQ ID NO: 9738
  chr8:110987020-110987222
  hyper

SEQ ID NO: 20187 - DNA, 146 bp, Homo sapiens; identical to SEQ ID NO: 9739
  chr8:110987765-110987911
  hyper

SEQ ID NO: 20188 - DNA, 41 bp, Homo sapiens; identical to SEQ ID NO: 9741
  chr8:114445521-114445562
  hyper

SEQ ID NO: 20189 - DNA, 30 bp, Homo sapiens; identical to SEQ ID NO: 9744
  chr8:114447368-114447398
  hyper

SEQ ID NO: 20190 - DNA, 30 bp, Homo sapiens; identical to SEQ ID NO: 9745
  chr8:114448796-114448826
  hyper

SEQ ID NO: 20191 - DNA, 59 bp, Homo sapiens
  chr8:117950379-117950438
  hyper
tccttgaattacctccgcccccgccctgaccccgccctaaacatcaaacttagaaactc

SEQ ID NO: 20192 - DNA, 50 bp, Homo sapiens
  chr8:117950468-117950518
  hyper
caggcgtctccgcgatgggccccggggacttccgccgctgcagagagaga

SEQ ID NO: 20193 - DNA, 4 bp, Homo sapiens
  chr8:117950779-117950783
  hyper
accc

SEQ ID NO: 20194 - DNA, 38 bp, Homo sapiens
  chr8:117950914-117950952
  hyper
ctcaggtctggacacggcgttgacgcccccgcctcccc

SEQ ID NO: 20195 - DNA, 30 bp, Homo sapiens; identical to SEQ ID NO: 9753
  chr8:122652164-122652194
  hyper

SEQ ID NO: 20196 - DNA, 151 bp, Homo sapiens
  chr8:124173095-124173246
  hyper
gaccttctgagccttcgagtggaatgaaactcgaacggcttcccagctgcggcgatgaggtcccgctcctgcagaatcccggcaggagcggagactcgggaggggaccgctggctgcaggcgccctgctggagtccggaacgagggtggtc

SEQ ID NO: 20197 - DNA, 33 bp, Homo sapiens; identical to SEQ ID NO: 9755
  chr8:131455313-131455346
  hyper

SEQ ID NO: 20198 - DNA, 102 bp, Homo sapiens; identical to SEQ ID NO: 9756
  chr8:131455680-131455782
  hyper

SEQ ID NO: 20199 - DNA, 142 bp, Homo sapiens
  chr8:132052005-132052147
  hyper
tcagcacgtccagcacgttcatcaccacttccgatttgcgcctttggcccaagaaatagcgctggtagaggcgttccaaatcccgagatttgaaggagttgcgcagggtggggaaaatgacccctcggtagctatagccccc

SEQ ID NO: 20200 - DNA, 30 bp, Homo sapiens; identical to SEQ ID NO: 9760
  chr8:132053488-132053518
  hyper

SEQ ID NO: 20201 - DNA, 257 bp, Homo sapiens; identical to SEQ ID NO: 9763
  chr8:133492359-133492616
  hyper

SEQ ID NO: 20202 - DNA, 41 bp, Homo sapiens; identical to SEQ ID NO: 9764
  chr8:133493711-133493752
  hyper

SEQ ID NO: 20203 - DNA, 30 bp, Homo sapiens; identical to SEQ ID NO: 9766
  chr8:139926700-139926730
  hyper

SEQ ID NO: 20204 - DNA, 250 bp, Homo sapiens
  chr8:140715219-140715469
  hyper
cgttctgcctcttcatggccgccagcaaggagccggcgcggggggcatgtcccgcaggctcacagccgcgcgcgtcccactgcagcgcccggcggccgccgccgcctcctcctccgccgccgccgccgccgcctccaagttgtaagcggcggcggcagcagcagcagcagcagcggggaggcggggggcggggaggctggggggggccccctccgctggggccgccacagccaccgccaccgcgaggcgg

SEQ ID NO: 20205 - DNA, 75 bp, Homo sapiens; identical to SEQ ID NO: 9769
  chr8:140715859-140715934
  hyper

SEQ ID NO: 20206 - DNA, 197 bp, Homo sapiens; identical to SEQ ID NO: 9770
  chr8:140716694-140716891
  hyper

SEQ ID NO: 20207 - DNA, 30 bp, Homo sapiens; identical to SEQ ID NO: 9771
  chr8:140717104-140717134
  hyper

SEQ ID NO: 20208 - DNA, 15 bp, Homo sapiens
  chr8:142529027-142529042
  hyper
cggaggcaggccctc

SEQ ID NO: 20209 - DNA, 177 bp, Homo sapiens; identical to SEQ ID NO: 9776
  chr8:143530536-143530713
  hyper

SEQ ID NO: 20210 - DNA, 352 bp, Homo sapiens; identical to SEQ ID NO: 9777
  chr8:143531062-143531414
  hyper

SEQ ID NO: 20211 - DNA, 125 bp, Homo sapiens; identical to SEQ ID NO: 9778
  chr8:143531646-143531771
  hyper

SEQ ID NO: 20212 - DNA, 81 bp, Homo sapiens
  chr8:143532041-143532122
  hyper
ccccagactccttctcgaagccctcgctcgtagaagccctcgcctgtagacctggcattggcagtggagactccctggagg

SEQ ID NO: 20213 - DNA, 653 bp, Homo sapiens
  chr8:143532846-143533499
  hyper
tgcaactccggagtagttgaaaggcaggaaggcgtgtgggcgggtagggggcctgcactcccgccccagaggagccgcttgtcgtttgtgttggggagggagctgggaggtctgctctcccgctccatcctgggaacccacggagaccctcggtactctccccacagacacaaacacacgccccctcggagcgagagccgccgcgggggaacagcagaggccgcgcgggcggaggcgggggaaaggggagctgggtcccttttctatctgggagggaggtggtatacggtgtgtggggtctggggaggcgactgtcacgtctcctagaaccctcatgccttccactcgtctgcgaccccggctgccgaggaggcaacgagggaggtcgagccgctccctcccgtgggcggcagcgaaactctgcgcccgcacgccggggtgccgccgagtccggctttgagtacccagcaaggtcaagcaggcgaaggagggggcgggggttcctgggcgcgcccccgtccgcgcacagtcggggccttggaagggggtgtgcgcagcccgccgagtcagtcccgctcgcctgccgcccgcgcccggtccccggaggcggacgttgcgcgcgttcggggatcccggagcgcccggcgccccac

SEQ ID NO: 20214 - DNA, 111 bp, Homo sapiens
  chr8:143533500-143533611
  hyper
ccctcccttcggctcgctagctgctccttggcgctgctttcagacttgttgcgcctcgatctggggggcagaaggctggcccgggagacccggcggctgagggccgagccg

SEQ ID NO: 20215 - DNA, 145 bp, Homo sapiens
  chr8:143533906-143534051
  hyper
cgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcgg

SEQ ID NO: 20216 - DNA, 195 bp, Homo sapiens; identical to SEQ ID NO: 9784
  chr8:143591612-143591807
  hyper

SEQ ID NO: 20217 - DNA, 17 bp, Homo sapiens
  chr8:143591888-143591905
  hyper
cgcgcccctccgggcct

SEQ ID NO: 20218 - DNA, 146 bp, Homo sapiens; identical to SEQ ID NO: 9786
  chr8:143592126-143592272
  hyper

SEQ ID NO: 20219 - DNA, 45 bp, Homo sapiens; identical to SEQ ID NO: 9788
  chr8:143859143-143859188
  hyper

SEQ ID NO: 20220 - DNA, 147 bp, Homo sapiens
  chr8:144241287-144241434
  hyper
gccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 20221 - DNA, 87 bp, Homo sapiens; identical to SEQ ID NO: 3378
  chr8:144241435-144241522
  hyper

SEQ ID NO: 20222 - DNA, 67 bp, Homo sapiens
  chr8:144328254-144328321
  hyper
gacggctcgccagggcgcgcacgcggtggcggcggcggtggaggcgttgcccgcctagctaggggcc

SEQ ID NO: 20223 - DNA, 6 bp, Homo sapiens
  chr8:144328565-144328571
  hyper
tggtgg

SEQ ID NO: 20224 - DNA, 87 bp, Homo sapiens; identical to SEQ ID NO: 9793
  chr8:144503405-144503492
  hyper

SEQ ID NO: 20225 - DNA, 30 bp, Homo sapiens; identical to SEQ ID NO: 9794
  chr8:144509088-144509118
  hyper

SEQ ID NO: 20226 - DNA, 32 bp, Homo sapiens
  chr8:144510529-144510561
  hyper
agattccacaaacaaaacgaaacacaatttaa

SEQ ID NO: 20227 - DNA, 65 bp, Homo sapiens; identical to SEQ ID NO: 9797
  chr8:144510915-144510980
  hyper

SEQ ID NO: 20228 - DNA, 41 bp, Homo sapiens
  chr8:144511184-144511225
  hyper
tctaggctggcagggcgaaggtgggaacggagaaccacgtt

SEQ ID NO: 20229 - DNA, 617 bp, Homo sapiens
  chr8:144511424-144512041
  hyper
cgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgt

SEQ ID NO: 20230 - DNA, 118 bp, Homo sapiens; identical to SEQ ID NO: 9799
  chr8:144651780-144651898
  hyper

SEQ ID NO: 20231 - DNA, 65 bp, Homo sapiens; identical to SEQ ID NO: 9800
  chr8:145700341-145700406
  hyper

SEQ ID NO: 20232 - DNA, 30 bp, Homo sapiens; identical to SEQ ID NO: 9801
  chr8:145806218-145806248
  hyper

SEQ ID NO: 20233 - DNA, 40 bp, Homo sapiens; identical to SEQ ID NO: 9802
  chr9:73266-73306
  hyper

SEQ ID NO: 20234 - DNA, 13 bp, Homo sapiens
  chr9:113420-113433
  hyper
cgcagcccagctt

SEQ ID NO: 20235 - DNA, 76 bp, Homo sapiens
  chr9:113774-113850
  hyper
ccggcggcgccgtcgcgcgcactcggcagaggcttcgcgggagaacgcgcagcccggggcgtggggcggggaactg

SEQ ID NO: 20236 - DNA, 269 bp, Homo sapiens
  chr9:113885-114154
  hyper
gagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggag

SEQ ID NO: 20237 - DNA, 102 bp, Homo sapiens; identical to SEQ ID NO: 9806
  chr9:114750-114852
  hyper

SEQ ID NO: 20238 - DNA, 8 bp, Homo sapiens
  chr9:117876-117884
  hyper
ctctgagg

SEQ ID NO: 20239 - DNA, 43 bp, Homo sapiens; identical to SEQ ID NO: 9811
  chr9:842922-842965
  hyper

SEQ ID NO: 20240 - DNA, 141 bp, Homo sapiens; identical to SEQ ID NO: 9812
  chr9:843219-843360
  hyper

SEQ ID NO: 20241 - DNA, 140 bp, Homo sapiens
  chr9:969846-969986
  hyper
agtgtcccctctcagcactgcccccttcagtccccctgcatttctggaaagtcaggcaaggcccaggtaggctgccagtgcactctcagccttgactgagcacctttcgggcctctggtgagccccgagagccaggtttg

SEQ ID NO: 20242 - DNA, 59 bp, Homo sapiens; identical to SEQ ID NO: 9815
  chr9:970533-970592
  hyper

SEQ ID NO: 20243 - DNA, 56 bp, Homo sapiens; identical to SEQ ID NO: 9817
  chr9:972016-972072
  hyper

SEQ ID NO: 20244 - DNA, 183 bp, Homo sapiens
  chr9:976435-976618
  hyper
cttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcgg

SEQ ID NO: 20245 - DNA, 96 bp, Homo sapiens; identical to SEQ ID NO: 9823
  chr9:977422-977518
  hyper

SEQ ID NO: 20246 - DNA, 13 bp, Homo sapiens
  chr9:981830-981843
  hyper
gctctttccttgg

SEQ ID NO: 20247 - DNA, 76 bp, Homo sapiens
  chr9:1042326-1042402
  hyper
tggaagggtctgacacggaatctgaccaaggctggaccctcaataattgtgatttcttttcccccttttccttctt

SEQ ID NO: 20248 - DNA, 152 bp, Homo sapiens
  chr9:1052166-1052318
  hyper
aggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 20249 - DNA, 179 bp, Homo sapiens
  chr9:3181573-3181752
  hyper
tcagtcttcgacctccgagacgcccggtgacttctgctggcacctgctgccctcggcatcacctccctcatccccctggagggcacgctggaaagctgcaactccccaccctccgcacaggagcgccccgtagacgcgcagatgggcccagccacccagcggggcggcagccctgagca

SEQ ID NO: 20250 - DNA, 11 bp, Homo sapiens
  chr9:3181869-3181880
  hyper
ctttgcctgag

SEQ ID NO: 20251 - DNA, 30 bp, Homo sapiens; identical to SEQ ID NO: 9829
  chr9:4299034-4299064
  hyper

SEQ ID NO: 20252 - DNA, 58 bp, Homo sapiens; identical to SEQ ID NO: 9830
  chr9:4299348-4299406
  hyper

SEQ ID NO: 20253 - DNA, 30 bp, Homo sapiens; identical to SEQ ID NO: 9831
  chr9:4299642-4299672
  hyper

SEQ ID NO: 20254 - DNA, 94 bp, Homo sapiens; identical to SEQ ID NO: 9832
  chr9:4299969-4300063
  hyper

SEQ ID NO: 20255 - DNA, 41 bp, Homo sapiens
  chr9:6412809-6412850
  hyper
cccctttccaggattatacaagtgcacgccagggtttctta

SEQ ID NO: 20256 - DNA, 31 bp, Homo sapiens
  chr9:6645594-6645625
  hyper
gcctggagcccctttcgctggacagtcggcc

SEQ ID NO: 20257 - DNA, 327 bp, Homo sapiens
  chr9:6645700-6646027
  hyper
ccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctg

SEQ ID NO: 20258 - DNA, 30 bp, Homo sapiens; identical to SEQ ID NO: 9837
  chr9:8857443-8857473
  hyper

SEQ ID NO: 20259 - DNA, 47 bp, Homo sapiens; identical to SEQ ID NO: 9838
  chr9:8858369-8858416
  hyper

SEQ ID NO: 20260 - DNA, 70 bp, Homo sapiens
  chr9:13278748-13278818
  hyper
accggtaccaattagcggctcgcctcggggtccccgcggctaaggcgagaacgcaggaccaggagcattg

SEQ ID NO: 20261 - DNA, 67 bp, Homo sapiens
  chr9:13278864-13278931
  hyper
gcggatggggcgtccgggagcggcccctgcaggggagagcaacaggctcccgcgccctggaggcctg

SEQ ID NO: 20262 - DNA, 32 bp, Homo sapiens; identical to SEQ ID NO: 9840
  chr9:13279717-13279749
  hyper

SEQ ID NO: 20263 - DNA, 207 bp, Homo sapiens
  chr9:14348107-14348314
  hyper
gaaggaaatgtggtgcgccctctggggcgtgaggccgccgcggcccattctacacacctactggcattccgcttttccttactgtgcgccaggggaaggcataattcaattatatcatacaactgcagcgcacccttttccttttttgctttgaggggaattttccaattcccaaataaatacctatggctctaaagccgagttggg

SEQ ID NO: 20264 - DNA, 43 bp, Homo sapiens; identical to SEQ ID NO: 9842
  chr9:16870864-16870907
  hyper

SEQ ID NO: 20265 - DNA, 42 bp, Homo sapiens; identical to SEQ ID NO: 9843
  chr9:17135632-17135674
  hyper

SEQ ID NO: 20266 - DNA, 48 bp, Homo sapiens; identical to SEQ ID NO: 9844
  chr9:17578826-17578874
  hyper

SEQ ID NO: 20267 - DNA, 63 bp, Homo sapiens; identical to SEQ ID NO: 9845
  chr9:17579090-17579153
  hyper

SEQ ID NO: 20268 - DNA, 223 bp, Homo sapiens; identical to SEQ ID NO: 9846
  chr9:17579476-17579699
  hyper

SEQ ID NO: 20269 - DNA, 51 bp, Homo sapiens; identical to SEQ ID NO: 9847
  chr9:17906058-17906109
  hyper

SEQ ID NO: 20270 - DNA, 30 bp, Homo sapiens; identical to SEQ ID NO: 9851
  chr9:19127231-19127261
  hyper

SEQ ID NO: 20271 - DNA, 30 bp, Homo sapiens; identical to SEQ ID NO: 9852
  chr9:19788506-19788536
  hyper

SEQ ID NO: 20272 - DNA, 255 bp, Homo sapiens
  chr9:21031479-21031734
  hyper
gcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttg

SEQ ID NO: 20273 - DNA, 46 bp, Homo sapiens; identical to SEQ ID NO: 9855
  chr9:21396004-21396050
  hyper

SEQ ID NO: 20274 - DNA, 38 bp, Homo sapiens; identical to SEQ ID NO: 9856
  chr9:21396276-21396314
  hyper

SEQ ID NO: 20275 - DNA, 27 bp, Homo sapiens
  chr9:21402590-21402617
  hyper
tccccttccccaagacgtccccgccct

SEQ ID NO: 20276 - DNA, 125 bp, Homo sapiens
  chr9:21403021-21403146
  hyper
gctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 20277 - DNA, 3 bp, Homo sapiens
  chr9:21965757-21965760
  hyper
gaa

SEQ ID NO: 20278 - DNA, 206 bp, Homo sapiens
  chr9:21968475-21968681
  hyper
ggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggc

SEQ ID NO: 20279 - DNA, 19 bp, Homo sapiens
  chr9:21969231-21969250
  hyper
acaaacaaacccaggcgtc

SEQ ID NO: 20280 - DNA, 262 bp, Homo sapiens
  chr9:21974237-21974499
  hyper
catacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttccca

SEQ ID NO: 20281 - DNA, 323 bp, Homo sapiens
  chr9:21974794-21975117
  hyper
ggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagc

SEQ ID NO: 20282 - DNA, 418 bp, Homo sapiens; identical to SEQ ID NO: 3399
  chr9:21975190-21975608
  hyper

SEQ ID NO: 20283 - DNA, 56 bp, Homo sapiens; identical to SEQ ID NO: 9865
  chr9:22447029-22447085
  hyper

SEQ ID NO: 20284 - DNA, 432 bp, Homo sapiens
  chr9:23824129-23824561
  hyper
aaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacac

SEQ ID NO: 20285 - DNA, 39 bp, Homo sapiens; identical to SEQ ID NO: 9868
  chr9:23826326-23826365
  hyper

SEQ ID NO: 20286 - DNA, 15 bp, Homo sapiens
  chr9:23831450-23831465
  hyper
cgggccacggtgaca

SEQ ID NO: 20287 - DNA, 13 bp, Homo sapiens
  chr9:29212294-29212307
  hyper
ctcaccccgccgc

SEQ ID NO: 20288 - DNA, 51 bp, Homo sapiens; identical to SEQ ID NO: 9872
  chr9:29212731-29212782
  hyper

SEQ ID NO: 20289 - DNA, 30 bp, Homo sapiens; identical to SEQ ID NO: 9873
  chr9:29213181-29213211
  hyper

SEQ ID NO: 20290 - DNA, 100 bp, Homo sapiens
  chr9:32783121-32783221
  hyper
cctgccgtcagtcacccggatttgtaactggagaagggtgcgggtcccggagggacatctccagctggcacctaactcctcggatcccggactgggagcc

SEQ ID NO: 20291 - DNA, 87 bp, Homo sapiens
  chr9:32783259-32783346
  hyper
cgaccctggtttccgactccggccactggcagcctcgcgccccagacccttcccgggcacggaagcgggtcaggtcgccctgctcag

SEQ ID NO: 20292 - DNA, 95 bp, Homo sapiens; identical to SEQ ID NO: 9883
  chr9:33523986-33524081
  hyper

SEQ ID NO: 20293 - DNA, 110 bp, Homo sapiens
  chr9:33524499-33524609
  hyper
ctcagttttgggagacgcctgggccaggcgctcctgagctccatggaccaagagtatgcgggtcgggggtaccacattcgggactgggaactgcggaagatccacagggc

SEQ ID NO: 20294 - DNA, 6 bp, Homo sapiens
  chr9:33524687-33524693
  hyper
agacag

SEQ ID NO: 20295 - DNA, 559 bp, Homo sapiens
  chr9:33676801-33677360
  hyper
gctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagagg

SEQ ID NO: 20296 - DNA, 101 bp, Homo sapiens
  chr9:34589156-34589257
  hyper
atttctgcccgagaaagaagccacctttgggcgcgcaaaggccactacgaacctccccaaacccaggaatttttccagaccccgcgcgtgcagctgagggg

SEQ ID NO: 20297 - DNA, 30 bp, Homo sapiens; identical to SEQ ID NO: 9887
  chr9:34590193-34590223
  hyper

SEQ ID NO: 20298 - DNA, 45 bp, Homo sapiens
  chr9:35675494-35675539
  hyper
ggctctaagcttgagcggttcatccttttcatttatacaggggat

SEQ ID NO: 20299 - DNA, 65 bp, Homo sapiens; identical to SEQ ID NO: 9890
  chr9:35728859-35728924
  hyper

SEQ ID NO: 20300 - DNA, 308 bp, Homo sapiens; identical to SEQ ID NO: 9891
  chr9:36037287-36037595
  hyper

SEQ ID NO: 20301 - DNA, 261 bp, Homo sapiens; identical to SEQ ID NO: 9892
  chr9:36258385-36258646
  hyper

SEQ ID NO: 20302 - DNA, 321 bp, Homo sapiens; identical to SEQ ID NO: 9893
  chr9:36258697-36259018
  hyper

SEQ ID NO: 20303 - DNA, 20 bp, Homo sapiens
  chr9:36739980-36740000
  hyper
tgctccggagccagggtaca

SEQ ID NO: 20304 - DNA, 258 bp, Homo sapiens
  chr9:37025306-37025564
  hyper
agacacggacatgctcgccccgggaagctcaccttcactccagccgggtctctgctgcctttgttaaataggggacctgcggctaggaaagctggatcccaggctgttgggatgggggggagcggggtgggaggaccaggcatggggacggctcctagcccgggagcaactccctgacctgaagcccgcagagaccccgagcggcacccgagccgaggctgccgaagcctgtcaccttcctccagcctggctctgcag

SEQ ID NO: 20305 - DNA, 363 bp, Homo sapiens
  chr9:37025783-37026146
  hyper
ggggtgcctgcgtggtaactaattggcttcctctttctttctttctttttcgtttcttatcctctttttttaaaggggagaagccatgagaaaaggcgtcctgcagagaaggacccaatggggtctttaagggtctctgtatgaactggccggctcctaagcagaagctgaactcagaaaccgctacttccttgatttttcaaagccccctcctcaactccaggacgcctttggagccctagccccggtgtcctcgcttagctctcaacctcttcctccacacatacagacacgggtcagggccccactatccctccaagcgccagtctggatcagccccatggctgaaaaaggcgccatcgg

SEQ ID NO: 20306 - DNA, 209 bp, Homo sapiens
  chr9:37026622-37026831
  hyper
aggggctgcccagggcggatagggagcctcgccaccaggccaggcactgtgcgagctgggctcagaaaacactgctggagcttcggggtctctctcagagcctccctgctggagaccgcccggagctgcgcggagaggcgggaaatggtgctagcgcacccgggctaggagcgggtgcccaactccggctggcttccctccctggctgg

SEQ ID NO: 20307 - DNA, 388 bp, Homo sapiens
  chr9:37027412-37027800
  hyper
ttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggcc

SEQ ID NO: 20308 - DNA, 30 bp, Homo sapiens; identical to SEQ ID NO: 9901
  chr9:37028470-37028500
  hyper

SEQ ID NO: 20309 - DNA, 43 bp, Homo sapiens; identical to SEQ ID NO: 9902
  chr9:37029348-37029391
  hyper

SEQ ID NO: 20310 - DNA, 112 bp, Homo sapiens
  chr9:37030655-37030767
  hyper
agttttagtactgaaagacagcccattgagaataatgtgtgagaagccagagacctcgtttcactggggacacaccccctcccggcttccctttccacgcctcccagcgcac

SEQ ID NO: 20311 - DNA, 369 bp, Homo sapiens
  chr9:37034247-37034616
  hyper
tgaaatgattaaggaactaaagagcttctcgccatgtgagatcatgtcctgttctcgccaacatcacaagatgtccccagacacgccgcgcccccagcgcgccgccccacactgccggcccggagcgaggaaagggtaggcgctgcgcggccgggcctgctcagcgcgccagacgtggcggacccggcccggccggagtagagcgggaagccgggagagcagcagtgctgctgccgcgccgccccagacttttataggggttggggggagggaaggaaggcttcagcctgcgccgggcgctagccagcgcacctacgggaaggggcagaccgaagcggagcccgggagcccgggtcttccagccgcacc

SEQ ID NO: 20312 - DNA, 133 bp, Homo sapiens
  chr9:37034731-37034864
  hyper
gaagaaattaactgctcggccaagcaggtgcttttgaaaggggttgcaaaggctggcagtgttgccaggcaccgaggcgacgttccggtttactccgattcacccctagggcggcgcccgaccccagggttcc

SEQ ID NO: 20313 - DNA, 46 bp, Homo sapiens
  chr9:37035734-37035780
  hyper
ggccatctccgagtgctcgactctttccctccgcagcccagcccca

SEQ ID NO: 20314 - DNA, 247 bp, Homo sapiens
  chr9:37036647-37036894
  hyper
cagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatccccca

SEQ ID NO: 20315 - DNA, 218 bp, Homo sapiens
  chr9:37037453-37037671
  hyper
gggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggc

SEQ ID NO: 20316 - DNA, 54 bp, Homo sapiens; identical to SEQ ID NO: 9908
  chr9:38424355-38424409
  hyper

SEQ ID NO: 20317 - DNA, 30 bp, Homo sapiens; identical to SEQ ID NO: 9909
  chr9:38621877-38621907
  hyper

SEQ ID NO: 20318 - DNA, 42 bp, Homo sapiens; identical to SEQ ID NO: 9910
  chr9:38622559-38622601
  hyper

SEQ ID NO: 20319 - DNA, 25 bp, Homo sapiens
  chr9:66458550-66458575
  hyper
gggcggcctcctttccgcccacgct

SEQ ID NO: 20320 - DNA, 34 bp, Homo sapiens; identical to SEQ ID NO: 9912
  chr9:66494123-66494157
  hyper

SEQ ID NO: 20321 - DNA, 78 bp, Homo sapiens; identical to SEQ ID NO: 9914
  chr9:74061681-74061759
  hyper

SEQ ID NO: 20322 - DNA, 51 bp, Homo sapiens
  chr9:74061787-74061838
  hyper
cgccgagcgctctcgctggctcctcgccgcgggtctccctccagcctgcgc

SEQ ID NO: 20323 - DNA, 21 bp, Homo sapiens
  chr9:74062070-74062091
  hyper
atgcgccgcagggtagcgctc

SEQ ID NO: 20324 - DNA, 49 bp, Homo sapiens; identical to SEQ ID NO: 9916
  chr9:74764314-74764363
  hyper

SEQ ID NO: 20325 - DNA, 80 bp, Homo sapiens; identical to SEQ ID NO: 9917
  chr9:77111763-77111843
  hyper

SEQ ID NO: 20326 - DNA, 69 bp, Homo sapiens; identical to SEQ ID NO: 9918
  chr9:77112827-77112896
  hyper

SEQ ID NO: 20327 - DNA, 96 bp, Homo sapiens
  chr9:77112897-77112993
  hyper
aggtaagcgagtctgcgggcaccgaggctccccgagtccggccaactccagccagacggggagatgggggaggggagggcacccagcagaaaggga

SEQ ID NO: 20328 - DNA, 18 bp, Homo sapiens
  chr9:77114851-77114869
  hyper
gcgcggggtggggatggg

SEQ ID NO: 20329 - DNA, 28 bp, Homo sapiens
  chr9:79627370-79627398
  hyper
ggaggccaacagccgcttaggagagccc

SEQ ID NO: 20330 - DNA, 35 bp, Homo sapiens; identical to SEQ ID NO: 9925
  chr9:79628238-79628273
  hyper

SEQ ID NO: 20331 - DNA, 54 bp, Homo sapiens; identical to SEQ ID NO: 9927
  chr9:79631016-79631070
  hyper

SEQ ID NO: 20332 - DNA, 30 bp, Homo sapiens; identical to SEQ ID NO: 9930
  chr9:79632823-79632853
  hyper

SEQ ID NO: 20333 - DNA, 63 bp, Homo sapiens
  chr9:79633334-79633397
  hyper
gtggcccgggtggggcgcagctgcgggaaatgcacccggagctgtgccccctcccggcgaaca

SEQ ID NO: 20334 - DNA, 45 bp, Homo sapiens
  chr9:79637274-79637319
  hyper
aagcttctctctggatatctatgctagccccgtgtgaaggtgttt

SEQ ID NO: 20335 - DNA, 40 bp, Homo sapiens; identical to SEQ ID NO: 9940
  chr9:80263460-80263500
  hyper

SEQ ID NO: 20336 - DNA, 265 bp, Homo sapiens
  chr9:87283038-87283303
  hyper
ttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgt

SEQ ID NO: 20337 - DNA, 30 bp, Homo sapiens; identical to SEQ ID NO: 9944
  chr9:87283616-87283646
  hyper

SEQ ID NO: 20338 - DNA, 30 bp, Homo sapiens; identical to SEQ ID NO: 9945
  chr9:87284009-87284039
  hyper

SEQ ID NO: 20339 - DNA, 151 bp, Homo sapiens
  chr9:87284555-87284706
  hyper
ttgtgtgtgtatgagcgtgtgtgtgtttttggatttcagactaattttctggagtttctgcccctgctctgcgtcagccctcacgtcacttcgccagcagtagcagaggcggcggcggcggctcccggaattgggttggagcaggagcctc

SEQ ID NO: 20340 - DNA, 196 bp, Homo sapiens
  chr9:87284798-87284994
  hyper
cccgggtgagcagcgcagatagtgccctcggtcgcctcggccctcactgtctccccctggggcggcctcggctactccccaggtgggacgtgccgcgccacctgcccgcgccaccggcacccagcggccgtggcggattctgcagcatcattcgggggccccgtcgcggagccaaagccgccggcagtctccgcat

SEQ ID NO: 20341 - DNA, 61 bp, Homo sapiens
  chr9:87285472-87285533
  hyper
ccctgccgcctgccggaacactcttcgctccggaccagctcagcctctgataagctggact

SEQ ID NO: 20342 - DNA, 116 bp, Homo sapiens
  chr9:88137998-88138114
  hyper
gagaactgatgcttagtaagcttaaaagccccagaaaggaagtctgtacaaatccttaatgatccagtcaattgtcgctgcataacaaaccaccccagaaccggtaacttgaaaca

SEQ ID NO: 20343 - DNA, 45 bp, Homo sapiens
  chr9:89560715-89560760
  hyper
ggggcgccaagcggccgccgccgccgctgctcctgcgcccaggcc

SEQ ID NO: 20344 - DNA, 35 bp, Homo sapiens; identical to SEQ ID NO: 9951
  chr9:89560977-89561012
  hyper

SEQ ID NO: 20345 - DNA, 2 bp, Homo sapiens
  chr9:90113746-90113748
  hyper
tg

SEQ ID NO: 20346 - DNA, 52 bp, Homo sapiens
  chr9:91150170-91150222
  hyper
tgctccagccacaggcgaggcctggccaaggtgtgggcgcatctggggcagg

SEQ ID NO: 20347 - DNA, 43 bp, Homo sapiens
  chr9:91606058-91606101
  hyper
cgcccggtttctgcacctggagctcgcccgatgaggacaaggt

SEQ ID NO: 20348 - DNA, 38 bp, Homo sapiens; identical to SEQ ID NO: 9955
  chr9:91606320-91606358
  hyper

SEQ ID NO: 20349 - DNA, 30 bp, Homo sapiens; identical to SEQ ID NO: 9958
  chr9:91849779-91849809
  hyper

SEQ ID NO: 20350 - DNA, 12 bp, Homo sapiens
  chr9:94183858-94183870
  hyper
cagaccccaccg

SEQ ID NO: 20351 - DNA, 30 bp, Homo sapiens; identical to SEQ ID NO: 9960
  chr9:94711494-94711524
  hyper

SEQ ID NO: 20352 - DNA, 120 bp, Homo sapiens; identical to SEQ ID NO: 3429
  chr9:94712294-94712414
  hyper

SEQ ID NO: 20353 - DNA, 70 bp, Homo sapiens; identical to SEQ ID NO: 9962
  chr9:94713007-94713077
  hyper

SEQ ID NO: 20354 - DNA, 263 bp, Homo sapiens
  chr9:95569984-95570247
  hyper
tgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccg

SEQ ID NO: 20355 - DNA, 67 bp, Homo sapiens
  chr9:95570434-95570501
  hyper
ccagacaaggcaaccgaagttcatcctctctgagttgacttcgtgcgggcagcgggccggcgcccag

SEQ ID NO: 20356 - DNA, 73 bp, Homo sapiens
  chr9:95571544-95571617
  hyper
ctcgggagcggtttccggagtccgagctggcgctgagctgcaggcgcgagcctaaaggcttagccggggccca

SEQ ID NO: 20357 - DNA, 171 bp, Homo sapiens
  chr9:95571760-95571931
  hyper
atcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtc

SEQ ID NO: 20358 - DNA, 109 bp, Homo sapiens; identical to SEQ ID NO: 9965
  chr9:95572141-95572250
  hyper

SEQ ID NO: 20359 - DNA, 37 bp, Homo sapiens
  chr9:96588885-96588922
  hyper
tacgggcggaggcaggggcgggcgggggctttcagca

SEQ ID NO: 20360 - DNA, 129 bp, Homo sapiens; identical to SEQ ID NO: 9967
  chr9:96708329-96708458
  hyper

SEQ ID NO: 20361 - DNA, 267 bp, Homo sapiens
  chr9:96710991-96711258
  hyper
ccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccg

SEQ ID NO: 20362 - DNA, 68 bp, Homo sapiens
  chr9:96717466-96717534
  hyper
ggcggcgacggcttggctccggcgcggggcccgcgcggggctctaggccggcccgcagctcggggcgg

SEQ ID NO: 20363 - DNA, 50 bp, Homo sapiens
  chr9:96718149-96718199
  hyper
cccggaaaggtcgggaggaggaggggcaaaggccgcgctcctcagctggg

SEQ ID NO: 20364 - DNA, 16 bp, Homo sapiens
  chr9:98111349-98111365
  hyper
ctaccaggacacatgc

SEQ ID NO: 20365 - DNA, 47 bp, Homo sapiens; identical to SEQ ID NO: 9980
  chr9:98783352-98783399
  hyper

SEQ ID NO: 20366 - DNA, 33 bp, Homo sapiens; identical to SEQ ID NO: 9981
  chr9:98784201-98784234
  hyper

SEQ ID NO: 20367 - DNA, 13 bp, Homo sapiens
  chr9:98790000-98790013
  hyper
cctccaaggcccc

SEQ ID NO: 20368 - DNA, 20 bp, Homo sapiens
  chr9:99639601-99639621
  hyper
aacacccccagatgccgctg

SEQ ID NO: 20369 - DNA, 91 bp, Homo sapiens
  chr9:99639942-99640033
  hyper
gcggtcttgaagcaatttcccggcaaagtcccgggacagcgggaaagaaactggtctccctgcctggggtcgttcccggtggatgtgcctc

SEQ ID NO: 20370 - DNA, 27 bp, Homo sapiens
  chr9:99983988-99984015
  hyper
tcgcgcaggacatcccggaatcgcagg

SEQ ID NO: 20371 - DNA, 110 bp, Homo sapiens
  chr9:100503515-100503625
  hyper
cggaactagaacaggcgggccccactgcctgcagcctgcgaggagacgccagggctgcaagcccccccgccctcctccgcccctgccgggacagtcagccgctaggggat

SEQ ID NO: 20372 - DNA, 103 bp, Homo sapiens
  chr9:100610218-100610321
  hyper
cttgcactccaggcccggggggtgggggggcgggggagaagccttagggagagtggggaggaggccagaggagagctggctgctctctcgtgttgaggttcaa

SEQ ID NO: 20373 - DNA, 38 bp, Homo sapiens; identical to SEQ ID NO: 9993
  chr9:100613747-100613785
  hyper

SEQ ID NO: 20374 - DNA, 7 bp, Homo sapiens
  chr9:100617675-100617682
  hyper
ccttcca

SEQ ID NO: 20375 - DNA, 28 bp, Homo sapiens
  chr9:100620069-100620097
  hyper
ctcgcgcaccggccgggccaggtgggaa

SEQ ID NO: 20376 - DNA, 47 bp, Homo sapiens; identical to SEQ ID NO: 10004
  chr9:101469203-101469250
  hyper

SEQ ID NO: 20377 - DNA, 76 bp, Homo sapiens
  chr9:101469527-101469603
  hyper
ggactccagcagaagcgcccggagagtcccaggaagccaggatcaagcccagcgcctcggccccgttccgcgcgat

SEQ ID NO: 20378 - DNA, 46 bp, Homo sapiens
  chr9:101469796-101469842
  hyper
ctggggcttcaggcagaacccaaaccgagggcgtggggaggggtct

SEQ ID NO: 20379 - DNA, 100 bp, Homo sapiens
  chr9:101470868-101470968
  hyper
gcggcggccggggggcgccccgcgcccagccccaggccccgggcgccagaggcagcagcagcggcagcagcagtagcagtagcaggcgcgcgggcggcgg

SEQ ID NO: 20380 - DNA, 166 bp, Homo sapiens
  chr9:101471071-101471237
  hyper
ggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtg

SEQ ID NO: 20381 - DNA, 47 bp, Homo sapiens; identical to SEQ ID NO: 10008
  chr9:101471465-101471512
  hyper

SEQ ID NO: 20382 - DNA, 84 bp, Homo sapiens
  chr9:101706695-101706779
  hyper
agtgcaggggttatagctgtgaatgggatccctgggcagctggggcggttggagcgttgtctgggcacccgagatgtctgagct

SEQ ID NO: 20383 - DNA, 92 bp, Homo sapiens; identical to SEQ ID NO: 10011
  chr9:102586697-102586789
  hyper

SEQ ID NO: 20384 - DNA, 30 bp, Homo sapiens; identical to SEQ ID NO: 10012
  chr9:103790612-103790642
  hyper

SEQ ID NO: 20385 - DNA, 16 bp, Homo sapiens
  chr9:104248563-104248579
  hyper
cctcagtttcccaccc

SEQ ID NO: 20386 - DNA, 61 bp, Homo sapiens; identical to SEQ ID NO: 10014
  chr9:104500256-104500317
  hyper

SEQ ID NO: 20387 - DNA, 174 bp, Homo sapiens; identical to SEQ ID NO: 10015
  chr9:104500856-104501030
  hyper

SEQ ID NO: 20388 - DNA, 193 bp, Homo sapiens; identical to SEQ ID NO: 10016
  chr9:104501031-104501224
  hyper

SEQ ID NO: 20389 - DNA, 460 bp, Homo sapiens; identical to SEQ ID NO: 10017
  chr9:108418487-108418947
  hyper

SEQ ID NO: 20390 - DNA, 153 bp, Homo sapiens; identical to SEQ ID NO: 10018
  chr9:109623063-109623216
  hyper

SEQ ID NO: 20391 - DNA, 170 bp, Homo sapiens; identical to SEQ ID NO: 10019
  chr9:110227815-110227985
  hyper

SEQ ID NO: 20392 - DNA, 30 bp, Homo sapiens
  chr9:110228602-110228632
  hyper
gccacagccagcgggcgctctggccctcgc

SEQ ID NO: 20393 - DNA, 30 bp, Homo sapiens; identical to SEQ ID NO: 10021
  chr9:111929340-111929370
  hyper

SEQ ID NO: 20394 - DNA, 86 bp, Homo sapiens; identical to SEQ ID NO: 10022
  chr9:112402752-112402838
  hyper

SEQ ID NO: 20395 - DNA, 79 bp, Homo sapiens; identical to SEQ ID NO: 10023
  chr9:112403209-112403288
  hyper

SEQ ID NO: 20396 - DNA, 99 bp, Homo sapiens; identical to SEQ ID NO: 10024
  chr9:112542259-112542358
  hyper

SEQ ID NO: 20397 - DNA, 30 bp, Homo sapiens; identical to SEQ ID NO: 10027
  chr9:113801304-113801334
  hyper

SEQ ID NO: 20398 - DNA, 136 bp, Homo sapiens; identical to SEQ ID NO: 10028
  chr9:114287491-114287627
  hyper

SEQ ID NO: 20399 - DNA, 96 bp, Homo sapiens; identical to SEQ ID NO: 10029
  chr9:114288004-114288100
  hyper

SEQ ID NO: 20400 - DNA, 132 bp, Homo sapiens
  chr9:115653425-115653557
  hyper
tctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 20401 - DNA, 147 bp, Homo sapiens; identical to SEQ ID NO: 10031
  chr9:118916648-118916795
  hyper

SEQ ID NO: 20402 - DNA, 30 bp, Homo sapiens; identical to SEQ ID NO: 10032
  chr9:118917350-118917380
  hyper

SEQ ID NO: 20403 - DNA, 231 bp, Homo sapiens
  chr9:120175564-120175795
  hyper
cggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaa

SEQ ID NO: 20404 - DNA, 30 bp, Homo sapiens; identical to SEQ ID NO: 10034
  chr9:120176040-120176070
  hyper

SEQ ID NO: 20405 - DNA, 42 bp, Homo sapiens
  chr9:120176825-120176867
  hyper
tgcgccccggcagctcgttacgcacaaagagcaggaggcgcg

SEQ ID NO: 20406 - DNA, 424 bp, Homo sapiens
  chr9:120176897-120177321
  hyper
agcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccagga

SEQ ID NO: 20407 - DNA, 95 bp, Homo sapiens; identical to SEQ ID NO: 3457
  chr9:120177898-120177993
  hyper

SEQ ID NO: 20408 - DNA, 30 bp, Homo sapiens; identical to SEQ ID NO: 10037
  chr9:122131178-122131208
  hyper

SEQ ID NO: 20409 - DNA, 42 bp, Homo sapiens
  chr9:122131838-122131880
  hyper
gagggaggagctgaacgccggggttgcttccgaggagtgttt

SEQ ID NO: 20410 - DNA, 36 bp, Homo sapiens; identical to SEQ ID NO: 10040
  chr9:124990570-124990606
  hyper

SEQ ID NO: 20411 - DNA, 710 bp, Homo sapiens; identical to SEQ ID NO: 10041
  chr9:126770648-126771358
  hyper

SEQ ID NO: 20412 - DNA, 35 bp, Homo sapiens
  chr9:126771705-126771740
  hyper
cacgtttcttgagcagcccgcggcaagagttgctg

SEQ ID NO: 20413 - DNA, 286 bp, Homo sapiens; identical to SEQ ID NO: 10043
  chr9:126773494-126773780
  hyper

SEQ ID NO: 20414 - DNA, 51 bp, Homo sapiens; identical to SEQ ID NO: 10044
  chr9:126774198-126774249
  hyper

SEQ ID NO: 20415 - DNA, 30 bp, Homo sapiens; identical to SEQ ID NO: 10050
  chr9:126780564-126780594
  hyper

SEQ ID NO: 20416 - DNA, 30 bp, Homo sapiens; identical to SEQ ID NO: 10052
  chr9:126781276-126781306
  hyper

SEQ ID NO: 20417 - DNA, 133 bp, Homo sapiens; identical to SEQ ID NO: 10054
  chr9:126785171-126785304
  hyper

SEQ ID NO: 20418 - DNA, 41 bp, Homo sapiens
  chr9:127266346-127266387
  hyper
agagagaaacgaggggtgggggattggatcagagactcgga

SEQ ID NO: 20419 - DNA, 54 bp, Homo sapiens
  chr9:127266534-127266588
  hyper
gaggcggaagcgcccagcccgagggtcggggacaggggacgcgcggaaacctgc

SEQ ID NO: 20420 - DNA, 219 bp, Homo sapiens; identical to SEQ ID NO: 10058
  chr9:127266628-127266847
  hyper

SEQ ID NO: 20421 - DNA, 172 bp, Homo sapiens; identical to SEQ ID NO: 10059
  chr9:127266865-127267037
  hyper

SEQ ID NO: 20422 - DNA, 91 bp, Homo sapiens; identical to SEQ ID NO: 10060
  chr9:127267360-127267451
  hyper

SEQ ID NO: 20423 - DNA, 274 bp, Homo sapiens
  chr9:128651926-128652200
  hyper
taaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcg

SEQ ID NO: 20424 - DNA, 18 bp, Homo sapiens
  chr9:128652232-128652250
  hyper
ctgcgccccgctgtagca

SEQ ID NO: 20425 - DNA, 51 bp, Homo sapiens
  chr9:129276667-129276718
  hyper
gggcgcccggctccccggccctcgctgggccctgcgggaacgccccggccg

SEQ ID NO: 20426 - DNA, 83 bp, Homo sapiens
  chr9:129276820-129276903
  hyper
aggctagcccgccgcgcaagtccccgcagcgccccgccggcctcccaccccctgcggcgtccggacctcgtggacctggggtg

SEQ ID NO: 20427 - DNA, 36 bp, Homo sapiens; identical to SEQ ID NO: 10063
  chr9:129372722-129372758
  hyper

SEQ ID NO: 20428 - DNA, 30 bp, Homo sapiens; identical to SEQ ID NO: 10064
  chr9:129373250-129373280
  hyper

SEQ ID NO: 20429 - DNA, 55 bp, Homo sapiens
  chr9:129377159-129377214
  hyper
tagcaatcaccttggcgagcttgggagaggcgcaaggtcacctggggtgggggag

SEQ ID NO: 20430 - DNA, 12 bp, Homo sapiens
  chr9:129377592-129377604
  hyper
ggtgcgaccggg

SEQ ID NO: 20431 - DNA, 15 bp, Homo sapiens
  chr9:129386182-129386197
  hyper
tccaggcccacctct

SEQ ID NO: 20432 - DNA, 4 bp, Homo sapiens
  chr9:129386429-129386433
  hyper
cgcg

SEQ ID NO: 20433 - DNA, 104 bp, Homo sapiens
  chr9:129388200-129388304
  hyper
cgggcgtcggagaagcggccgcgctgttccgggtcactgcaccggctgaaaaaaccaaaagcaaaaccaacacccagaaacgaagcctgcgtgcccccgggggc

SEQ ID NO: 20434 - DNA, 25 bp, Homo sapiens
  chr9:129389192-129389217
  hyper
tcagcccggccgggcccgcagcgtc

SEQ ID NO: 20435 - DNA, 46 bp, Homo sapiens
  chr9:129400940-129400986
  hyper
aaagacctcggggcgcgtggcgcagcggcggctcggagctcccatt

SEQ ID NO: 20436 - DNA, 65 bp, Homo sapiens
  chr9:129445813-129445878
  hyper
gtctagggtcctgtcgcctagctcctgtgaactgcagctcatccttcagccggcatcatcagagc

SEQ ID NO: 20437 - DNA, 189 bp, Homo sapiens
  chr9:130461742-130461931
  hyper
ctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 20438 - DNA, 319 bp, Homo sapiens; identical to SEQ ID NO: 10076
  chr9:131872526-131872845
  hyper

SEQ ID NO: 20439 - DNA, 30 bp, Homo sapiens; identical to SEQ ID NO: 10077
  chr9:131872856-131872886
  hyper

SEQ ID NO: 20440 - DNA, 69 bp, Homo sapiens; identical to SEQ ID NO: 3468
  chr9:132382286-132382355
  hyper

SEQ ID NO: 20441 - DNA, 181 bp, Homo sapiens; identical to SEQ ID NO: 10080
  chr9:132428476-132428657
  hyper

SEQ ID NO: 20442 - DNA, 26 bp, Homo sapiens
  chr9:133308867-133308893
  hyper
ggcgtccccgccaaccgcaccgagct

SEQ ID NO: 20443 - DNA, 32 bp, Homo sapiens
  chr9:133308941-133308973
  hyper
gcgcgcgggccttggcgcggtctacacccgtc

SEQ ID NO: 20444 - DNA, 100 bp, Homo sapiens
  chr9:133534583-133534683
  hyper
gtctttgtacccctgcgtctccgactcggcctttcatctgctccctccacctcggcatcgccttgcctcagtctcccccgacccctgtctcgccccctct

SEQ ID NO: 20445 - DNA, 220 bp, Homo sapiens
  chr9:133534713-133534933
  hyper
caccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcc

SEQ ID NO: 20446 - DNA, 174 bp, Homo sapiens; identical to SEQ ID NO: 10083
  chr9:133535311-133535485
  hyper

SEQ ID NO: 20447 - DNA, 95 bp, Homo sapiens
  chr9:133535839-133535934
  hyper
gaggaggaggcgcgcggagctcccgggaggggggacaaatctctccctccgaggggcgagaacaggagactttcttctaaagttcaaaagaaaga

SEQ ID NO: 20448 - DNA, 126 bp, Homo sapiens
  chr9:133535971-133536097
  hyper
cggacaatgggcttctttctgcgcctctgagggccggcggggcgggcagggcggggacccgtgcgctttggccccgcctgaccgactcgcacccccctcccccgcacccaggcccgggccccagag

SEQ ID NO: 20449 - DNA, 1 bp, Homo sapiens
  chr9:133536344-133536345
  hyper
c

SEQ ID NO: 20450 - DNA, 160 bp, Homo sapiens; identical to SEQ ID NO: 3474
  chr9:133536346-133536506
  hyper

SEQ ID NO: 20451 - DNA, 1 bp, Homo sapiens
  chr9:133536777-133536778
  hyper
t

SEQ ID NO: 20452 - DNA, 112 bp, Homo sapiens
  chr9:133537070-133537182
  hyper
caccttgagactgggcgctacctacgggctcctttttccccgggcgggggtccaggtgggttttgccgctagactagaagcacaaaatgtgagcgcggtggagatttgggcg

SEQ ID NO: 20453 - DNA, 264 bp, Homo sapiens; identical to SEQ ID NO: 10090
  chr9:133537606-133537870
  hyper

SEQ ID NO: 20454 - DNA, 452 bp, Homo sapiens
  chr9:133538728-133539180
  hyper
tttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggg

SEQ ID NO: 20455 - DNA, 37 bp, Homo sapiens; identical to SEQ ID NO: 10093
  chr9:133540453-133540490
  hyper

SEQ ID NO: 20456 - DNA, 273 bp, Homo sapiens
  chr9:133541192-133541465
  hyper
gtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggc

SEQ ID NO: 20457 - DNA, 24 bp, Homo sapiens
  chr9:133541665-133541689
  hyper
attcttaaacttatccggggcaga

SEQ ID NO: 20458 - DNA, 70 bp, Homo sapiens
  chr9:133542337-133542407
  hyper
cccgagcctggagctcaccccgcctctaggctcctcccaacccgtgccgaaaatccgaccctccttcccc

SEQ ID NO: 20459 - DNA, 394 bp, Homo sapiens; identical to SEQ ID NO: 10096
  chr9:134151976-134152370
  hyper

SEQ ID NO: 20460 - DNA, 34 bp, Homo sapiens; identical to SEQ ID NO: 10097
  chr9:135285831-135285865
  hyper

SEQ ID NO: 20461 - DNA, 169 bp, Homo sapiens; identical to SEQ ID NO: 10098
  chr9:135285880-135286049
  hyper

SEQ ID NO: 20462 - DNA, 107 bp, Homo sapiens; identical to SEQ ID NO: 10099
  chr9:135455044-135455151
  hyper

SEQ ID NO: 20463 - DNA, 411 bp, Homo sapiens
  chr9:135455585-135455996
  hyper
agtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgacc

SEQ ID NO: 20464 - DNA, 70 bp, Homo sapiens
  chr9:135456827-135456897
  hyper
ctacatgggaaacaccgagagcccaacagaaatgccgcaaacaacataacttgaattttcttccccacac

SEQ ID NO: 20465 - DNA, 383 bp, Homo sapiens; identical to SEQ ID NO: 10102
  chr9:135456970-135457353
  hyper

SEQ ID NO: 20466 - DNA, 2 bp, Homo sapiens
  chr9:135458597-135458599
  hyper
ag

SEQ ID NO: 20467 - DNA, 39 bp, Homo sapiens
  chr9:135461773-135461812
  hyper
aggagggtgagcattgagcttgttcgattaagtgttttc

SEQ ID NO: 20468 - DNA, 21 bp, Homo sapiens
  chr9:135464918-135464939
  hyper
cggctccggggcctcctcccg

SEQ ID NO: 20469 - DNA, 61 bp, Homo sapiens
  chr9:135465887-135465948
  hyper
ccatctggttcctagcggctcccagacggtcccgagggccggggcgggggtccgtgccgga

SEQ ID NO: 20470 - DNA, 64 bp, Homo sapiens; identical to SEQ ID NO: 10111
  chr9:135646011-135646075
  hyper

SEQ ID NO: 20471 - DNA, 144 bp, Homo sapiens; identical to SEQ ID NO: 3484
  chr9:137533823-137533967
  hyper

SEQ ID NO: 20472 - DNA, 136 bp, Homo sapiens; identical to SEQ ID NO: 10116
  chr9:137534360-137534496
  hyper

SEQ ID NO: 20473 - DNA, 110 bp, Homo sapiens; identical to SEQ ID NO: 10117
  chr9:137979517-137979627
  hyper

SEQ ID NO: 20474 - DNA, 190 bp, Homo sapiens
  chr9:137980288-137980478
  hyper
ctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctggga

SEQ ID NO: 20475 - DNA, 166 bp, Homo sapiens
  chr9:137980714-137980880
  hyper
ccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaa

SEQ ID NO: 20476 - DNA, 50 bp, Homo sapiens
  chr9:137980910-137980960
  hyper
ctctctctttttgctgccaggggtttagtgccctgcgaagagggctccgt

SEQ ID NO: 20477 - DNA, 95 bp, Homo sapiens; identical to SEQ ID NO: 3486
  chr9:138606154-138606249
  hyper

SEQ ID NO: 20478 - DNA, 200 bp, Homo sapiens; identical to SEQ ID NO: 10121
  chr9:138628543-138628743
  hyper

SEQ ID NO: 20479 - DNA, 109 bp, Homo sapiens
  chr9:139024782-139024891
  hyper
cctgttcgtggggtccctggggtgcaggggtggaggacataggagtgtgggggtcgtgggcagacccaggcgggacgctgtgccagtgccgccccgaaggcccagtgcg

SEQ ID NO: 20480 - DNA, 54 bp, Homo sapiens; identical to SEQ ID NO: 10123
  chr9:139025663-139025717
  hyper

SEQ ID NO: 20481 - DNA, 408 bp, Homo sapiens; identical to SEQ ID NO: 10124
  chr9:139084662-139085070
  hyper

SEQ ID NO: 20482 - DNA, 161 bp, Homo sapiens; identical to SEQ ID NO: 10126
  chr9:139085372-139085533
  hyper

SEQ ID NO: 20483 - DNA, 73 bp, Homo sapiens; identical to SEQ ID NO: 10127
  chr9:139089123-139089196
  hyper

SEQ ID NO: 20484 - DNA, 44 bp, Homo sapiens; identical to SEQ ID NO: 10128
  chr9:139089415-139089459
  hyper

SEQ ID NO: 20485 - DNA, 156 bp, Homo sapiens; identical to SEQ ID NO: 10130
  chr9:139090586-139090742
  hyper

SEQ ID NO: 20486 - DNA, 156 bp, Homo sapiens
  chr9:139091369-139091525
  hyper
cccggcctcggcttcctgctgcctacaccgccctagcccaggcccccttagtgagcgcttggggagagaatttccccggacgcccccctgggcgtggcctcagccccatttttttcagaccaggaaaggtgggagcgtcgtcccctcggctgacct

SEQ ID NO: 20487 - DNA, 33 bp, Homo sapiens
  chr9:139093890-139093923
  hyper
cgggggctcctgtgtcagggatggcggggtcgg

SEQ ID NO: 20488 - DNA, 37 bp, Homo sapiens; identical to SEQ ID NO: 10133
  chr9:139094162-139094199
  hyper

SEQ ID NO: 20489 - DNA, 51 bp, Homo sapiens
  chr9:139094654-139094705
  hyper
caggcgcggacgttccggggtcctcgcgcccactcccgcccagatcctcta

SEQ ID NO: 20490 - DNA, 7 bp, Homo sapiens
  chr9:139095014-139095021
  hyper
gccctgg

SEQ ID NO: 20491 - DNA, 55 bp, Homo sapiens
  chr9:139095285-139095340
  hyper
ctgagctggagcacacgccaggagggctaaggttcccgggagaggggtcgagaag

SEQ ID NO: 20492 - DNA, 52 bp, Homo sapiens
  chr9:139096598-139096650
  hyper
gcgtcaggccctccccgccaccctgggatctggaaactcactctctgcagtt

SEQ ID NO: 20493 - DNA, 37 bp, Homo sapiens
  chr9:139097006-139097043
  hyper
cgcccgctgcccgccccgcccgcgcgcccgcccacct

SEQ ID NO: 20494 - DNA, 183 bp, Homo sapiens; identical to SEQ ID NO: 10138
  chr9:139606480-139606663
  hyper

SEQ ID NO: 20495 - DNA, 147 bp, Homo sapiens
  chr9:140033762-140033909
  hyper
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgcc

SEQ ID NO: 20496 - DNA, 65 bp, Homo sapiens
  chr9:140034079-140034144
  hyper
caggccaacaagcggcacggctcctggaagattcagctcaatgccacctccgtcacgcacaagcc

SEQ ID NO: 20497 - DNA, 13 bp, Homo sapiens
  chr9:140050956-140050969
  hyper
tcctgggttctgg

SEQ ID NO: 20498 - DNA, 137 bp, Homo sapiens
  chr9:140051354-140051491
  hyper
ggcccacatcagcgacgccgtgggcgtggtggcccaggccgtgcacgagctcctcgagaaggagaacatcaccgacccgccgcggggctgcgtgggcaacaccaacatctggaagaccgggccgctcttcaagaggt

SEQ ID NO: 20499 - DNA, 40 bp, Homo sapiens; identical to SEQ ID NO: 10147
  chr10:1778568-1778608
  hyper

SEQ ID NO: 20500 - DNA, 239 bp, Homo sapiens; identical to SEQ ID NO: 3493
  chr10:1778844-1779083
  hyper

SEQ ID NO: 20501 - DNA, 29 bp, Homo sapiens
  chr10:1779111-1779140
  hyper
cggagcagccatcccgccagcaccccaaa

SEQ ID NO: 20502 - DNA, 91 bp, Homo sapiens
  chr10:1779744-1779835
  hyper
tatttgctgcagcagcgtctaattagatccaatcacaactgctttctggctctgacatcagcagcagcaccagccgcaccgccgcctggcc

SEQ ID NO: 20503 - DNA, 195 bp, Homo sapiens; identical to SEQ ID NO: 10151
  chr10:1779836-1780031
  hyper

SEQ ID NO: 20504 - DNA, 30 bp, Homo sapiens; identical to SEQ ID NO: 10152
  chr10:3109104-3109134
  hyper

SEQ ID NO: 20505 - DNA, 837 bp, Homo sapiens
  chr10:7451390-7452227
  hyper
caaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaa

SEQ ID NO: 20506 - DNA, 215 bp, Homo sapiens
  chr10:7452777-7452992
  hyper
cggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattcca

SEQ ID NO: 20507 - DNA, 261 bp, Homo sapiens
  chr10:7453052-7453313
  hyper
tttaagattttgtgtgtgtgtgtatgtgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatct

SEQ ID NO: 20508 - DNA, 65 bp, Homo sapiens
  chr10:7453930-7453995
  hyper
gcggaaaagccggtgacgccctggtagcaagaccaagagcttccgaagaacgctgcgcccttaac

SEQ ID NO: 20509 - DNA, 100 bp, Homo sapiens; identical to SEQ ID NO: 10158
  chr10:7454472-7454572
  hyper

SEQ ID NO: 20510 - DNA, 121 bp, Homo sapiens
  chr10:7708669-7708790
  hyper
cggtcgaagggggcccgggcagaagctccgcggccgggccggcggagggaagggggcggccgcgcccgggacccggctcccctcggctccacttacctgctccgaagagtggccccagctc

SEQ ID NO: 20511 - DNA, 124 bp, Homo sapiens; identical to SEQ ID NO: 3501
  chr10:8076053-8076177
  hyper

SEQ ID NO: 20512 - DNA, 99 bp, Homo sapiens
  chr10:8076705-8076804
  hyper
cccgccccaaccctccgcagagaagccgaggaccacatccatccgcttcctaggaacctgcccgcaccagcaggccctgtttcctggacaaactgggca

SEQ ID NO: 20513 - DNA, 254 bp, Homo sapiens
  chr10:8085721-8085975
  hyper
ggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtgg

SEQ ID NO: 20514 - DNA, 81 bp, Homo sapiens; identical to SEQ ID NO: 10167
  chr10:8090494-8090575
  hyper

SEQ ID NO: 20515 - DNA, 37 bp, Homo sapiens
  chr10:8091858-8091895
  hyper
cacggcccggtcctccggcttctctcctttgaacagg

SEQ ID NO: 20516 - DNA, 6 bp, Homo sapiens
  chr10:8093458-8093464
  hyper
aagccc

SEQ ID NO: 20517 - DNA, 6 bp, Homo sapiens
  chr10:8094252-8094258
  hyper
catccc

SEQ ID NO: 20518 - DNA, 72 bp, Homo sapiens; identical to SEQ ID NO: 10173
  chr10:8095387-8095459
  hyper

SEQ ID NO: 20519 - DNA, 111 bp, Homo sapiens
  chr10:8095492-8095603
  hyper
cgcggctcggccacagcctcgcccgctgattggtccctccaggccccgcccccgctcgccccgcccctctcgctggggcgcctcggagccgcgtgccctccgccccggggt

SEQ ID NO: 20520 - DNA, 73 bp, Homo sapiens; identical to SEQ ID NO: 10175
  chr10:8096204-8096277
  hyper

SEQ ID NO: 20521 - DNA, 41 bp, Homo sapiens; identical to SEQ ID NO: 10177
  chr10:8374499-8374540
  hyper

SEQ ID NO: 20522 - DNA, 172 bp, Homo sapiens; identical to SEQ ID NO: 3506
  chr10:11059492-11059664
  hyper

SEQ ID NO: 20523 - DNA, 121 bp, Homo sapiens; identical to SEQ ID NO: 10180
  chr10:11060314-11060435
  hyper

SEQ ID NO: 20524 - DNA, 69 bp, Homo sapiens
  chr10:13043317-13043386
  hyper
ggtcgcacagcatctcgacctcggccgagtagaagaggcccccctggccggcgtggtactgccagggca

SEQ ID NO: 20525 - DNA, 109 bp, Homo sapiens
  chr10:13043425-13043534
  hyper
gcaccctggcgtacacgatggtctcggccagctcggcgcggcagccctcgctcaggggcctccactcggagggcagctggcaggcgcgcgcgggcgctgggggacccgc

SEQ ID NO: 20526 - DNA, 60 bp, Homo sapiens
  chr10:13934183-13934243
  hyper
gggggacccctggctcccccacaaaacccacccaaagccaccgctcgaggccctctccta

SEQ ID NO: 20527 - DNA, 125 bp, Homo sapiens; identical to SEQ ID NO: 10187
  chr10:14215748-14215873
  hyper

SEQ ID NO: 20528 - DNA, 296 bp, Homo sapiens
  chr10:15760996-15761292
  hyper
cgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttct

SEQ ID NO: 20529 - DNA, 183 bp, Homo sapiens
  chr10:15761671-15761854
  hyper
ggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 20530 - DNA, 111 bp, Homo sapiens; identical to SEQ ID NO: 873
  chr10:15761855-15761966
  hyper

SEQ ID NO: 20531 - DNA, 42 bp, Homo sapiens
  chr10:16563909-16563951
  hyper
gcacccaaggcacagaggaaggggagccgctttggcatctca

SEQ ID NO: 20532 - DNA, 116 bp, Homo sapiens
  chr10:17271625-17271741
  hyper
cgcctgcggagcagcgtgcccggggtgcggctcctgcaggactcggtggacttctcgctggccgacgccatcaacaccgagttcaagaacacccgcaccaacgagaaggtggagct

SEQ ID NO: 20533 - DNA, 102 bp, Homo sapiens; identical to SEQ ID NO: 10197
  chr10:17495534-17495636
  hyper

SEQ ID NO: 20534 - DNA, 110 bp, Homo sapiens
  chr10:17496734-17496844
  hyper
cacaccacaactctgcctgcggagagaggagaggagaaaaaggggccgcttcaaaaactttcaaaactgtgcagtcgcttggctggatcctcccacgcatgaagaaagct

SEQ ID NO: 20535 - DNA, 19 bp, Homo sapiens
  chr10:18429774-18429793
  hyper
ccgccgcacaggtagcgag

SEQ ID NO: 20536 - DNA, 55 bp, Homo sapiens; identical to SEQ ID NO: 10200
  chr10:18430183-18430238
  hyper

SEQ ID NO: 20537 - DNA, 33 bp, Homo sapiens; identical to SEQ ID NO: 10201
  chr10:20105577-20105610
  hyper

SEQ ID NO: 20538 - DNA, 30 bp, Homo sapiens; identical to SEQ ID NO: 10202
  chr10:20106628-20106658
  hyper

SEQ ID NO: 20539 - DNA, 59 bp, Homo sapiens; identical to SEQ ID NO: 10203
  chr10:21783695-21783754
  hyper

SEQ ID NO: 20540 - DNA, 108 bp, Homo sapiens
  chr10:21805109-21805217
  hyper
cgttccttatctcagcgaaacaactccccaggctggccgggcagtacaccggagatgctttgggggcccagctctgcagattccactccgccggcgactccgctttga

SEQ ID NO: 20541 - DNA, 21 bp, Homo sapiens
  chr10:21805277-21805298
  hyper
cggcggcggaggccagatggt

SEQ ID NO: 20542 - DNA, 30 bp, Homo sapiens; identical to SEQ ID NO: 10205
  chr10:22518011-22518041
  hyper

SEQ ID NO: 20543 - DNA, 402 bp, Homo sapiens
  chr10:22541236-22541638
  hyper
ctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcg

SEQ ID NO: 20544 - DNA, 125 bp, Homo sapiens
  chr10:22625978-22626103
  hyper
taataacatcgacacaaagaagagctcatggttgcgtctgcgcttggtaacagtggctttcctctgggttagagccacaggcacaagcacccgctgctatctttcttcttcgcctaccatgaata

SEQ ID NO: 20545 - DNA, 77 bp, Homo sapiens
  chr10:22634578-22634655
  hyper
gggcaggtgccctaactagctggcgccgaggagacccgggtgcggtgggctccaccgactctctctcccgcagtgtt

SEQ ID NO: 20546 - DNA, 9 bp, Homo sapiens
  chr10:23216856-23216865
  hyper
tcctcccgc

SEQ ID NO: 20547 - DNA, 185 bp, Homo sapiens
  chr10:23216945-23217130
  hyper
cgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 20548 - DNA, 22 bp, Homo sapiens
  chr10:23462910-23462932
  hyper
catggtccgcaaaagacaggtg

SEQ ID NO: 20549 - DNA, 18 bp, Homo sapiens
  chr10:23481303-23481321
  hyper
gggcactccagggaggcc

SEQ ID NO: 20550 - DNA, 271 bp, Homo sapiens
  chr10:23481515-23481786
  hyper
gtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggc

SEQ ID NO: 20551 - DNA, 149 bp, Homo sapiens
  chr10:23481787-23481936
  hyper
gcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcg

SEQ ID NO: 20552 - DNA, 15 bp, Homo sapiens
  chr10:23482445-23482460
  hyper
cgcgtccccgccaga

SEQ ID NO: 20553 - DNA, 51 bp, Homo sapiens
  chr10:23483777-23483828
  hyper
aaggtaggaagaagccgcccgctacccctgccaccttcgcaacaggcttac

SEQ ID NO: 20554 - DNA, 30 bp, Homo sapiens; identical to SEQ ID NO: 10232
  chr10:23486384-23486414
  hyper

SEQ ID NO: 20555 - DNA, 177 bp, Homo sapiens
  chr10:23487978-23488155
  hyper
gggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtg

SEQ ID NO: 20556 - DNA, 251 bp, Homo sapiens
  chr10:23489158-23489409
  hyper
ttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaa

SEQ ID NO: 20557 - DNA, 51 bp, Homo sapiens
  chr10:23489439-23489490
  hyper
tgctaattacaaattttaaaacaagccacttctaagcgaaggacgcctggc

SEQ ID NO: 20558 - DNA, 55 bp, Homo sapiens; identical to SEQ ID NO: 10235
  chr10:23633401-23633456
  hyper

SEQ ID NO: 20559 - DNA, 44 bp, Homo sapiens
  chr10:23982394-23982438
  hyper
aaaaccgttgccactcgacggtggcaaaattgctggctgcactg

SEQ ID NO: 20560 - DNA, 374 bp, Homo sapiens
  chr10:23982820-23983194
  hyper
ctcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaac

SEQ ID NO: 20561 - DNA, 33 bp, Homo sapiens
  chr10:23983247-23983280
  hyper
tcccccctaaacctctagcgcagctttttaaag

SEQ ID NO: 20562 - DNA, 107 bp, Homo sapiens
  chr10:23983700-23983807
  hyper
gcaagcgggaggcgcactggggccgccgccgttcccgcgctcctccctctcctctgcacccactgtcacgctacccgcccgcgggggagcctcgagagcctccaggt

SEQ ID NO: 20563 - DNA, 240 bp, Homo sapiens; identical to SEQ ID NO: 10239
  chr10:23984535-23984775
  hyper

SEQ ID NO: 20564 - DNA, 82 bp, Homo sapiens
  chr10:23984841-23984923
  hyper
cgacagcgcccgggagcagggtgacccccacagcggccggccttccggctggctgccctccccgctcgccgctctccccgcg

SEQ ID NO: 20565 - DNA, 147 bp, Homo sapiens; identical to SEQ ID NO: 3542
  chr10:25465203-25465350
  hyper

SEQ ID NO: 20566 - DNA, 70 bp, Homo sapiens
  chr10:25465351-25465421
  hyper
cgaacgcttctcaccctcagagtagagacccgggctgagggacaccccacgcgggcgcgggtgcttgggg

SEQ ID NO: 20567 - DNA, 38 bp, Homo sapiens
  chr10:25465517-25465555
  hyper
ccttggcaggacggagacacccccgctgctctgtgctt

SEQ ID NO: 20568 - DNA, 110 bp, Homo sapiens
  chr10:26055841-26055951
  hyper
cctatctgcgcgctgtcaatcatcccccacctgtggatcgcgcagcccagccaaaaaattaattgcttagaaatataaaatcggtggactcagatcggaaaggattagga

SEQ ID NO: 20569 - DNA, 104 bp, Homo sapiens; identical to SEQ ID NO: 10246
  chr10:26223766-26223870
  hyper

SEQ ID NO: 20570 - DNA, 27 bp, Homo sapiens
  chr10:26500592-26500619
  hyper
cctgttgagaattatcgcagatacgtt

SEQ ID NO: 20571 - DNA, 30 bp, Homo sapiens; identical to SEQ ID NO: 10248
  chr10:26501132-26501162
  hyper

SEQ ID NO: 20572 - DNA, 39 bp, Homo sapiens; identical to SEQ ID NO: 10249
  chr10:26501446-26501485
  hyper

SEQ ID NO: 20573 - DNA, 100 bp, Homo sapiens
  chr10:26504014-26504114
  hyper
cccagacgggatccccgggtctctgctttgttagcagctttggtggctggttcaggaggtcagagaaataaaacgacttgtgaacacaatggaaatgaca

SEQ ID NO: 20574 - DNA, 301 bp, Homo sapiens
  chr10:26504190-26504491
  hyper
cgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaa

SEQ ID NO: 20575 - DNA, 20 bp, Homo sapiens
  chr10:26507400-26507420
  hyper
tgcacttacacaccgtctcc

SEQ ID NO: 20576 - DNA, 23 bp, Homo sapiens
  chr10:26727368-26727391
  hyper
ggcgcgcgcggcacaggtagggg

SEQ ID NO: 20577 - DNA, 183 bp, Homo sapiens; identical to SEQ ID NO: 891
  chr10:26727867-26728050
  hyper

SEQ ID NO: 20578 - DNA, 220 bp, Homo sapiens
  chr10:27547726-27547946
  hyper
gcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtc

SEQ ID NO: 20579 - DNA, 173 bp, Homo sapiens; identical to SEQ ID NO: 10263
  chr10:28032490-28032663
  hyper

SEQ ID NO: 20580 - DNA, 123 bp, Homo sapiens; identical to SEQ ID NO: 10267
  chr10:28034396-28034519
  hyper

SEQ ID NO: 20581 - DNA, 136 bp, Homo sapiens
  chr10:28288070-28288206
  hyper
ttcaactttgcatctccctttctcaaacacttttatgcaactcccgagtgtgcaccctaactcactccacgcggtgggaaaggttgactttgacagaggtcgtgagcagttgcggggtcggcggcaagttagcaga

SEQ ID NO: 20582 - DNA, 355 bp, Homo sapiens; identical to SEQ ID NO: 10271
  chr10:28957640-28957995
  hyper

SEQ ID NO: 20583 - DNA, 15 bp, Homo sapiens
  chr10:28958043-28958058
  hyper
cgatctttttggatg

SEQ ID NO: 20584 - DNA, 30 bp, Homo sapiens; identical to SEQ ID NO: 10273
  chr10:28965689-28965719
  hyper

SEQ ID NO: 20585 - DNA, 9 bp, Homo sapiens
  chr10:29011038-29011047
  hyper
agctgttta

SEQ ID NO: 20586 - DNA, 47 bp, Homo sapiens; identical to SEQ ID NO: 10276
  chr10:31608931-31608978
  hyper

SEQ ID NO: 20587 - DNA, 81 bp, Homo sapiens; identical to SEQ ID NO: 10277
  chr10:31609959-31610040
  hyper

SEQ ID NO: 20588 - DNA, 41 bp, Homo sapiens; identical to SEQ ID NO: 10278
  chr10:43248734-43248775
  hyper

SEQ ID NO: 20589 - DNA, 65 bp, Homo sapiens
  chr10:43249944-43250009
  hyper
caggctgaggacctgcgacttggtgggacttcggtgcccgcccctccgccactacagggagcaga

SEQ ID NO: 20590 - DNA, 80 bp, Homo sapiens
  chr10:43250039-43250119
  hyper
accgcgaccggaggagcgcagaacgctcctcccagcgtcctgggctccgcaggcacaatttttaaaccagaggcgaaatc

SEQ ID NO: 20591 - DNA, 15 bp, Homo sapiens
  chr10:43250136-43250151
  hyper
cggggagggagcgtg

SEQ ID NO: 20592 - DNA, 7 bp, Homo sapiens
  chr10:43250886-43250893
  hyper
ggggccc

SEQ ID NO: 20593 - DNA, 78 bp, Homo sapiens; identical to SEQ ID NO: 10283
  chr10:43393565-43393643
  hyper

SEQ ID NO: 20594 - DNA, 58 bp, Homo sapiens
  chr10:43429100-43429158
  hyper
tctgaatggagtgatgcgcctggacttttgttcggaaatcccgcgtggagggcggcct

SEQ ID NO: 20595 - DNA, 15 bp, Homo sapiens
  chr10:43429361-43429376
  hyper
tagcccagctgcagc

SEQ ID NO: 20596 - DNA, 27 bp, Homo sapiens
  chr10:43429411-43429438
  hyper
ccccgacagctgcgcaagtctattcct

SEQ ID NO: 20597 - DNA, 192 bp, Homo sapiens; identical to SEQ ID NO: 10287
  chr10:43571989-43572181
  hyper

SEQ ID NO: 20598 - DNA, 67 bp, Homo sapiens; identical to SEQ ID NO: 10290
  chr10:43724529-43724596
  hyper

SEQ ID NO: 20599 - DNA, 117 bp, Homo sapiens; identical to SEQ ID NO: 10291
  chr10:44185390-44185507
  hyper

SEQ ID NO: 20600 - DNA, 18 bp, Homo sapiens
  chr10:44879926-44879944
  hyper
gcgaactttgcaaagcgc

SEQ ID NO: 20601 - DNA, 78 bp, Homo sapiens; identical to SEQ ID NO: 10293
  chr10:44880377-44880455
  hyper

SEQ ID NO: 20602 - DNA, 110 bp, Homo sapiens
  chr10:44880759-44880869
  hyper
ggctccgctgggccccgcaccgctggcccggtctgcagtgaggtccgcagcctgagcgacgccggctggagggccgcttattgtccctgtgacagggccccactggagag

SEQ ID NO: 20603 - DNA, 33 bp, Homo sapiens
  chr10:44880915-44880948
  hyper
gacggggcctttcgatggcgggaactgaatgag

SEQ ID NO: 20604 - DNA, 52 bp, Homo sapiens
  chr10:49731749-49731801
  hyper
cccggccgtggacttggcggacctgcagccggcgccgcggccagccccgggc

SEQ ID NO: 20605 - DNA, 45 bp, Homo sapiens
  chr10:49732498-49732543
  hyper
cccaggagccgccagggggcgccacggagccggggctgcctccgc

SEQ ID NO: 20606 - DNA, 340 bp, Homo sapiens; identical to SEQ ID NO: 10299
  chr10:50323347-50323687
  hyper

SEQ ID NO: 20607 - DNA, 205 bp, Homo sapiens; identical to SEQ ID NO: 10300
  chr10:50603003-50603208
  hyper

SEQ ID NO: 20608 - DNA, 58 bp, Homo sapiens
  chr10:50603909-50603967
  hyper
ggccaggaaggcagccgagccccaaggcccggcgctcggggcccggcgagtgggtcag

SEQ ID NO: 20609 - DNA, 11 bp, Homo sapiens
  chr10:50604159-50604170
  hyper
tttataatctc

SEQ ID NO: 20610 - DNA, 373 bp, Homo sapiens
  chr10:50605654-50606027
  hyper
gctgggagcccctagagctgatcctcccttagcccaggtcaagagactggctcgcgcgcgctgtctctctccctgtctccctcagagggcccctgctctctggagctcttgacaagagcccgaggctcctcttgccgcctaggtctgccgaaagtcccctcgggttccctcctgccctaggcagcagttccctgcctgtgcgctttgggaacccggtggccgtgaagtgaggtgcggacagcttctgggccgcctcggccaagatgctcaggcgcacctgggggtgtgtgcgggaaccctcagcggcagcagcccagcccggggtgcagtgttggccccagaaaccaatgaggtccaaacgccagtctcagtt

SEQ ID NO: 20611 - DNA, 238 bp, Homo sapiens
  chr10:50606433-50606671
  hyper
gctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcacca

SEQ ID NO: 20612 - DNA, 30 bp, Homo sapiens; identical to SEQ ID NO: 10305
  chr10:50817434-50817464
  hyper

SEQ ID NO: 20613 - DNA, 230 bp, Homo sapiens
  chr10:50818152-50818382
  hyper
cgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcg

SEQ ID NO: 20614 - DNA, 180 bp, Homo sapiens
  chr10:50818432-50818612
  hyper
cctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacgg

SEQ ID NO: 20615 - DNA, 52 bp, Homo sapiens; identical to SEQ ID NO: 10308
  chr10:50822142-50822194
  hyper

SEQ ID NO: 20616 - DNA, 30 bp, Homo sapiens; identical to SEQ ID NO: 10309
  chr10:50887488-50887518
  hyper

SEQ ID NO: 20617 - DNA, 196 bp, Homo sapiens; identical to SEQ ID NO: 10311
  chr10:50969916-50970112
  hyper

SEQ ID NO: 20618 - DNA, 88 bp, Homo sapiens; identical to SEQ ID NO: 10312
  chr10:52177735-52177823
  hyper

SEQ ID NO: 20619 - DNA, 30 bp, Homo sapiens; identical to SEQ ID NO: 10313
  chr10:52178275-52178305
  hyper

SEQ ID NO: 20620 - DNA, 137 bp, Homo sapiens; identical to SEQ ID NO: 10314
  chr10:52750888-52751025
  hyper

SEQ ID NO: 20621 - DNA, 88 bp, Homo sapiens; identical to SEQ ID NO: 10315
  chr10:52833568-52833656
  hyper

SEQ ID NO: 20622 - DNA, 87 bp, Homo sapiens; identical to SEQ ID NO: 10316
  chr10:52834409-52834496
  hyper

SEQ ID NO: 20623 - DNA, 80 bp, Homo sapiens
  chr10:54068446-54068526
  hyper
aagtctgattaagaccgggggtccccaggccgtttgatcttcgctcatcaaagagagtctttaaacaagcttcattttac

SEQ ID NO: 20624 - DNA, 103 bp, Homo sapiens
  chr10:54073162-54073265
  hyper
acgttggaccctgtccgctttggtcccggccactttgatctcacgcgtctgcctaatcaagttcatctaccgccgcgattgccctgattcaaagaacaacatt

SEQ ID NO: 20625 - DNA, 4 bp, Homo sapiens
  chr10:57387425-57387429
  hyper
ctcc

SEQ ID NO: 20626 - DNA, 58 bp, Homo sapiens
  chr10:57388267-57388325
  hyper
gacgtcagcaccagtcgagctcgctgggtgagcgccaggtctccccgccccacggatt

SEQ ID NO: 20627 - DNA, 46 bp, Homo sapiens; identical to SEQ ID NO: 10322
  chr10:57389890-57389936
  hyper

SEQ ID NO: 20628 - DNA, 30 bp, Homo sapiens; identical to SEQ ID NO: 10324
  chr10:57390646-57390676
  hyper

SEQ ID NO: 20629 - DNA, 94 bp, Homo sapiens; identical to SEQ ID NO: 10325
  chr10:57391255-57391349
  hyper

SEQ ID NO: 20630 - DNA, 188 bp, Homo sapiens; identical to SEQ ID NO: 10326
  chr10:60272637-60272825
  hyper

SEQ ID NO: 20631 - DNA, 48 bp, Homo sapiens; identical to SEQ ID NO: 10328
  chr10:60936403-60936451
  hyper

SEQ ID NO: 20632 - DNA, 128 bp, Homo sapiens
  chr10:63212701-63212829
  hyper
gagcaagaggttgagcagcgcaagcagccagtaccgcggctccttcttcacctcggtcactcgccagaccccgaccagcgagtgcagcaggaacagcaaccgagtggccagggcgttaaggaagacca

SEQ ID NO: 20633 - DNA, 92 bp, Homo sapiens; identical to SEQ ID NO: 10332
  chr10:63213120-63213212
  hyper

SEQ ID NO: 20634 - DNA, 250 bp, Homo sapiens; identical to SEQ ID NO: 10333
  chr10:64133867-64134117
  hyper

SEQ ID NO: 20635 - DNA, 354 bp, Homo sapiens; identical to SEQ ID NO: 10334
  chr10:64574714-64575068
  hyper

SEQ ID NO: 20636 - DNA, 399 bp, Homo sapiens
  chr10:64575127-64575526
  hyper
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagc

SEQ ID NO: 20637 - DNA, 156 bp, Homo sapiens
  chr10:64575638-64575794
  hyper
tctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgct

SEQ ID NO: 20638 - DNA, 89 bp, Homo sapiens
  chr10:64578540-64578629
  hyper
cgcttcgctcctctctgcgcacgtgggcggaccggcaggcgggcgagttgcccgggccgccccgcgactggcgctgctgccaaacccgc

SEQ ID NO: 20639 - DNA, 5 bp, Homo sapiens
  chr10:64578651-64578656
  hyper
cgagg

SEQ ID NO: 20640 - DNA, 106 bp, Homo sapiens
  chr10:71328821-71328927
  hyper
gggggtggggtgggatgggggcagggcaccataaatctacctgcttgtgtgccagcgcggcttgactggaaggaggagcaagattcatgtgcggtttttctggaag

SEQ ID NO: 20641 - DNA, 102 bp, Homo sapiens; identical to SEQ ID NO: 10340
  chr10:71331570-71331672
  hyper

SEQ ID NO: 20642 - DNA, 72 bp, Homo sapiens
  chr10:71331980-71332052
  hyper
atgaacccagcctgccgcccccgtggaggcctgggccggccaggggtcagccagggagaagcagaaggaaca

SEQ ID NO: 20643 - DNA, 33 bp, Homo sapiens
  chr10:71333018-71333051
  hyper
gctcagcgggcttctggtcgccaagttcagctg

SEQ ID NO: 20644 - DNA, 57 bp, Homo sapiens; identical to SEQ ID NO: 10343
  chr10:71338223-71338280
  hyper

SEQ ID NO: 20645 - DNA, 49 bp, Homo sapiens; identical to SEQ ID NO: 10344
  chr10:71562537-71562586
  hyper

SEQ ID NO: 20646 - DNA, 51 bp, Homo sapiens; identical to SEQ ID NO: 10345
  chr10:71813722-71813773
  hyper

SEQ ID NO: 20647 - DNA, 43 bp, Homo sapiens
  chr10:72015339-72015382
  hyper
cgagaagagcacagtggtgtagaccctgcgcatgcccttctcg

SEQ ID NO: 20648 - DNA, 15 bp, Homo sapiens
  chr10:72200050-72200065
  hyper
gccccctcccatccc

SEQ ID NO: 20649 - DNA, 216 bp, Homo sapiens
  chr10:72200138-72200354
  hyper
gtctggctggtccccagatgacccttccggagagggtcaccggctgtctgaccccaggcgcgggagcgaagggcccccggcaccaggtcacaaggggcgggcaggcggcaggtcggatcagattagcgtttgtggattgcgccccggccccagggagggccgtctggcccccgcaggcggagggaggcgtgggcggccgcggctgcccaggcggca

SEQ ID NO: 20650 - DNA, 96 bp, Homo sapiens
  chr10:72201285-72201381
  hyper
gctcagcatgtacgccagaggggatggcgacgagggctgcccccgcgtacgcaggagcgcagtggccaccgtcgcagcacccgcctggagtagggc

SEQ ID NO: 20651 - DNA, 49 bp, Homo sapiens; identical to SEQ ID NO: 10351
  chr10:72431989-72432038
  hyper

SEQ ID NO: 20652 - DNA, 56 bp, Homo sapiens; identical to SEQ ID NO: 10352
  chr10:73156679-73156735
  hyper

SEQ ID NO: 20653 - DNA, 135 bp, Homo sapiens; identical to SEQ ID NO: 10353
  chr10:73157113-73157248
  hyper

SEQ ID NO: 20654 - DNA, 30 bp, Homo sapiens; identical to SEQ ID NO: 10354
  chr10:73157660-73157690
  hyper

SEQ ID NO: 20655 - DNA, 72 bp, Homo sapiens; identical to SEQ ID NO: 3574
  chr10:73847720-73847792
  hyper

SEQ ID NO: 20656 - DNA, 14 bp, Homo sapiens
  chr10:73848208-73848222
  hyper
ggtgactggcggag

SEQ ID NO: 20657 - DNA, 15 bp, Homo sapiens
  chr10:75407398-75407413
  hyper
cagattctgcacccc

SEQ ID NO: 20658 - DNA, 93 bp, Homo sapiens
  chr10:75407477-75407570
  hyper
cgtctcctcctttcccggccggaacatctgcttccgggtcccccggcgccgggcctcctgcaggatacccgtgcgggcagctggcacagagat

SEQ ID NO: 20659 - DNA, 30 bp, Homo sapiens; identical to SEQ ID NO: 10359
  chr10:77191554-77191584
  hyper

SEQ ID NO: 20660 - DNA, 235 bp, Homo sapiens
  chr10:79396686-79396921
  hyper
tggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatg

SEQ ID NO: 20661 - DNA, 374 bp, Homo sapiens
  chr10:79397089-79397463
  hyper
atgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaagaggaggaggaggaggaggaggacgcgtctaggctgagatggttcgcgtggatattgctactcattctaagactgctgcctccgccgccgccgccgccgccgctgctgccgccgccgccgccgccaccatttgccatagctagcaacgggcagccggcgcaggggctcgggggagctcctcccgccgccagcgccacccc

SEQ ID NO: 20662 - DNA, 581 bp, Homo sapiens; identical to SEQ ID NO: 10361
  chr10:79398015-79398596
  hyper

SEQ ID NO: 20663 - DNA, 30 bp, Homo sapiens; identical to SEQ ID NO: 10362
  chr10:79470990-79471020
  hyper

SEQ ID NO: 20664 - DNA, 269 bp, Homo sapiens
  chr10:81664598-81664867
  hyper
gcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactggga

SEQ ID NO: 20665 - DNA, 91 bp, Homo sapiens
  chr10:81664899-81664990
  hyper
cggctcatctttgctccccaggagcagcatatttcgcatctgccagaggtgtgcccgggggtcgttgggagagggacggggtgaatccctg

SEQ ID NO: 20666 - DNA, 127 bp, Homo sapiens; identical to SEQ ID NO: 10364
  chr10:81892288-81892415
  hyper

SEQ ID NO: 20667 - DNA, 329 bp, Homo sapiens; identical to SEQ ID NO: 10365
  chr10:82116699-82117028
  hyper

SEQ ID NO: 20668 - DNA, 246 bp, Homo sapiens; identical to SEQ ID NO: 10366
  chr10:83633868-83634114
  hyper

SEQ ID NO: 20669 - DNA, 282 bp, Homo sapiens; identical to SEQ ID NO: 10367
  chr10:83634933-83635215
  hyper

SEQ ID NO: 20670 - DNA, 15 bp, Homo sapiens
  chr10:83635484-83635499
  hyper
ctaccacttccacca

SEQ ID NO: 20671 - DNA, 14 bp, Homo sapiens
  chr10:83635545-83635559
  hyper
gcccaaccggatta

SEQ ID NO: 20672 - DNA, 59 bp, Homo sapiens; identical to SEQ ID NO: 10370
  chr10:83636287-83636346
  hyper

SEQ ID NO: 20673 - DNA, 30 bp, Homo sapiens; identical to SEQ ID NO: 10371
  chr10:85954715-85954745
  hyper

SEQ ID NO: 20674 - DNA, 516 bp, Homo sapiens; identical to SEQ ID NO: 10372
  chr10:88125592-88126108
  hyper

SEQ ID NO: 20675 - DNA, 20 bp, Homo sapiens
  chr10:88126833-88126853
  hyper
agaatggaggagggccggcc

SEQ ID NO: 20676 - DNA, 279 bp, Homo sapiens; identical to SEQ ID NO: 10374
  chr10:88126854-88127133
  hyper

SEQ ID NO: 20677 - DNA, 14 bp, Homo sapiens
  chr10:88127346-88127360
  hyper
ggtgcctgcctcgg

SEQ ID NO: 20678 - DNA, 132 bp, Homo sapiens; identical to SEQ ID NO: 10377
  chr10:88391908-88392040
  hyper

SEQ ID NO: 20679 - DNA, 42 bp, Homo sapiens; identical to SEQ ID NO: 10378
  chr10:90343138-90343180
  hyper

SEQ ID NO: 20680 - DNA, 30 bp, Homo sapiens; identical to SEQ ID NO: 10379
  chr10:90966573-90966603
  hyper

SEQ ID NO: 20681 - DNA, 153 bp, Homo sapiens; identical to SEQ ID NO: 10380
  chr10:90967173-90967326
  hyper

SEQ ID NO: 20682 - DNA, 27 bp, Homo sapiens
  chr10:90967644-90967671
  hyper
gtccccgaacgccggcggtgaccgtca

SEQ ID NO: 20683 - DNA, 116 bp, Homo sapiens
  chr10:90968040-90968156
  hyper
atgtgagttcctgaagcctcccgggaggctattgaaggaccaggtgatgtcgtcactaccctacccttccccttgttggctttgcggggccaacttgcagtcgccctctgccaccg

SEQ ID NO: 20684 - DNA, 87 bp, Homo sapiens; identical to SEQ ID NO: 10382
  chr10:91295259-91295346
  hyper

SEQ ID NO: 20685 - DNA, 145 bp, Homo sapiens; identical to SEQ ID NO: 10383
  chr10:91295347-91295492
  hyper

SEQ ID NO: 20686 - DNA, 154 bp, Homo sapiens
  chr10:91295725-91295879
  hyper
gccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccc

SEQ ID NO: 20687 - DNA, 15 bp, Homo sapiens
  chr10:92617227-92617242
  hyper
ggcattgtccggggg

SEQ ID NO: 20688 - DNA, 58 bp, Homo sapiens
  chr10:92617308-92617366
  hyper
gaccgggtcggcgccaccgtcggggctcaagtcgggcagcccgcgccccacttctggc

SEQ ID NO: 20689 - DNA, 97 bp, Homo sapiens
  chr10:93647119-93647216
  hyper
ggccagtgggaaggtcggacgccgaggggcgaaatcaccccaccggcatcagaccaccgcctccattcagcggaggaatgtgggcgggcagaggacg

SEQ ID NO: 20690 - DNA, 262 bp, Homo sapiens
  chr10:93647300-93647562
  hyper
ggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcac

SEQ ID NO: 20691 - DNA, 2 bp, Homo sapiens
  chr10:93647649-93647651
  hyper
aa

SEQ ID NO: 20692 - DNA, 70 bp, Homo sapiens; identical to SEQ ID NO: 10388
  chr10:94180377-94180447
  hyper

SEQ ID NO: 20693 - DNA, 30 bp, Homo sapiens; identical to SEQ ID NO: 10390
  chr10:94822377-94822407
  hyper

SEQ ID NO: 20694 - DNA, 23 bp, Homo sapiens
  chr10:94828498-94828521
  hyper
gcacgcagcgccacccatctgcc

SEQ ID NO: 20695 - DNA, 66 bp, Homo sapiens
  chr10:94828828-94828894
  hyper
aggggagtgggaatattgcaactcggggacattgcagagacccgacgcacgcggtgggacctgcaa

SEQ ID NO: 20696 - DNA, 53 bp, Homo sapiens; identical to SEQ ID NO: 10393
  chr10:94831830-94831883
  hyper

SEQ ID NO: 20697 - DNA, 92 bp, Homo sapiens; identical to SEQ ID NO: 10394
  chr10:94833030-94833122
  hyper

SEQ ID NO: 20698 - DNA, 380 bp, Homo sapiens
  chr10:94834033-94834413
  hyper
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccagg

SEQ ID NO: 20699 - DNA, 36 bp, Homo sapiens; identical to SEQ ID NO: 10396
  chr10:95361207-95361243
  hyper

SEQ ID NO: 20700 - DNA, 243 bp, Homo sapiens; identical to SEQ ID NO: 10397
  chr10:98945514-98945757
  hyper

SEQ ID NO: 20701 - DNA, 29 bp, Homo sapiens
  chr10:98945992-98946021
  hyper
gggtgtgactcgacccgccaagtcctggc

SEQ ID NO: 20702 - DNA, 76 bp, Homo sapiens; identical to SEQ ID NO: 10399
  chr10:98946094-98946170
  hyper

SEQ ID NO: 20703 - DNA, 71 bp, Homo sapiens
  chr10:99531148-99531219
  hyper
caggccaggggaagccgtaggcctccatgagcggcgcgcagccggcgcgcacggcctcgcacagcgagcgg

SEQ ID NO: 20704 - DNA, 98 bp, Homo sapiens; identical to SEQ ID NO: 10402
  chr10:99531512-99531610
  hyper

SEQ ID NO: 20705 - DNA, 16 bp, Homo sapiens
  chr10:99531863-99531879
  hyper
gccctcagcccctccc

SEQ ID NO: 20706 - DNA, 101 bp, Homo sapiens; identical to SEQ ID NO: 10404
  chr10:99531880-99531981
  hyper

SEQ ID NO: 20707 - DNA, 12 bp, Homo sapiens
  chr10:99789282-99789294
  hyper
cggcagcagcag

SEQ ID NO: 20708 - DNA, 44 bp, Homo sapiens; identical to SEQ ID NO: 10406
  chr10:99789739-99789783
  hyper

SEQ ID NO: 20709 - DNA, 22 bp, Homo sapiens
  chr10:99790318-99790340
  hyper
agccccggtcccgggctggcct

SEQ ID NO: 20710 - DNA, 153 bp, Homo sapiens
  chr10:99790437-99790590
  hyper
cgcggcagctggagccgggggcccggggtggggggcgccggcgcggccaatcgcggccccgagagcccggagagccgggcgtggggagggagcgcctccccgcgctgatttaggagccgggattgcggtggcagcagccggcagccaggctgg

SEQ ID NO: 20711 - DNA, 96 bp, Homo sapiens
  chr10:99790664-99790760
  hyper
gccactgcgtcgcgtaaccttcaggcggcagcgaggcctggcgaggaggggagagggcgcctggctgggcgctgggggccccaggccggagggaag

SEQ ID NO: 20712 - DNA, 30 bp, Homo sapiens
  chr10:99790917-99790947
  hyper
cgtcgccgggccgggccaaagcggccgagc

SEQ ID NO: 20713 - DNA, 16 bp, Homo sapiens
  chr10:99791161-99791177
  hyper
ccgtccccaccagcag

SEQ ID NO: 20714 - DNA, 49 bp, Homo sapiens; identical to SEQ ID NO: 10412
  chr10:100992458-100992507
  hyper

SEQ ID NO: 20715 - DNA, 50 bp, Homo sapiens
  chr10:100993487-100993537
  hyper
tgtaaccagaatggtcgtttggcagaagtctccgggaccgcactccagga

SEQ ID NO: 20716 - DNA, 379 bp, Homo sapiens
  chr10:100994016-100994395
  hyper
cacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgag

SEQ ID NO: 20717 - DNA, 62 bp, Homo sapiens; identical to SEQ ID NO: 10415
  chr10:100994599-100994661
  hyper

SEQ ID NO: 20718 - DNA, 249 bp, Homo sapiens
  chr10:100995797-100996046
  hyper
ttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggta

SEQ ID NO: 20719 - DNA, 53 bp, Homo sapiens
  chr10:101089855-101089908
  hyper
ctgttcagcggcctgcgcctgagcctgctgtcgctggacccggtggagttacg

SEQ ID NO: 20720 - DNA, 11 bp, Homo sapiens
  chr10:101280193-101280204
  hyper
cacataaatca

SEQ ID NO: 20721 - DNA, 253 bp, Homo sapiens; identical to SEQ ID NO: 10421
  chr10:101283181-101283434
  hyper

SEQ ID NO: 20722 - DNA, 111 bp, Homo sapiens
  chr10:101293343-101293454
  hyper
ctttaccctttggctggggccatgcctccgccctggtcaccgacagctccacaaagcgcaggtacctgcaagggagccggggtggagagacaaggacgaggtgaccctgac

SEQ ID NO: 20723 - DNA, 19 bp, Homo sapiens
  chr10:102322260-102322279
  hyper
tggccgcagcccagctcgg

SEQ ID NO: 20724 - DNA, 30 bp, Homo sapiens; identical to SEQ ID NO: 10430
  chr10:102414410-102414440
  hyper

SEQ ID NO: 20725 - DNA, 166 bp, Homo sapiens
  chr10:102419681-102419847
  hyper
aggagaggctcagggagtgggacagagggtatctctctttccccagcgtccacccccagacgcctcctacccccaaccagggaggttagaggggcagatgggagtacgaggcttacacccagctctcctatgccacttcctctccctaagacgtggccttttcccc

SEQ ID NO: 20726 - DNA, 17 bp, Homo sapiens
  chr10:102430682-102430699
  hyper
tactcctgacaggatcg

SEQ ID NO: 20727 - DNA, 37 bp, Homo sapiens
  chr10:102430761-102430798
  hyper
tccaaaggctccgcggccattacgggaaagttagtgt

SEQ ID NO: 20728 - DNA, 39 bp, Homo sapiens; identical to SEQ ID NO: 10433
  chr10:102470136-102470175
  hyper

SEQ ID NO: 20729 - DNA, 30 bp, Homo sapiens; identical to SEQ ID NO: 10434
  chr10:102470378-102470408
  hyper

SEQ ID NO: 20730 - DNA, 197 bp, Homo sapiens; identical to SEQ ID NO: 10435
  chr10:102473519-102473716
  hyper

SEQ ID NO: 20731 - DNA, 97 bp, Homo sapiens
  chr10:102473759-102473856
  hyper
cggaggtgggactggggagcagggcctgggactccgctggtgggggtacacgcaggggcactggcgggggcggggggcgacggcactcagaattgcg

SEQ ID NO: 20732 - DNA, 77 bp, Homo sapiens
  chr10:102473932-102474009
  hyper
ccccactccccatccccttcctggaccccacgtctagggccgctggcggctcctgcgattagcgctccagatgtttg

SEQ ID NO: 20733 - DNA, 50 bp, Homo sapiens; identical to SEQ ID NO: 10437
  chr10:102475641-102475691
  hyper

SEQ ID NO: 20734 - DNA, 41 bp, Homo sapiens; identical to SEQ ID NO: 10438
  chr10:102475904-102475945
  hyper

SEQ ID NO: 20735 - DNA, 30 bp, Homo sapiens; identical to SEQ ID NO: 10439
  chr10:102483765-102483795
  hyper

SEQ ID NO: 20736 - DNA, 60 bp, Homo sapiens; identical to SEQ ID NO: 10441
  chr10:102489604-102489664
  hyper

SEQ ID NO: 20737 - DNA, 15 bp, Homo sapiens
  chr10:102489700-102489715
  hyper
cgccatggacccagg

SEQ ID NO: 20738 - DNA, 16 bp, Homo sapiens
  chr10:102495125-102495141
  hyper
ggctgggctgcggtcc

SEQ ID NO: 20739 - DNA, 51 bp, Homo sapiens; identical to SEQ ID NO: 10444
  chr10:102495142-102495193
  hyper

SEQ ID NO: 20740 - DNA, 15 bp, Homo sapiens
  chr10:102497161-102497176
  hyper
gggcggccgcttacc

SEQ ID NO: 20741 - DNA, 21 bp, Homo sapiens
  chr10:102497252-102497273
  hyper
cgggtgcgggtctcgtgttcc

SEQ ID NO: 20742 - DNA, 58 bp, Homo sapiens
  chr10:102497708-102497766
  hyper
ggggattgaatcagcaactagggcaattgtggtcttcagctatcgctgcctatacccc

SEQ ID NO: 20743 - DNA, 32 bp, Homo sapiens; identical to SEQ ID NO: 10450
  chr10:102498739-102498771
  hyper

SEQ ID NO: 20744 - DNA, 211 bp, Homo sapiens; identical to SEQ ID NO: 10451
  chr10:102498831-102499042
  hyper

SEQ ID NO: 20745 - DNA, 112 bp, Homo sapiens
  chr10:102501247-102501359
  hyper
aggagggggaaaggccgggcaggagccggtcaggcctttctgcggaaggggctggggtgtaagtttcggctccctgggatctgacagccgagggtatgcgccctggggtgcg

SEQ ID NO: 20746 - DNA, 181 bp, Homo sapiens; identical to SEQ ID NO: 10453
  chr10:102501875-102502056
  hyper

SEQ ID NO: 20747 - DNA, 30 bp, Homo sapiens; identical to SEQ ID NO: 10454
  chr10:102502378-102502408
  hyper

SEQ ID NO: 20748 - DNA, 216 bp, Homo sapiens; identical to SEQ ID NO: 10455
  chr10:102504302-102504518
  hyper

SEQ ID NO: 20749 - DNA, 42 bp, Homo sapiens
  chr10:102507467-102507509
  hyper
taagtaatttccaagcgcaggaaagccgcgccgagggcatca

SEQ ID NO: 20750 - DNA, 43 bp, Homo sapiens; identical to SEQ ID NO: 10457
  chr10:102507908-102507951
  hyper

SEQ ID NO: 20751 - DNA, 470 bp, Homo sapiens; identical to SEQ ID NO: 10458
  chr10:102508341-102508811
  hyper

SEQ ID NO: 20752 - DNA, 48 bp, Homo sapiens; identical to SEQ ID NO: 10460
  chr10:102509494-102509542
  hyper

SEQ ID NO: 20753 - DNA, 175 bp, Homo sapiens
  chr10:102589250-102589425
  hyper
gccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaa

SEQ ID NO: 20754 - DNA, 293 bp, Homo sapiens
  chr10:102589493-102589786
  hyper
cgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcc

SEQ ID NO: 20755 - DNA, 237 bp, Homo sapiens
  chr10:102589915-102590152
  hyper
gggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccg

SEQ ID NO: 20756 - DNA, 241 bp, Homo sapiens
  chr10:102891582-102891823
  hyper
tcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccc

SEQ ID NO: 20757 - DNA, 41 bp, Homo sapiens
  chr10:102893583-102893624
  hyper
ctgaggggaggggagcgtgaccattagctcgccttagactg

SEQ ID NO: 20758 - DNA, 206 bp, Homo sapiens
  chr10:102899601-102899807
  hyper
cacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacaggg

SEQ ID NO: 20759 - DNA, 59 bp, Homo sapiens
  chr10:102900575-102900634
  hyper
caggaacccaggcagggatggggtcctagaggccctgtgcagtgcggtgggtggcacac

SEQ ID NO: 20760 - DNA, 40 bp, Homo sapiens; identical to SEQ ID NO: 10469
  chr10:102905699-102905739
  hyper

SEQ ID NO: 20761 - DNA, 125 bp, Homo sapiens; identical to SEQ ID NO: 10470
  chr10:102975199-102975324
  hyper

SEQ ID NO: 20762 - DNA, 25 bp, Homo sapiens
  chr10:102975834-102975859
  hyper
tgcccggctccggaggtcttagcag

SEQ ID NO: 20763 - DNA, 70 bp, Homo sapiens; identical to SEQ ID NO: 10472
  chr10:102976414-102976484
  hyper

SEQ ID NO: 20764 - DNA, 536 bp, Homo sapiens
  chr10:102977412-102977948
  hyper
cagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattg

SEQ ID NO: 20765 - DNA, 280 bp, Homo sapiens; identical to SEQ ID NO: 10474
  chr10:102978742-102979022
  hyper

SEQ ID NO: 20766 - DNA, 224 bp, Homo sapiens; identical to SEQ ID NO: 10475
  chr10:102982567-102982791
  hyper

SEQ ID NO: 20767 - DNA, 30 bp, Homo sapiens; identical to SEQ ID NO: 10476
  chr10:102983002-102983032
  hyper

SEQ ID NO: 20768 - DNA, 316 bp, Homo sapiens
  chr10:102985456-102985772
  hyper
caaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcagg

SEQ ID NO: 20769 - DNA, 571 bp, Homo sapiens
  chr10:102985963-102986534
  hyper
ggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaagga

SEQ ID NO: 20770 - DNA, 256 bp, Homo sapiens; identical to SEQ ID NO: 10482
  chr10:102989238-102989494
  hyper

SEQ ID NO: 20771 - DNA, 329 bp, Homo sapiens; identical to SEQ ID NO: 10483
  chr10:102989968-102990297
  hyper

SEQ ID NO: 20772 - DNA, 90 bp, Homo sapiens
  chr10:102996026-102996116
  hyper
actactgtcggggggcgccgggcgcaggccgggcatggggcctgagcttaggccaggtggaaaggtggaaggacctagtggggacagacg

SEQ ID NO: 20773 - DNA, 81 bp, Homo sapiens
  chr10:102996638-102996719
  hyper
ctgcttcgtcctggccaggactttccttgccctgaagtgaggcgccagggaagctgcagggccctccgccctctctgaact

SEQ ID NO: 20774 - DNA, 142 bp, Homo sapiens; identical to SEQ ID NO: 3618
  chr10:102997086-102997228
  hyper

SEQ ID NO: 20775 - DNA, 48 bp, Homo sapiens
  chr10:102997281-102997329
  hyper
cgccacagccctgtcccctagggagaggcctggactaactttgccgtc

SEQ ID NO: 20776 - DNA, 178 bp, Homo sapiens
  chr10:102997406-102997584
  hyper
ggtgggctggcgattccctagcctcagatggctctgccaccagccagctctgtgatcctgggtaagtctttcaacctctctgagtcttgacgttggtaaaaggcaggagatttagagaaggtgttgggagactaaatcttttcattcgtttgagaaagggagtcgcctgtgttgggac

SEQ ID NO: 20777 - DNA, 220 bp, Homo sapiens
  chr10:102998356-102998576
  hyper
ggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtg

SEQ ID NO: 20778 - DNA, 31 bp, Homo sapiens
  chr10:102998828-102998859
  hyper
aggggtttggaagagccgaattcaagcaccc

SEQ ID NO: 20779 - DNA, 51 bp, Homo sapiens
  chr10:103043924-103043975
  hyper
cggatggagctgttaatgtaagtggagtttctgcaatggtaattaggaggg

SEQ ID NO: 20780 - DNA, 33 bp, Homo sapiens
  chr10:103044366-103044399
  hyper
ggccagacagagttggggcgggaggcgggtata

SEQ ID NO: 20781 - DNA, 36 bp, Homo sapiens; identical to SEQ ID NO: 10491
  chr10:103051231-103051267
  hyper

SEQ ID NO: 20782 - DNA, 553 bp, Homo sapiens; identical to SEQ ID NO: 10492
  chr10:103534896-103535449
  hyper

SEQ ID NO: 20783 - DNA, 81 bp, Homo sapiens
  chr10:103536416-103536497
  hyper
gaatggctgcgcacccggccctcgcgcagtgcgtgccggtgccacccggaccccgctcccctgtttcggccgcgtgccccg

SEQ ID NO: 20784 - DNA, 108 bp, Homo sapiens; identical to SEQ ID NO: 10495
  chr10:103986112-103986220
  hyper

SEQ ID NO: 20785 - DNA, 142 bp, Homo sapiens; identical to SEQ ID NO: 10496
  chr10:104000843-104000985
  hyper

SEQ ID NO: 20786 - DNA, 69 bp, Homo sapiens
  chr10:104170732-104170801
  hyper
ttggagggcccttggcctcccaggtcctgcatgtctggccaggggtttgttttccggctcctgcccgcc

SEQ ID NO: 20787 - DNA, 92 bp, Homo sapiens
  chr10:105036450-105036542
  hyper
gtaactggaaaaacacgacctcgccctcgggaaggctttctgtgcgcctcacctcaggatgagggtgggtgtaggggacacctcccagaaac

SEQ ID NO: 20788 - DNA, 19 bp, Homo sapiens
  chr10:105036864-105036883
  hyper
ccttaaaagccgggcgcac

SEQ ID NO: 20789 - DNA, 330 bp, Homo sapiens
  chr10:105036893-105037223
  hyper
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaac

SEQ ID NO: 20790 - DNA, 86 bp, Homo sapiens; identical to SEQ ID NO: 10504
  chr10:105041683-105041769
  hyper

SEQ ID NO: 20791 - DNA, 139 bp, Homo sapiens
  chr10:106399442-106399581
  hyper
atcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggat

SEQ ID NO: 20792 - DNA, 110 bp, Homo sapiens; identical to SEQ ID NO: 3632
  chr10:106400808-106400918
  hyper

SEQ ID NO: 20793 - DNA, 26 bp, Homo sapiens
  chr10:106402325-106402351
  hyper
agtccagggagcggccctggaaagcc

SEQ ID NO: 20794 - DNA, 92 bp, Homo sapiens
  chr10:106402620-106402712
  hyper
cggtctggcctactccggcattccgaactgggcgcccgactgagcatcgcgcctgcctggcagctgcagcggcccgcagcgcgtgcccggag

SEQ ID NO: 20795 - DNA, 30 bp, Homo sapiens; identical to SEQ ID NO: 10512
  chr10:108923969-108923999
  hyper

SEQ ID NO: 20796 - DNA, 19 bp, Homo sapiens
  chr10:108924382-108924401
  hyper
actccatccaagttgcgcc

SEQ ID NO: 20797 - DNA, 1 bp, Homo sapiens
  chr10:109674853-109674854
  hyper
c

SEQ ID NO: 20798 - DNA, 68 bp, Homo sapiens; identical to SEQ ID NO: 10515
  chr10:109674855-109674923
  hyper

SEQ ID NO: 20799 - DNA, 257 bp, Homo sapiens; identical to SEQ ID NO: 10516
  chr10:110225912-110226169
  hyper

SEQ ID NO: 20800 - DNA, 71 bp, Homo sapiens; identical to SEQ ID NO: 10517
  chr10:110671709-110671780
  hyper

SEQ ID NO: 20801 - DNA, 51 bp, Homo sapiens; identical to SEQ ID NO: 3638
  chr10:111216345-111216396
  hyper

SEQ ID NO: 20802 - DNA, 559 bp, Homo sapiens
  chr10:112403297-112403856
  hyper
tcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtg

SEQ ID NO: 20803 - DNA, 56 bp, Homo sapiens; identical to SEQ ID NO: 10522
  chr10:112404226-112404282
  hyper

SEQ ID NO: 20804 - DNA, 76 bp, Homo sapiens; identical to SEQ ID NO: 10523
  chr10:112431872-112431948
  hyper

SEQ ID NO: 20805 - DNA, 70 bp, Homo sapiens; identical to SEQ ID NO: 10524
  chr10:115804051-115804121
  hyper

SEQ ID NO: 20806 - DNA, 41 bp, Homo sapiens
  chr10:115805014-115805055
  hyper
tcatctactgccgcagccccgacttccgcaaggccttccag

SEQ ID NO: 20807 - DNA, 154 bp, Homo sapiens; identical to SEQ ID NO: 10526
  chr10:116852264-116852418
  hyper

SEQ ID NO: 20808 - DNA, 262 bp, Homo sapiens
  chr10:118032547-118032809
  hyper
aaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaa

SEQ ID NO: 20809 - DNA, 135 bp, Homo sapiens
  chr10:118033542-118033677
  hyper
ttagaaaatttataagctgacctccattttggctgtttcgagagtaaattaacaacaacaaaaaaagcctaacatgtacacagcccttcgccccaacccctgggaccgctggttcccagtcgtgctgctcacccc

SEQ ID NO: 20810 - DNA, 42 bp, Homo sapiens
  chr10:118890938-118890980
  hyper
gatctcagcaaaaagcggagctcaaggctcagggactccgcc

SEQ ID NO: 20811 - DNA, 14 bp, Homo sapiens
  chr10:118894477-118894491
  hyper
ggaatttccggtgg

SEQ ID NO: 20812 - DNA, 89 bp, Homo sapiens
  chr10:118896540-118896629
  hyper
cagctctgggcttgccgaccagaccgtgatccagacgtccccacccccaccctcgagtctccttccctccggagtccgcgcggcggaag

SEQ ID NO: 20813 - DNA, 30 bp, Homo sapiens; identical to SEQ ID NO: 10543
  chr10:118897545-118897575
  hyper

SEQ ID NO: 20814 - DNA, 18 bp, Homo sapiens
  chr10:118897895-118897913
  hyper
tcaggtagcgaacagcgc

SEQ ID NO: 20815 - DNA, 187 bp, Homo sapiens
  chr10:118897968-118898155
  hyper
cgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 20816 - DNA, 209 bp, Homo sapiens
  chr10:118899957-118900166
  hyper
ggggtccctgcagcagatggggcattcacttccctgcagagctcggcccgagggagctcctgggcctccttgggcagggaggggtgcgaccgaattccctggcacaccggcccttccttgccccctaccctggaggggttggaggggtcggaccctcggactacgcgagatcgggtgcgcaggaggattctaggccttcctcagccctt

SEQ ID NO: 20817 - DNA, 353 bp, Homo sapiens
  chr10:118922208-118922561
  hyper
tctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtc

SEQ ID NO: 20818 - DNA, 75 bp, Homo sapiens
  chr10:118923063-118923138
  hyper
gcggagaaccctctccgagctggggtccccgcctgctgggcaacctcacctcaacgtctggcctggcctggggcc

SEQ ID NO: 20819 - DNA, 46 bp, Homo sapiens
  chr10:118923259-118923305
  hyper
ggacagcccaagctgtcccgcccgctgcgcccgaggagcatcccct

SEQ ID NO: 20820 - DNA, 173 bp, Homo sapiens
  chr10:118924431-118924604
  hyper
tttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatc

SEQ ID NO: 20821 - DNA, 480 bp, Homo sapiens; identical to SEQ ID NO: 10551
  chr10:118925062-118925542
  hyper

SEQ ID NO: 20822 - DNA, 86 bp, Homo sapiens; identical to SEQ ID NO: 10552
  chr10:118925816-118925902
  hyper

SEQ ID NO: 20823 - DNA, 60 bp, Homo sapiens
  chr10:118927026-118927086
  hyper
ttcggtttccattcacgctaccctctctgagccgcaattctctctcctgcgttggcactg

SEQ ID NO: 20824 - DNA, 267 bp, Homo sapiens
  chr10:118927296-118927563
  hyper
cctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggc

SEQ ID NO: 20825 - DNA, 30 bp, Homo sapiens; identical to SEQ ID NO: 10554
  chr10:118928412-118928442
  hyper

SEQ ID NO: 20826 - DNA, 113 bp, Homo sapiens; identical to SEQ ID NO: 10555
  chr10:119000479-119000592
  hyper

SEQ ID NO: 20827 - DNA, 200 bp, Homo sapiens; identical to SEQ ID NO: 3656
  chr10:119001328-119001528
  hyper

SEQ ID NO: 20828 - DNA, 83 bp, Homo sapiens; identical to SEQ ID NO: 10561
  chr10:119297144-119297227
  hyper

SEQ ID NO: 20829 - DNA, 115 bp, Homo sapiens
  chr10:119297529-119297644
  hyper
aagggctcgcccttcacgggcgtcggtgcggtccgcggcgagccgcgggagcacagggcgggctcagcattctggttcaacgtgaggaccagaacctcggcgatcagggaccagg

SEQ ID NO: 20830 - DNA, 81 bp, Homo sapiens; identical to SEQ ID NO: 10563
  chr10:119300926-119301007
  hyper

SEQ ID NO: 20831 - DNA, 42 bp, Homo sapiens
  chr10:119301323-119301365
  hyper
ctagagaccgtggggcgagagagggagagagttggaagccca

SEQ ID NO: 20832 - DNA, 53 bp, Homo sapiens
  chr10:119302909-119302962
  hyper
aaatccgttcctcaacggcttccactcggccgccgccgccgccgccggtaggg

SEQ ID NO: 20833 - DNA, 409 bp, Homo sapiens; identical to SEQ ID NO: 10566
  chr10:119303312-119303721
  hyper

SEQ ID NO: 20834 - DNA, 37 bp, Homo sapiens; identical to SEQ ID NO: 10567
  chr10:119304504-119304541
  hyper

SEQ ID NO: 20835 - DNA, 33 bp, Homo sapiens; identical to SEQ ID NO: 10571
  chr10:119494374-119494407
  hyper

SEQ ID NO: 20836 - DNA, 15 bp, Homo sapiens
  chr10:119494848-119494863
  hyper
cgggagaagttcagg

SEQ ID NO: 20837 - DNA, 85 bp, Homo sapiens; identical to SEQ ID NO: 10575
  chr10:121301528-121301613
  hyper

SEQ ID NO: 20838 - DNA, 112 bp, Homo sapiens; identical to SEQ ID NO: 10576
  chr10:122216112-122216224
  hyper

SEQ ID NO: 20839 - DNA, 232 bp, Homo sapiens; identical to SEQ ID NO: 10577
  chr10:122216525-122216757
  hyper

SEQ ID NO: 20840 - DNA, 42 bp, Homo sapiens; identical to SEQ ID NO: 10578
  chr10:122216793-122216835
  hyper

SEQ ID NO: 20841 - DNA, 34 bp, Homo sapiens; identical to SEQ ID NO: 10579
  chr10:122217317-122217351
  hyper

SEQ ID NO: 20842 - DNA, 30 bp, Homo sapiens; identical to SEQ ID NO: 10581
  chr10:123356872-123356902
  hyper

SEQ ID NO: 20843 - DNA, 35 bp, Homo sapiens; identical to SEQ ID NO: 10583
  chr10:124221715-124221750
  hyper

SEQ ID NO: 20844 - DNA, 41 bp, Homo sapiens
  chr10:124893594-124893635
  hyper
agcaaaaatggggttcgctgctgtagatgaatgcagaaaga

SEQ ID NO: 20845 - DNA, 200 bp, Homo sapiens
  chr10:124893765-124893965
  hyper
cgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtct

SEQ ID NO: 20846 - DNA, 128 bp, Homo sapiens
  chr10:124894479-124894607
  hyper
gaagacgcagtgcgaggacttacacctggattcccttactatcggctggatggtgggtggggaacccaaatccctctcttcttggcctcgcccttcctagcaggctttaggaaaaataccgaggtcgc

SEQ ID NO: 20847 - DNA, 19 bp, Homo sapiens
  chr10:124894870-124894889
  hyper
gggctcgcggccgttagtg

SEQ ID NO: 20848 - DNA, 265 bp, Homo sapiens
  chr10:124895161-124895426
  hyper
ccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttgg

SEQ ID NO: 20849 - DNA, 33 bp, Homo sapiens
  chr10:124899116-124899149
  hyper
tctcccctgtactttccgcggcctgaaacgccc

SEQ ID NO: 20850 - DNA, 69 bp, Homo sapiens
  chr10:124903238-124903307
  hyper
atccctttgggtttaggcctgggagaggtatagagccagcgagagagcgcgttgcgcctatcactgagg

SEQ ID NO: 20851 - DNA, 46 bp, Homo sapiens
  chr10:124905119-124905165
  hyper
tcactgtttcagggcctgggagttgcttttccgaggcccacttcga

SEQ ID NO: 20852 - DNA, 19 bp, Homo sapiens
  chr10:124907293-124907312
  hyper
cgtcgcctgcggaggcgtc

SEQ ID NO: 20853 - DNA, 55 bp, Homo sapiens
  chr10:124907534-124907589
  hyper
ttttccggggccgctcggcggcgctgcgattggccgcgttcgggtaacctctatg

SEQ ID NO: 20854 - DNA, 112 bp, Homo sapiens
  chr10:124907979-124908091
  hyper
gcccctcggaggcaccgcgggagcccgtcggctggccagccaggaagcgcagcctgtccgtgtcctcggaggaggaggagccggacgacggctggaaggcgcccgcctgctt

SEQ ID NO: 20855 - DNA, 174 bp, Homo sapiens
  chr10:124908121-124908295
  hyper
gggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggag

SEQ ID NO: 20856 - DNA, 145 bp, Homo sapiens; identical to SEQ ID NO: 10603
  chr10:125425698-125425843
  hyper

SEQ ID NO: 20857 - DNA, 88 bp, Homo sapiens; identical to SEQ ID NO: 3676
  chr10:125651372-125651460
  hyper

SEQ ID NO: 20858 - DNA, 155 bp, Homo sapiens
  chr10:125851173-125851328
  hyper
tcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaaga

SEQ ID NO: 20859 - DNA, 50 bp, Homo sapiens
  chr10:126135877-126135927
  hyper
cgcggcgggcaggggtgcgctgacacccgcgcacctgcacccccggtgga

SEQ ID NO: 20860 - DNA, 36 bp, Homo sapiens; identical to SEQ ID NO: 10610
  chr10:126137640-126137676
  hyper

SEQ ID NO: 20861 - DNA, 698 bp, Homo sapiens; identical to SEQ ID NO: 10611
  chr10:126138211-126138909
  hyper

SEQ ID NO: 20862 - DNA, 70 bp, Homo sapiens; identical to SEQ ID NO: 10612
  chr10:128075707-128075777
  hyper

SEQ ID NO: 20863 - DNA, 46 bp, Homo sapiens; identical to SEQ ID NO: 10613
  chr10:128075978-128076024
  hyper

SEQ ID NO: 20864 - DNA, 128 bp, Homo sapiens; identical to SEQ ID NO: 10614
  chr10:128076940-128077068
  hyper

SEQ ID NO: 20865 - DNA, 17 bp, Homo sapiens
  chr10:128993505-128993522
  hyper
cgaccccgggctgcccg

SEQ ID NO: 20866 - DNA, 41 bp, Homo sapiens; identical to SEQ ID NO: 10616
  chr10:128993580-128993621
  hyper

SEQ ID NO: 20867 - DNA, 95 bp, Homo sapiens
  chr10:129948016-129948111
  hyper
accgtcagctgccgccgacggagcccacagaggaggctcgggcgcccgcgccccctgcgcagcggcccctccgcagcggccccagcccgcgtccc

SEQ ID NO: 20868 - DNA, 116 bp, Homo sapiens; identical to SEQ ID NO: 10623
  chr10:130008498-130008614
  hyper

SEQ ID NO: 20869 - DNA, 61 bp, Homo sapiens; identical to SEQ ID NO: 10624
  chr10:130008816-130008877
  hyper

SEQ ID NO: 20870 - DNA, 73 bp, Homo sapiens; identical to SEQ ID NO: 10625
  chr10:130008906-130008979
  hyper

SEQ ID NO: 20871 - DNA, 146 bp, Homo sapiens; identical to SEQ ID NO: 946
  chr10:130085053-130085199
  hyper

SEQ ID NO: 20872 - DNA, 76 bp, Homo sapiens; identical to SEQ ID NO: 947
  chr10:130085200-130085276
  hyper

SEQ ID NO: 20873 - DNA, 47 bp, Homo sapiens
  chr10:130085362-130085409
  hyper
gtccccgggccgcggcgcgctccccgccacgccgcacatcaaggccc

SEQ ID NO: 20874 - DNA, 30 bp, Homo sapiens; identical to SEQ ID NO: 10630
  chr10:130339734-130339764
  hyper

SEQ ID NO: 20875 - DNA, 127 bp, Homo sapiens
  chr10:131761725-131761852
  hyper
tggatttccggaggttggaaggcggctgcttctcgaagtgcgcccgcgccagccccacgccgctgcgggaggaaagagacagcggcccggtgaggagcgcggcgccggccggcggagggggccgggc

SEQ ID NO: 20876 - DNA, 42 bp, Homo sapiens
  chr10:131762124-131762166
  hyper
ccctcgccctgctcggcgcctgcggtccggccccgccgccgg

SEQ ID NO: 20877 - DNA, 265 bp, Homo sapiens
  chr10:131762639-131762904
  hyper
cctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaa

SEQ ID NO: 20878 - DNA, 397 bp, Homo sapiens
  chr10:131762940-131763337
  hyper
ggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 20879 - DNA, 37 bp, Homo sapiens
  chr10:131769496-131769533
  hyper
aagaaagaaagaaaccggcttctcttctagactatta

SEQ ID NO: 20880 - DNA, 39 bp, Homo sapiens
  chr10:131770237-131770276
  hyper
atgaaacactgattgctagttatgcggacttttaagcac

SEQ ID NO: 20881 - DNA, 54 bp, Homo sapiens
  chr10:131770603-131770657
  hyper
tgcttcctgcgttgtcgtccaggcatctaggcgcttcgaccttccccatccctc

SEQ ID NO: 20882 - DNA, 301 bp, Homo sapiens
  chr10:131770687-131770988
  hyper
aagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgc

SEQ ID NO: 20883 - DNA, 21 bp, Homo sapiens
  chr10:131771281-131771302
  hyper
gggagagcccacgggcccggc

SEQ ID NO: 20884 - DNA, 121 bp, Homo sapiens; identical to SEQ ID NO: 3684
  chr10:133110064-133110185
  hyper

SEQ ID NO: 20885 - DNA, 139 bp, Homo sapiens
  chr10:133110704-133110843
  hyper
ggggcaggaccacccctctgtgaattcgtcctggatgcccccaggcacagtctgtactcctccctcccccagcacacgcggcctctgacgctgcacgccgagcttcctgggacccaggacgaaccgggctccaaggacc

SEQ ID NO: 20886 - DNA, 252 bp, Homo sapiens
  chr10:133795430-133795682
  hyper
cggagccccgcagcccggccggaggaactcacagggcagggcggggccgggcggatctgcggccgcgtcgcccattggccgcgacttggggcctgcgcgtgcgcaggggcgtggggtgcgtgtggcacgtgcggcgcgtgcgcggggcgggtcctgcggtgggcgaggggcagaggcctgcggtgcgcgggacgcgggcggggagaggggcggggcgaggggcgcgcaggcgcgagggcggcagcgaccgcc

SEQ ID NO: 20887 - DNA, 127 bp, Homo sapiens
  chr10:133850008-133850135
  hyper
gagcttgcacagcggctccgcggagaccgggactgcgtgggggaggatcgcggcgggggccgtcgccgagcaaggagcgcggccgcggggaccgcccgggagtgggggcggcggggcgggccgggtt

SEQ ID NO: 20888 - DNA, 137 bp, Homo sapiens; identical to SEQ ID NO: 10644
  chr10:133850156-133850293
  hyper

SEQ ID NO: 20889 - DNA, 1 bp, Homo sapiens
  chr10:133850528-133850529
  hyper
c

SEQ ID NO: 20890 - DNA, 48 bp, Homo sapiens
  chr10:133850774-133850822
  hyper
ttgcctctcgtggaaagccgctgggagttggagcggctccctcctgcc

SEQ ID NO: 20891 - DNA, 127 bp, Homo sapiens; identical to SEQ ID NO: 10646
  chr10:134000613-134000740
  hyper

SEQ ID NO: 20892 - DNA, 59 bp, Homo sapiens; identical to SEQ ID NO: 10647
  chr10:134000798-134000857
  hyper

SEQ ID NO: 20893 - DNA, 157 bp, Homo sapiens; identical to SEQ ID NO: 10649
  chr10:134120760-134120917
  hyper

SEQ ID NO: 20894 - DNA, 30 bp, Homo sapiens; identical to SEQ ID NO: 10650
  chr10:134122245-134122275
  hyper

SEQ ID NO: 20895 - DNA, 30 bp, Homo sapiens
  chr10:134599482-134599512
  hyper
tccgggccccgccgccgccgcccctgcccg

SEQ ID NO: 20896 - DNA, 30 bp, Homo sapiens; identical to SEQ ID NO: 10652
  chr10:134599761-134599791
  hyper

SEQ ID NO: 20897 - DNA, 30 bp, Homo sapiens; identical to SEQ ID NO: 10655
  chr10:134602360-134602390
  hyper

SEQ ID NO: 20898 - DNA, 65 bp, Homo sapiens; identical to SEQ ID NO: 10656
  chr10:134676528-134676593
  hyper

SEQ ID NO: 20899 - DNA, 10 bp, Homo sapiens
  chr10:134901183-134901193
  hyper
ggaataacac

SEQ ID NO: 20900 - DNA, 42 bp, Homo sapiens; identical to SEQ ID NO: 10659
  chr10:134974307-134974349
  hyper

SEQ ID NO: 20901 - DNA, 88 bp, Homo sapiens
  chr10:135043538-135043626
  hyper
aactcctgaggaccctccgtttccaaccgaagccagtctttgctctgcgtcttcccggccgcagcgccaggaccgaccccttaggacc

SEQ ID NO: 20902 - DNA, 142 bp, Homo sapiens
  chr10:135043826-135043968
  hyper
cgccccccgcgccgccctcgcccgccagccccgaccccgagccgcggacacccggagacgccccggggaccccgccccggaggcccgcctcgcccagcgcgctgggggaactcgggttgccggtgtccccgggctcggcgca

SEQ ID NO: 20903 - DNA, 101 bp, Homo sapiens
  chr10:135044573-135044674
  hyper
cggctccccgccagctcccgccccgaccgccctcgccacctgcatccccgaggaccgcgcgcccgtccgcggccccgggtccccgccgccacccccggccc

SEQ ID NO: 20904 - DNA, 218 bp, Homo sapiens
  chr10:135048939-135049157
  hyper
gggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggag

SEQ ID NO: 20905 - DNA, 56 bp, Homo sapiens; identical to SEQ ID NO: 10664
  chr10:135049727-135049783
  hyper

SEQ ID NO: 20906 - DNA, 43 bp, Homo sapiens
  chr10:135050679-135050722
  hyper
gggatggagtcagggagccgcccgcgcccgaatgcagaggctc

SEQ ID NO: 20907 - DNA, 574 bp, Homo sapiens
  chr10:135138981-135139555
  hyper
ggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggat

SEQ ID NO: 20908 - DNA, 100 bp, Homo sapiens; identical to SEQ ID NO: 10667
  chr10:135148986-135149086
  hyper

SEQ ID NO: 20909 - DNA, 30 bp, Homo sapiens; identical to SEQ ID NO: 10668
  chr11:308110-308140
  hyper

SEQ ID NO: 20910 - DNA, 103 bp, Homo sapiens
  chr11:406939-407042
  hyper
aaggtgatgaagatgggtctgcgggtgagctccagcagccggcacaggccctccctgcggggcgggaccgtcaggggggtgggtgctacgctggggcccaccc

SEQ ID NO: 20911 - DNA, 26 bp, Homo sapiens
  chr11:407401-407427
  hyper
gcacggggtggggcccgggataccag

SEQ ID NO: 20912 - DNA, 26 bp, Homo sapiens
  chr11:637441-637467
  hyper
cgcggtgctcgcggggaactcgctcg

SEQ ID NO: 20913 - DNA, 101 bp, Homo sapiens
  chr11:726316-726417
  hyper
catggacgaggtcaacgacgagctcatccggaaaatcagcaacatcagggcgcagccacagaggcacttccgcgtggagcgcagccagcccgtgagccagc

SEQ ID NO: 20914 - DNA, 138 bp, Homo sapiens; identical to SEQ ID NO: 10674
  chr11:1410132-1410270
  hyper

SEQ ID NO: 20915 - DNA, 34 bp, Homo sapiens; identical to SEQ ID NO: 10675
  chr11:1411655-1411689
  hyper

SEQ ID NO: 20916 - DNA, 30 bp, Homo sapiens; identical to SEQ ID NO: 10676
  chr11:1412279-1412309
  hyper

SEQ ID NO: 20917 - DNA, 379 bp, Homo sapiens; identical to SEQ ID NO: 10677
  chr11:1770262-1770641
  hyper

SEQ ID NO: 20918 - DNA, 81 bp, Homo sapiens
  chr11:2292636-2292717
  hyper
ggggtgggaggttcaggttcccggggcgccttccccaacccgccccgctttccccgtccctccacgcgcaccctgcctgtg

SEQ ID NO: 20919 - DNA, 86 bp, Homo sapiens; identical to SEQ ID NO: 10682
  chr11:2883674-2883760
  hyper

SEQ ID NO: 20920 - DNA, 156 bp, Homo sapiens; identical to SEQ ID NO: 10683
  chr11:6280445-6280601
  hyper

SEQ ID NO: 20921 - DNA, 51 bp, Homo sapiens; identical to SEQ ID NO: 10684
  chr11:6281269-6281320
  hyper

SEQ ID NO: 20922 - DNA, 104 bp, Homo sapiens; identical to SEQ ID NO: 10685
  chr11:6676726-6676830
  hyper

SEQ ID NO: 20923 - DNA, 84 bp, Homo sapiens; identical to SEQ ID NO: 10686
  chr11:6677244-6677328
  hyper

SEQ ID NO: 20924 - DNA, 614 bp, Homo sapiens; identical to SEQ ID NO: 10687
  chr11:6947606-6948220
  hyper

SEQ ID NO: 20925 - DNA, 30 bp, Homo sapiens; identical to SEQ ID NO: 10688
  chr11:7273118-7273148
  hyper

SEQ ID NO: 20926 - DNA, 3 bp, Homo sapiens
  chr11:7274245-7274248
  hyper
gtg

SEQ ID NO: 20927 - DNA, 38 bp, Homo sapiens; identical to SEQ ID NO: 10690
  chr11:8040298-8040336
  hyper

SEQ ID NO: 20928 - DNA, 6 bp, Homo sapiens
  chr11:8040770-8040776
  hyper
cgggcc

SEQ ID NO: 20929 - DNA, 67 bp, Homo sapiens; identical to SEQ ID NO: 10692
  chr11:8041504-8041571
  hyper

SEQ ID NO: 20930 - DNA, 344 bp, Homo sapiens; identical to SEQ ID NO: 10693
  chr11:8102616-8102960
  hyper

SEQ ID NO: 20931 - DNA, 41 bp, Homo sapiens
  chr11:8189946-8189987
  hyper
gttgaaaaaacataacgacttaaggtttgctgtaccaattc

SEQ ID NO: 20932 - DNA, 35 bp, Homo sapiens; identical to SEQ ID NO: 10695
  chr11:8284256-8284291
  hyper

SEQ ID NO: 20933 - DNA, 39 bp, Homo sapiens; identical to SEQ ID NO: 10697
  chr11:8284896-8284935
  hyper

SEQ ID NO: 20934 - DNA, 27 bp, Homo sapiens
  chr11:8289745-8289772
  hyper
tcccgccgccgccgaagcccgggcgct

SEQ ID NO: 20935 - DNA, 138 bp, Homo sapiens
  chr11:8290057-8290195
  hyper
cgccgccggccgcctgcgctgctcccgccggccccgcgcgggcgccgagtccggagagccgcgaccgccgacgggggcagacggaccggagtccggagcgcagccccgcgggcagggagcgcaggaggagggactggg

SEQ ID NO: 20936 - DNA, 30 bp, Homo sapiens; identical to SEQ ID NO: 10700
  chr11:8615288-8615318
  hyper

SEQ ID NO: 20937 - DNA, 890 bp, Homo sapiens
  chr11:9025080-9025970
  hyper
gggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgc

SEQ ID NO: 20938 - DNA, 205 bp, Homo sapiens
  chr11:9112741-9112946
  hyper
gccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctc

SEQ ID NO: 20939 - DNA, 26 bp, Homo sapiens
  chr11:12029931-12029957
  hyper
gcgcaatttgtgctgcgtgtcctcca

SEQ ID NO: 20940 - DNA, 194 bp, Homo sapiens; identical to SEQ ID NO: 10705
  chr11:12030273-12030467
  hyper

SEQ ID NO: 20941 - DNA, 61 bp, Homo sapiens; identical to SEQ ID NO: 10706
  chr11:13031258-13031319
  hyper

SEQ ID NO: 20942 - DNA, 33 bp, Homo sapiens
  chr11:15136394-15136427
  hyper
gggcgggggagaacggggcggggggtggggcgg

SEQ ID NO: 20943 - DNA, 59 bp, Homo sapiens; identical to SEQ ID NO: 10708
  chr11:16626111-16626170
  hyper

SEQ ID NO: 20944 - DNA, 53 bp, Homo sapiens; identical to SEQ ID NO: 10710
  chr11:16634305-16634358
  hyper

SEQ ID NO: 20945 - DNA, 143 bp, Homo sapiens; identical to SEQ ID NO: 10713
  chr11:17498038-17498181
  hyper

SEQ ID NO: 20946 - DNA, 49 bp, Homo sapiens; identical to SEQ ID NO: 10714
  chr11:17717486-17717535
  hyper

SEQ ID NO: 20947 - DNA, 79 bp, Homo sapiens
  chr11:17740414-17740493
  hyper
agctgggtttctaagcgtctagggaagaaggactgggcccacgacctgctgagcaactcccaggtcggggactggcgga

SEQ ID NO: 20948 - DNA, 39 bp, Homo sapiens; identical to SEQ ID NO: 10716
  chr11:17741123-17741162
  hyper

SEQ ID NO: 20949 - DNA, 72 bp, Homo sapiens; identical to SEQ ID NO: 10721
  chr11:17756900-17756972
  hyper

SEQ ID NO: 20950 - DNA, 15 bp, Homo sapiens
  chr11:17756993-17757008
  hyper
cgaccacctcacaga

SEQ ID NO: 20951 - DNA, 53 bp, Homo sapiens; identical to SEQ ID NO: 10723
  chr11:17757704-17757757
  hyper

SEQ ID NO: 20952 - DNA, 306 bp, Homo sapiens; identical to SEQ ID NO: 10724
  chr11:18742729-18743035
  hyper

SEQ ID NO: 20953 - DNA, 57 bp, Homo sapiens
  chr11:18812557-18812614
  hyper
gctgggggaggggagcgcgctaagcttgtattctaggggagggtgggacgcgggagg

SEQ ID NO: 20954 - DNA, 138 bp, Homo sapiens
  chr11:18812894-18813032
  hyper
ccctcccccagcatgcgggcgcccagagccccacgggggcgtggcgggggcgggcgccggctcctcggccgggagggctggagaaggtgtcagttgcggggccgcccgaaggagggacccgcgccctccaccttccgg

SEQ ID NO: 20955 - DNA, 80 bp, Homo sapiens
  chr11:18813086-18813166
  hyper
ccgggcgccggcgagcaggcgggcaggctggcgggaggatgcgcgcgcgagtgtgcgtgtgtctgcgtgtgtccctgctt

SEQ ID NO: 20956 - DNA, 75 bp, Homo sapiens
  chr11:18813376-18813451
  hyper
ccccagccccggctccgccccgcccccgggcgggcttccgccgctcgccgggaattgcgcagggctggcggggcg

SEQ ID NO: 20957 - DNA, 88 bp, Homo sapiens
  chr11:18813947-18814035
  hyper
ttctccctgttcagcctctggggagctagagcgagtggacagcccctccctccactgagtcttgccctcctgacgtgcggcgcggggc

SEQ ID NO: 20958 - DNA, 62 bp, Homo sapiens; identical to SEQ ID NO: 10729
  chr11:19366698-19366760
  hyper

SEQ ID NO: 20959 - DNA, 124 bp, Homo sapiens
  chr11:19366978-19367102
  hyper
ctctgtgctgagctccggggtccagagcagggtggggactgccgttggggagagggccggcccctcattgagaggctcgggggccacacctctgctgcgggactctgaccgagggccagggcct

SEQ ID NO: 20960 - DNA, 29 bp, Homo sapiens
  chr11:19367330-19367359
  hyper
tccctctgggcgtacgtgcctgaggctgt

SEQ ID NO: 20961 - DNA, 39 bp, Homo sapiens; identical to SEQ ID NO: 10732
  chr11:19367898-19367937
  hyper

SEQ ID NO: 20962 - DNA, 39 bp, Homo sapiens; identical to SEQ ID NO: 10733
  chr11:19367938-19367977
  hyper

SEQ ID NO: 20963 - DNA, 30 bp, Homo sapiens; identical to SEQ ID NO: 10734
  chr11:19735404-19735434
  hyper

SEQ ID NO: 20964 - DNA, 19 bp, Homo sapiens
  chr11:20153699-20153718
  hyper
ccgcccatccacattcggc

SEQ ID NO: 20965 - DNA, 127 bp, Homo sapiens
  chr11:20153764-20153891
  hyper
ctggaacgattgaaactaagggggtgcgccaactcccccaccttcgcgggtcccctggcaggagacctggtccttgccttaccgcagtaggtgtggctgtgactgaagggagcggcatccctgagca

SEQ ID NO: 20966 - DNA, 73 bp, Homo sapiens; identical to SEQ ID NO: 10736
  chr11:20177730-20177803
  hyper

SEQ ID NO: 20967 - DNA, 173 bp, Homo sapiens
  chr11:20178305-20178478
  hyper
ttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctg

SEQ ID NO: 20968 - DNA, 200 bp, Homo sapiens; identical to SEQ ID NO: 10738
  chr11:20178700-20178900
  hyper

SEQ ID NO: 20969 - DNA, 33 bp, Homo sapiens
  chr11:20180793-20180826
  hyper
cgaaggtcttgggagggacgctctggagcaagg

SEQ ID NO: 20970 - DNA, 28 bp, Homo sapiens
  chr11:20181185-20181213
  hyper
tgtctcctagaagctcgaaggcagaaac

SEQ ID NO: 20971 - DNA, 32 bp, Homo sapiens
  chr11:20181254-20181286
  hyper
tgactgcgcacagtctccgactgcgtgtgctc

SEQ ID NO: 20972 - DNA, 32 bp, Homo sapiens; identical to SEQ ID NO: 10745
  chr11:20184112-20184144
  hyper

SEQ ID NO: 20973 - DNA, 69 bp, Homo sapiens
  chr11:20184500-20184569
  hyper
cctgcttcctggggtcggtctccacagcctcctaaagaattcctaaagcgccaaagaggaaaagtgagg

SEQ ID NO: 20974 - DNA, 20 bp, Homo sapiens
  chr11:20185410-20185430
  hyper
cccgacgcctggctttgggg

SEQ ID NO: 20975 - DNA, 17 bp, Homo sapiens
  chr11:20229550-20229567
  hyper
gacgctcccttaggacc

SEQ ID NO: 20976 - DNA, 39 bp, Homo sapiens; identical to SEQ ID NO: 10749
  chr11:20230466-20230505
  hyper

SEQ ID NO: 20977 - DNA, 310 bp, Homo sapiens
  chr11:20619407-20619717
  hyper
agcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccc

SEQ ID NO: 20978 - DNA, 9 bp, Homo sapiens
  chr11:20621644-20621653
  hyper
taataggat

SEQ ID NO: 20979 - DNA, 26 bp, Homo sapiens
  chr11:20691060-20691086
  hyper
gccagcggtggggggcgggctggggg

SEQ ID NO: 20980 - DNA, 40 bp, Homo sapiens; identical to SEQ ID NO: 956
  chr11:20691121-20691161
  hyper

SEQ ID NO: 20981 - DNA, 57 bp, Homo sapiens
  chr11:20691162-20691219
  hyper
cccgctagcaagtttggcggctccaagccaggcgcgcctcaggatccaggctcattt

SEQ ID NO: 20982 - DNA, 164 bp, Homo sapiens
  chr11:20691452-20691616
  hyper
gggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttc

SEQ ID NO: 20983 - DNA, 36 bp, Homo sapiens; identical to SEQ ID NO: 10761
  chr11:20692310-20692346
  hyper

SEQ ID NO: 20984 - DNA, 30 bp, Homo sapiens; identical to SEQ ID NO: 10762
  chr11:20692851-20692881
  hyper

SEQ ID NO: 20985 - DNA, 386 bp, Homo sapiens; identical to SEQ ID NO: 10763
  chr11:22214443-22214829
  hyper

SEQ ID NO: 20986 - DNA, 15 bp, Homo sapiens
  chr11:22359403-22359418
  hyper
tcttttatttactca

SEQ ID NO: 20987 - DNA, 105 bp, Homo sapiens; identical to SEQ ID NO: 10766
  chr11:22359777-22359882
  hyper

SEQ ID NO: 20988 - DNA, 355 bp, Homo sapiens; identical to SEQ ID NO: 10767
  chr11:22362533-22362888
  hyper

SEQ ID NO: 20989 - DNA, 61 bp, Homo sapiens
  chr11:22364975-22365036
  hyper
agctggagcagagacaacagcccagaggggtttgaggactcccgggcgaagtcttctagtc

SEQ ID NO: 20990 - DNA, 70 bp, Homo sapiens
  chr11:22365477-22365547
  hyper
cagctgctttcagtggcctcctgccttgctgcggtgtccacaaccaaggtcctagcgccagttcccagaa

SEQ ID NO: 20991 - DNA, 30 bp, Homo sapiens; identical to SEQ ID NO: 10770
  chr11:22688349-22688379
  hyper

SEQ ID NO: 20992 - DNA, 25 bp, Homo sapiens
  chr11:27743608-27743633
  hyper
accagaaaagcgcagcagggagggg

SEQ ID NO: 20993 - DNA, 250 bp, Homo sapiens
  chr11:27743897-27744147
  hyper
gtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgc

SEQ ID NO: 20994 - DNA, 55 bp, Homo sapiens
  chr11:27744656-27744711
  hyper
tgttatggagatgtccgtcgctctgaggagcgctagtgccctgggaagtccccag

SEQ ID NO: 20995 - DNA, 9 bp, Homo sapiens
  chr11:30037743-30037752
  hyper
gaagggaac

SEQ ID NO: 20996 - DNA, 195 bp, Homo sapiens; identical to SEQ ID NO: 10775
  chr11:30038294-30038489
  hyper

SEQ ID NO: 20997 - DNA, 37 bp, Homo sapiens; identical to SEQ ID NO: 10776
  chr11:30038919-30038956
  hyper

SEQ ID NO: 20998 - DNA, 71 bp, Homo sapiens; identical to SEQ ID NO: 10777
  chr11:30040131-30040202
  hyper

SEQ ID NO: 20999 - DNA, 34 bp, Homo sapiens; identical to SEQ ID NO: 10778
  chr11:30605841-30605875
  hyper

SEQ ID NO: 21000 - DNA, 30 bp, Homo sapiens; identical to SEQ ID NO: 10781
  chr11:30606351-30606381
  hyper

SEQ ID NO: 21001 - DNA, 15 bp, Homo sapiens
  chr11:30606740-30606755
  hyper
tgtagagaagaaatc

SEQ ID NO: 21002 - DNA, 223 bp, Homo sapiens
  chr11:30606864-30607087
  hyper
cggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatc

SEQ ID NO: 21003 - DNA, 321 bp, Homo sapiens
  chr11:30607409-30607730
  hyper
ccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttc

SEQ ID NO: 21004 - DNA, 212 bp, Homo sapiens
  chr11:31819833-31820045
  hyper
ggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaa

SEQ ID NO: 21005 - DNA, 30 bp, Homo sapiens; identical to SEQ ID NO: 10790
  chr11:31822002-31822032
  hyper

SEQ ID NO: 21006 - DNA, 221 bp, Homo sapiens; identical to SEQ ID NO: 10791
  chr11:31822487-31822708
  hyper

SEQ ID NO: 21007 - DNA, 54 bp, Homo sapiens
  chr11:31824246-31824300
  hyper
atcacctgcagaattcgggaaatgtcgcacggccgggccccgctgtgagctagc

SEQ ID NO: 21008 - DNA, 209 bp, Homo sapiens
  chr11:31824355-31824564
  hyper
caccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgcc

SEQ ID NO: 21009 - DNA, 284 bp, Homo sapiens
  chr11:31824680-31824964
  hyper
tgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgct

SEQ ID NO: 21010 - DNA, 26 bp, Homo sapiens
  chr11:31827204-31827230
  hyper
gtgggaccccacggggtctgggcaga

SEQ ID NO: 21011 - DNA, 329 bp, Homo sapiens; identical to SEQ ID NO: 10798
  chr11:31829116-31829445
  hyper

SEQ ID NO: 21012 - DNA, 56 bp, Homo sapiens; identical to SEQ ID NO: 10799
  chr11:31830319-31830375
  hyper

SEQ ID NO: 21013 - DNA, 75 bp, Homo sapiens; identical to SEQ ID NO: 10800
  chr11:31831502-31831577
  hyper

SEQ ID NO: 21014 - DNA, 50 bp, Homo sapiens; identical to SEQ ID NO: 10801
  chr11:31832795-31832845
  hyper

SEQ ID NO: 21015 - DNA, 49 bp, Homo sapiens; identical to SEQ ID NO: 10802
  chr11:31833553-31833602
  hyper

SEQ ID NO: 21016 - DNA, 149 bp, Homo sapiens; identical to SEQ ID NO: 10803
  chr11:31834086-31834235
  hyper

SEQ ID NO: 21017 - DNA, 30 bp, Homo sapiens; identical to SEQ ID NO: 10804
  chr11:31835312-31835342
  hyper

SEQ ID NO: 21018 - DNA, 116 bp, Homo sapiens
  chr11:31835591-31835707
  hyper
tgctgccctccaagacgcgggggggcggcggggattgcgctttaggttctgtctcctttccccgcctccccacaggcccctgttcccccctaccctccgccccctgtggccagagg

SEQ ID NO: 21019 - DNA, 14 bp, Homo sapiens
  chr11:31835797-31835811
  hyper
gctgggggaccgtg

SEQ ID NO: 21020 - DNA, 14 bp, Homo sapiens
  chr11:31836032-31836046
  hyper
aactctctctttcc

SEQ ID NO: 21021 - DNA, 256 bp, Homo sapiens
  chr11:31839051-31839307
  hyper
gacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggag

SEQ ID NO: 21022 - DNA, 93 bp, Homo sapiens
  chr11:31840080-31840173
  hyper
ggcctaggccaaaggtctctccaggcctgctgggttctcaagagggaagccctaaagggggcctacccgggcttccctcgccctctggctgaa

SEQ ID NO: 21023 - DNA, 46 bp, Homo sapiens
  chr11:31847925-31847971
  hyper
acagaccccgagcccctctctgcgcaactaccgcctctaaaaaaaa

SEQ ID NO: 21024 - DNA, 117 bp, Homo sapiens
  chr11:31848355-31848472
  hyper
cctgagtgactggggcgcacatgacccccctcctggggcctttgggctcaacccttacttttaacttgttctaacaggaataatggagtagtactactaatgcatggtcagaagggg

SEQ ID NO: 21025 - DNA, 214 bp, Homo sapiens
  chr11:32458175-32458389
  hyper
atctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgt

SEQ ID NO: 21026 - DNA, 25 bp, Homo sapiens
  chr11:32460864-32460889
  hyper
gagccccacgcgcaagacagcccaa

SEQ ID NO: 21027 - DNA, 118 bp, Homo sapiens
  chr11:33890334-33890452
  hyper
ccctggaggcccagagccagctccgaggtggacggtcggacccctcacccgcccgttatccgcaaggctggcagcggctccacctgcggaccgggaaggcggccgttggggaccccgg

SEQ ID NO: 21028 - DNA, 91 bp, Homo sapiens; identical to SEQ ID NO: 10831
  chr11:35440574-35440665
  hyper

SEQ ID NO: 21029 - DNA, 146 bp, Homo sapiens; identical to SEQ ID NO: 10832
  chr11:35441295-35441441
  hyper

SEQ ID NO: 21030 - DNA, 549 bp, Homo sapiens; identical to SEQ ID NO: 10833
  chr11:35641053-35641602
  hyper

SEQ ID NO: 21031 - DNA, 52 bp, Homo sapiens; identical to SEQ ID NO: 10834
  chr11:36399257-36399309
  hyper

SEQ ID NO: 21032 - DNA, 44 bp, Homo sapiens; identical to SEQ ID NO: 10835
  chr11:40314716-40314760
  hyper

SEQ ID NO: 21033 - DNA, 93 bp, Homo sapiens; identical to SEQ ID NO: 10836
  chr11:40315465-40315558
  hyper

SEQ ID NO: 21034 - DNA, 62 bp, Homo sapiens; identical to SEQ ID NO: 10837
  chr11:43569013-43569075
  hyper

SEQ ID NO: 21035 - DNA, 110 bp, Homo sapiens; identical to SEQ ID NO: 10838
  chr11:43569128-43569238
  hyper

SEQ ID NO: 21036 - DNA, 24 bp, Homo sapiens
  chr11:43596489-43596513
  hyper
ggtgagtttcctcttcgggtggag

SEQ ID NO: 21037 - DNA, 30 bp, Homo sapiens; identical to SEQ ID NO: 10840
  chr11:43599075-43599105
  hyper

SEQ ID NO: 21038 - DNA, 246 bp, Homo sapiens
  chr11:43600557-43600803
  hyper
cacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctc

SEQ ID NO: 21039 - DNA, 82 bp, Homo sapiens
  chr11:43601012-43601094
  hyper
cagctggctgcagtgcggacgggaccggcgcgctcccgtggcccccagaccgaggtaaggagcagggagtcggcgcccgggt

SEQ ID NO: 21040 - DNA, 75 bp, Homo sapiens
  chr11:43602393-43602468
  hyper
ctgattggtgggtgacgattttagtccgcaccaatgagctggcggcctcgtctgtatttatttagtgctctgggg

SEQ ID NO: 21041 - DNA, 40 bp, Homo sapiens; identical to SEQ ID NO: 3747
  chr11:43603446-43603486
  hyper

SEQ ID NO: 21042 - DNA, 31 bp, Homo sapiens; identical to SEQ ID NO: 10848
  chr11:43963534-43963565
  hyper

SEQ ID NO: 21043 - DNA, 30 bp, Homo sapiens; identical to SEQ ID NO: 10849
  chr11:43963625-43963655
  hyper

SEQ ID NO: 21044 - DNA, 198 bp, Homo sapiens; identical to SEQ ID NO: 10850
  chr11:43964453-43964651
  hyper

SEQ ID NO: 21045 - DNA, 357 bp, Homo sapiens; identical to SEQ ID NO: 10851
  chr11:43964895-43965252
  hyper

SEQ ID NO: 21046 - DNA, 162 bp, Homo sapiens; identical to SEQ ID NO: 10852
  chr11:43965899-43966061
  hyper

SEQ ID NO: 21047 - DNA, 30 bp, Homo sapiens; identical to SEQ ID NO: 10856
  chr11:44332542-44332572
  hyper

SEQ ID NO: 21048 - DNA, 122 bp, Homo sapiens; identical to SEQ ID NO: 10857
  chr11:44332922-44333044
  hyper

SEQ ID NO: 21049 - DNA, 194 bp, Homo sapiens; identical to SEQ ID NO: 3752
  chr11:45376858-45377052
  hyper

SEQ ID NO: 21050 - DNA, 88 bp, Homo sapiens; identical to SEQ ID NO: 10862
  chr11:46259327-46259415
  hyper

SEQ ID NO: 21051 - DNA, 15 bp, Homo sapiens
  chr11:46316818-46316833
  hyper
gtaccattactgccc

SEQ ID NO: 21052 - DNA, 17 bp, Homo sapiens
  chr11:46317680-46317697
  hyper
gccgaccccttgctctt

SEQ ID NO: 21053 - DNA, 137 bp, Homo sapiens; identical to SEQ ID NO: 10866
  chr11:46414563-46414700
  hyper

SEQ ID NO: 21054 - DNA, 364 bp, Homo sapiens
  chr11:47208680-47209044
  hyper
ttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagagga

SEQ ID NO: 21055 - DNA, 68 bp, Homo sapiens
  chr11:47209189-47209257
  hyper
tagcaaaattatgttgtttctaaatccaggaggaatcactgacgcgttctttacgcagatgaatccgc

SEQ ID NO: 21056 - DNA, 64 bp, Homo sapiens; identical to SEQ ID NO: 10868
  chr11:47615772-47615836
  hyper

SEQ ID NO: 21057 - DNA, 177 bp, Homo sapiens
  chr11:57194178-57194355
  hyper
gaagacacaaactcccgctgccaagttggtgttatcttcagtttactgacaatgaaacaaaagctcccatggatttcaggaacttgcccaaggtcacagggctagtttagtcacgacgcaggccattctactgccagaaatacccccaactcccatgaccctcgcctaggactcgca

SEQ ID NO: 21058 - DNA, 30 bp, Homo sapiens; identical to SEQ ID NO: 10870
  chr11:58668429-58668459
  hyper

SEQ ID NO: 21059 - DNA, 29 bp, Homo sapiens
  chr11:58672717-58672746
  hyper
aagttggatcatttgcggagcaggccaag

SEQ ID NO: 21060 - DNA, 103 bp, Homo sapiens
  chr11:58673064-58673167
  hyper
gcttccactgggagacaggggacgccgatgagcaggaagaagcagggcagtgactgcttagtttatcctggtacgcgggaactggctgtggaccgagtggttc

SEQ ID NO: 21061 - DNA, 80 bp, Homo sapiens; identical to SEQ ID NO: 3759
  chr11:58673168-58673248
  hyper

SEQ ID NO: 21062 - DNA, 34 bp, Homo sapiens
  chr11:59333371-59333405
  hyper
agcccgtgcgccgaacgctttcgaggacttcttt

SEQ ID NO: 21063 - DNA, 20 bp, Homo sapiens
  chr11:61063138-61063158
  hyper
ccaaccgctccctggcctgg

SEQ ID NO: 21064 - DNA, 38 bp, Homo sapiens; identical to SEQ ID NO: 10878
  chr11:61276466-61276504
  hyper

SEQ ID NO: 21065 - DNA, 230 bp, Homo sapiens
  chr11:61276772-61277002
  hyper
gctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgc

SEQ ID NO: 21066 - DNA, 15 bp, Homo sapiens
  chr11:61277327-61277342
  hyper
cgctccaggactggg

SEQ ID NO: 21067 - DNA, 51 bp, Homo sapiens; identical to SEQ ID NO: 10881
  chr11:61335193-61335244
  hyper

SEQ ID NO: 21068 - DNA, 37 bp, Homo sapiens
  chr11:61595049-61595086
  hyper
cgcgccaaggaagggcgtcacctagccaagccggccc

SEQ ID NO: 21069 - DNA, 61 bp, Homo sapiens
  chr11:61595262-61595323
  hyper
gatctcctccggcgcccggggccggagagtgggggagggaggaggtcggacacgtagcctg

SEQ ID NO: 21070 - DNA, 300 bp, Homo sapiens
  chr11:61596120-61596420
  hyper
ggatccctggctccccgtgggccaaacagacctccggcgctgaatggagcttgggacgtcctgtagggaaggaaagtgcatctattgcactcgtaccccctccccaatcctcctcctcctctgggccgactggggtggagaccggatctgggacccggggaggcggcgctgcggtgaaagtcccagcggtggagaacagggcaagcatctaccgcgcgcgccgggacccacgcgtcctccccttcctcggggtttgtctggaggcagggactccccaagaggggcgctcgggccagacgg

SEQ ID NO: 21071 - DNA, 158 bp, Homo sapiens; identical to SEQ ID NO: 10884
  chr11:64059919-64060077
  hyper

SEQ ID NO: 21072 - DNA, 72 bp, Homo sapiens; identical to SEQ ID NO: 10885
  chr11:64066962-64067034
  hyper

SEQ ID NO: 21073 - DNA, 123 bp, Homo sapiens; identical to SEQ ID NO: 10886
  chr11:64409956-64410079
  hyper

SEQ ID NO: 21074 - DNA, 59 bp, Homo sapiens; identical to SEQ ID NO: 10887
  chr11:64410347-64410406
  hyper

SEQ ID NO: 21075 - DNA, 108 bp, Homo sapiens; identical to SEQ ID NO: 10888
  chr11:64478789-64478897
  hyper

SEQ ID NO: 21076 - DNA, 58 bp, Homo sapiens; identical to SEQ ID NO: 10889
  chr11:64480273-64480331
  hyper

SEQ ID NO: 21077 - DNA, 50 bp, Homo sapiens
  chr11:64480379-64480429
  hyper
cgaagcgccccaggccctcacccccgcgcccaggcaccgggcggccgctc

SEQ ID NO: 21078 - DNA, 231 bp, Homo sapiens
  chr11:64480593-64480824
  hyper
cccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagc

SEQ ID NO: 21079 - DNA, 158 bp, Homo sapiens
  chr11:64481042-64481200
  hyper
gcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcc

SEQ ID NO: 21080 - DNA, 328 bp, Homo sapiens; identical to SEQ ID NO: 10891
  chr11:64512954-64513282
  hyper

SEQ ID NO: 21081 - DNA, 13 bp, Homo sapiens
  chr11:64739455-64739468
  hyper
gctctctgaaaaa

SEQ ID NO: 21082 - DNA, 32 bp, Homo sapiens; identical to SEQ ID NO: 10893
  chr11:64739698-64739730
  hyper

SEQ ID NO: 21083 - DNA, 30 bp, Homo sapiens; identical to SEQ ID NO: 10894
  chr11:65185213-65185243
  hyper

SEQ ID NO: 21084 - DNA, 30 bp, Homo sapiens; identical to SEQ ID NO: 10895
  chr11:65185467-65185497
  hyper

SEQ ID NO: 21085 - DNA, 17 bp, Homo sapiens
  chr11:65601640-65601657
  hyper
tgcggtggtgtgtgtgt

SEQ ID NO: 21086 - DNA, 20 bp, Homo sapiens
  chr11:66188095-66188115
  hyper
aattagtgtcagtgccggcc

SEQ ID NO: 21087 - DNA, 25 bp, Homo sapiens
  chr11:66188145-66188170
  hyper
ggcttcaggccgccctaaacctggc

SEQ ID NO: 21088 - DNA, 98 bp, Homo sapiens
  chr11:66188375-66188473
  hyper
cccctccccagtcagcggctcccgctgcagcttgcttagcccagcctcccgctctcccgcccccccggctctaaaacgagccccccacgcctggcagg

SEQ ID NO: 21089 - DNA, 135 bp, Homo sapiens
  chr11:66188974-66189109
  hyper
ttcctcctgagctccctccagacctcaccttagttctgaatgagagttagagagcctggacggtgtccctaacaccagattatgagaggataagagccaggacagagcggcctcggtgcccgccagtgcagaagc

SEQ ID NO: 21090 - DNA, 66 bp, Homo sapiens; identical to SEQ ID NO: 10903
  chr11:67479192-67479258
  hyper

SEQ ID NO: 21091 - DNA, 74 bp, Homo sapiens; identical to SEQ ID NO: 10904
  chr11:67895805-67895879
  hyper

SEQ ID NO: 21092 - DNA, 30 bp, Homo sapiens; identical to SEQ ID NO: 10905
  chr11:69452211-69452241
  hyper

SEQ ID NO: 21093 - DNA, 240 bp, Homo sapiens
  chr11:69517174-69517414
  hyper
tccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacagg

SEQ ID NO: 21094 - DNA, 240 bp, Homo sapiens
  chr11:69518290-69518530
  hyper
aggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgcc

SEQ ID NO: 21095 - DNA, 30 bp, Homo sapiens; identical to SEQ ID NO: 10908
  chr11:69519421-69519451
  hyper

SEQ ID NO: 21096 - DNA, 26 bp, Homo sapiens
  chr11:69588904-69588930
  hyper
gggcgcaggtcattgcggggcaggtg

SEQ ID NO: 21097 - DNA, 100 bp, Homo sapiens; identical to SEQ ID NO: 10910
  chr11:69589407-69589507
  hyper

SEQ ID NO: 21098 - DNA, 259 bp, Homo sapiens
  chr11:69589854-69590113
  hyper
cggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggccc

SEQ ID NO: 21099 - DNA, 35 bp, Homo sapiens
  chr11:69590114-69590149
  hyper
cccgaggccgagccgctatatatatagcccggcgc

SEQ ID NO: 21100 - DNA, 245 bp, Homo sapiens
  chr11:69590222-69590467
  hyper
ggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagcc

SEQ ID NO: 21101 - DNA, 53 bp, Homo sapiens
  chr11:71318279-71318332
  hyper
ggggaaggtgcggggcgaggcggccgcggctccctggcatccctctccttacc

SEQ ID NO: 21102 - DNA, 51 bp, Homo sapiens
  chr11:71318967-71319018
  hyper
cagctctcggcggcggacccgggccgcgtgtgagcgcgctttgcacctcct

SEQ ID NO: 21103 - DNA, 56 bp, Homo sapiens
  chr11:71951583-71951639
  hyper
ggagtgttccagggccgtggagagcagtttagggcgccagtaaaccttttgtctag

SEQ ID NO: 21104 - DNA, 19 bp, Homo sapiens
  chr11:71954593-71954612
  hyper
ttgacctgaagggcacgag

SEQ ID NO: 21105 - DNA, 129 bp, Homo sapiens
  chr11:71955215-71955344
  hyper
caagtgcagccagcccggcccgcgcgccttttaacgcgcaggaccccgcggaggggggcggggcggggcgagctccgaaggggcggggcctaggaggcccagacaccgcccaaagccgccccgaccccc

SEQ ID NO: 21106 - DNA, 3 bp, Homo sapiens
  chr11:71955377-71955380
  hyper
cag

SEQ ID NO: 21107 - DNA, 37 bp, Homo sapiens
  chr11:71956340-71956377
  hyper
agggcccgcctgcctctccccccgttccctcagctcc

SEQ ID NO: 21108 - DNA, 157 bp, Homo sapiens
  chr11:72432916-72433073
  hyper
ggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggt

SEQ ID NO: 21109 - DNA, 37 bp, Homo sapiens
  chr11:74394454-74394491
  hyper
ggctgggcacccccacgccgcccgggcactgctcgcg

SEQ ID NO: 21110 - DNA, 30 bp, Homo sapiens; identical to SEQ ID NO: 10922
  chr11:74441845-74441875
  hyper

SEQ ID NO: 21111 - DNA, 388 bp, Homo sapiens; identical to SEQ ID NO: 10923
  chr11:74442255-74442643
  hyper

SEQ ID NO: 21112 - DNA, 49 bp, Homo sapiens; identical to SEQ ID NO: 10924
  chr11:74442705-74442754
  hyper

SEQ ID NO: 21113 - DNA, 33 bp, Homo sapiens; identical to SEQ ID NO: 10925
  chr11:74952180-74952213
  hyper

SEQ ID NO: 21114 - DNA, 5 bp, Homo sapiens
  chr11:74952724-74952729
  hyper
gaccc

SEQ ID NO: 21115 - DNA, 198 bp, Homo sapiens; identical to SEQ ID NO: 10927
  chr11:75141367-75141565
  hyper

SEQ ID NO: 21116 - DNA, 553 bp, Homo sapiens; identical to SEQ ID NO: 10928
  chr11:75378696-75379249
  hyper

SEQ ID NO: 21117 - DNA, 178 bp, Homo sapiens
  chr11:75379895-75380073
  hyper
gctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgc

SEQ ID NO: 21118 - DNA, 138 bp, Homo sapiens; identical to SEQ ID NO: 10930
  chr11:75863325-75863463
  hyper

SEQ ID NO: 21119 - DNA, 156 bp, Homo sapiens; identical to SEQ ID NO: 10931
  chr11:76032912-76033068
  hyper

SEQ ID NO: 21120 - DNA, 30 bp, Homo sapiens; identical to SEQ ID NO: 10932
  chr11:76382193-76382223
  hyper

SEQ ID NO: 21121 - DNA, 26 bp, Homo sapiens
  chr11:78672891-78672917
  hyper
ctgatgtttccttctcgtgatgtctg

SEQ ID NO: 21122 - DNA, 103 bp, Homo sapiens
  chr11:78672964-78673067
  hyper
gggttggggacagaagcagccctccaactcttgcacactccagcggcgccgcggggcaagagcggggctgcctgagcccgcggagccacgtcaggcccccagc

SEQ ID NO: 21123 - DNA, 30 bp, Homo sapiens; identical to SEQ ID NO: 10934
  chr11:78673274-78673304
  hyper

SEQ ID NO: 21124 - DNA, 142 bp, Homo sapiens; identical to SEQ ID NO: 10935
  chr11:79148873-79149015
  hyper

SEQ ID NO: 21125 - DNA, 30 bp, Homo sapiens; identical to SEQ ID NO: 10936
  chr11:79149278-79149308
  hyper

SEQ ID NO: 21126 - DNA, 42 bp, Homo sapiens; identical to SEQ ID NO: 10937
  chr11:79149528-79149570
  hyper

SEQ ID NO: 21127 - DNA, 61 bp, Homo sapiens; identical to SEQ ID NO: 10938
  chr11:79150941-79151002
  hyper

SEQ ID NO: 21128 - DNA, 137 bp, Homo sapiens; identical to SEQ ID NO: 10939
  chr11:79152080-79152217
  hyper

SEQ ID NO: 21129 - DNA, 20 bp, Homo sapiens
  chr11:82443549-82443569
  hyper
aaaggctggaataggcggtg

SEQ ID NO: 21130 - DNA, 69 bp, Homo sapiens; identical to SEQ ID NO: 10941
  chr11:82443651-82443720
  hyper

SEQ ID NO: 21131 - DNA, 32 bp, Homo sapiens; identical to SEQ ID NO: 10942
  chr11:82444153-82444185
  hyper

SEQ ID NO: 21132 - DNA, 83 bp, Homo sapiens
  chr11:82445101-82445184
  hyper
gactcctctaaccgcaaggggtgaggaagagatggctggtctcaaactccagttcaggcccatgaggccgctgcagcgcttga

SEQ ID NO: 21133 - DNA, 79 bp, Homo sapiens; identical to SEQ ID NO: 10944
  chr11:84431621-84431700
  hyper

SEQ ID NO: 21134 - DNA, 30 bp, Homo sapiens; identical to SEQ ID NO: 10945
  chr11:84432138-84432168
  hyper

SEQ ID NO: 21135 - DNA, 23 bp, Homo sapiens
  chr11:86085968-86085991
  hyper
gagctgcccgagagccagagcag

SEQ ID NO: 21136 - DNA, 111 bp, Homo sapiens; identical to SEQ ID NO: 3779
  chr11:88798820-88798931
  hyper

SEQ ID NO: 21137 - DNA, 117 bp, Homo sapiens
  chr11:88798965-88799082
  hyper
cgcccccaggcagccgctcctcgagggcttcctgcgctctcgtagcggccttggctgcagctggagcgctagtgtcggcgatggaggcagcggtgacagcaggcagaacggctgcgg

SEQ ID NO: 21138 - DNA, 34 bp, Homo sapiens; identical to SEQ ID NO: 10953
  chr11:89224559-89224593
  hyper

SEQ ID NO: 21139 - DNA, 185 bp, Homo sapiens
  chr11:91957315-91957500
  hyper
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatat

SEQ ID NO: 21140 - DNA, 158 bp, Homo sapiens
  chr11:91957674-91957832
  hyper
agagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccg

SEQ ID NO: 21141 - DNA, 4 bp, Homo sapiens
  chr11:91958730-91958734
  hyper
gcag

SEQ ID NO: 21142 - DNA, 30 bp, Homo sapiens; identical to SEQ ID NO: 10956
  chr11:91959509-91959539
  hyper

SEQ ID NO: 21143 - DNA, 32 bp, Homo sapiens; identical to SEQ ID NO: 10957
  chr11:91960082-91960114
  hyper

SEQ ID NO: 21144 - DNA, 80 bp, Homo sapiens; identical to SEQ ID NO: 10958
  chr11:91960369-91960449
  hyper

SEQ ID NO: 21145 - DNA, 92 bp, Homo sapiens
  chr11:93063645-93063737
  hyper
gaggcagccgaggagccgcacagggcagcgcctgccgccgccgccgcgcccatcccccactccgacggccacgagttcgggccgcgacgtcc

SEQ ID NO: 21146 - DNA, 19 bp, Homo sapiens
  chr11:94134067-94134086
  hyper
caactgccaggttgacgat

SEQ ID NO: 21147 - DNA, 4 bp, Homo sapiens
  chr11:94473596-94473600
  hyper
ggag

SEQ ID NO: 21148 - DNA, 30 bp, Homo sapiens; identical to SEQ ID NO: 10966
  chr11:94474489-94474519
  hyper

SEQ ID NO: 21149 - DNA, 521 bp, Homo sapiens; identical to SEQ ID NO: 10967
  chr11:94501445-94501966
  hyper

SEQ ID NO: 21150 - DNA, 34 bp, Homo sapiens; identical to SEQ ID NO: 10968
  chr11:98891367-98891401
  hyper

SEQ ID NO: 21151 - DNA, 295 bp, Homo sapiens
  chr11:100997981-100998276
  hyper
gaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgg

SEQ ID NO: 21152 - DNA, 76 bp, Homo sapiens
  chr11:100998318-100998394
  hyper
ggccgtcccgcgggagcaggcagccgctcgcgcccggcgccttgcagggcggcggcgcgaacgggccctgctgggg

SEQ ID NO: 21153 - DNA, 30 bp, Homo sapiens; identical to SEQ ID NO: 10971
  chr11:100999675-100999705
  hyper

SEQ ID NO: 21154 - DNA, 90 bp, Homo sapiens
  chr11:101453090-101453180
  hyper
tagagctgagaacctcgggaaaccgcttgcgggtggatgtgacaagtcaggaaacttgactacccaatcacccaaaggggcaatgggaca

SEQ ID NO: 21155 - DNA, 64 bp, Homo sapiens; identical to SEQ ID NO: 10973
  chr11:101454510-101454574
  hyper

SEQ ID NO: 21156 - DNA, 35 bp, Homo sapiens; identical to SEQ ID NO: 10974
  chr11:101918471-101918506
  hyper

SEQ ID NO: 21157 - DNA, 112 bp, Homo sapiens
  chr11:104034409-104034521
  hyper
acaatgcattcagcccgagttcacattcaagattcaaaaagaaaggggaaaaacatagaaagaacaataacaatagcaaacatgatttttttttcagttaaaaaataaaatg

SEQ ID NO: 21158 - DNA, 222 bp, Homo sapiens
  chr11:104034996-104035218
  hyper
cgttctccagccccggccgcggcccctgagaggcgcgcactcgggctcagagcggcggcgcgagcacctcagctccccagtttcccaggccgggcctaaacctgctctgccactgagcatgcccagtttaatcgccggccgggactcttcccaccgccctgggctttaccctcctggttggacctgtaagggctcaggaaacaaactcgccaggaggaagtg

SEQ ID NO: 21159 - DNA, 211 bp, Homo sapiens
  chr11:105481005-105481216
  hyper
aaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcg

SEQ ID NO: 21160 - DNA, 25 bp, Homo sapiens
  chr11:106888283-106888308
  hyper
tgtagtcccctcttccgccctagcc

SEQ ID NO: 21161 - DNA, 57 bp, Homo sapiens
  chr11:106888429-106888486
  hyper
tccgcgttctctcccccgaaggcggtccccccttccgccccccgctcaccgagggcg

SEQ ID NO: 21162 - DNA, 23 bp, Homo sapiens
  chr11:106888801-106888824
  hyper
ggccgaggcggtggcggcgagga

SEQ ID NO: 21163 - DNA, 15 bp, Homo sapiens
  chr11:106889400-106889415
  hyper
cgttgctgtcctctg

SEQ ID NO: 21164 - DNA, 286 bp, Homo sapiens; identical to SEQ ID NO: 10984
  chr11:106889690-106889976
  hyper

SEQ ID NO: 21165 - DNA, 287 bp, Homo sapiens
  chr11:107462128-107462415
  hyper
agtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcg

SEQ ID NO: 21166 - DNA, 448 bp, Homo sapiens; identical to SEQ ID NO: 10986
  chr11:107799357-107799805
  hyper

SEQ ID NO: 21167 - DNA, 15 bp, Homo sapiens
  chr11:109292815-109292830
  hyper
tctggcaataggctg

SEQ ID NO: 21168 - DNA, 15 bp, Homo sapiens
  chr11:109292891-109292906
  hyper
cgcggctcggtctct

SEQ ID NO: 21169 - DNA, 123 bp, Homo sapiens
  chr11:109293052-109293175
  hyper
ggggaggacagctcacgcggcctgagcagccacccctggccatagctccagcccccgcccctgcccccggcccctgccctggcttgcttgcgcgctacctcgctactccgcagtgcaacagtt

SEQ ID NO: 21170 - DNA, 26 bp, Homo sapiens
  chr11:109293873-109293899
  hyper
cgcggtgccggcgcagaccccatcct

SEQ ID NO: 21171 - DNA, 141 bp, Homo sapiens; identical to SEQ ID NO: 10991
  chr11:110581773-110581914
  hyper

SEQ ID NO: 21172 - DNA, 95 bp, Homo sapiens
  chr11:110582137-110582232
  hyper
cgcccccaccctgctcggttctaggcccagccgaacctacatgtccccgtagtgtcgagcgttatcatccacagtcgcccctcaaactgtgaccc

SEQ ID NO: 21173 - DNA, 101 bp, Homo sapiens
  chr11:110582434-110582535
  hyper
ggctgacaccgccaaagggcagtcagtgctcgcccaggccacttcgggaggcccaggggcacggcgaggggtcggggaaaggcgatcgcccactacagccc

SEQ ID NO: 21174 - DNA, 6 bp, Homo sapiens
  chr11:110582889-110582895
  hyper
gtcagg

SEQ ID NO: 21175 - DNA, 524 bp, Homo sapiens
  chr11:110583050-110583574
  hyper
gcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttg

SEQ ID NO: 21176 - DNA, 166 bp, Homo sapiens
  chr11:110583730-110583896
  hyper
tcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaag

SEQ ID NO: 21177 - DNA, 30 bp, Homo sapiens; identical to SEQ ID NO: 10996
  chr11:110584122-110584152
  hyper

SEQ ID NO: 21178 - DNA, 51 bp, Homo sapiens
  chr11:111383132-111383183
  hyper
acccgccccgtctcgcgcccgccccgcccctcggcccgcggggttccaagg

SEQ ID NO: 21179 - DNA, 223 bp, Homo sapiens
  chr11:111383682-111383905
  hyper
gtcattagctgattgtactgtggtggttacaatcactaactccactgccatcaaaacaaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagata

SEQ ID NO: 21180 - DNA, 151 bp, Homo sapiens
  chr11:111412061-111412212
  hyper
ccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactcca

SEQ ID NO: 21181 - DNA, 320 bp, Homo sapiens; identical to SEQ ID NO: 11002
  chr11:113345418-113345738
  hyper

SEQ ID NO: 21182 - DNA, 58 bp, Homo sapiens; identical to SEQ ID NO: 11003
  chr11:113346283-113346341
  hyper

SEQ ID NO: 21183 - DNA, 120 bp, Homo sapiens; identical to SEQ ID NO: 11004
  chr11:113929618-113929738
  hyper

SEQ ID NO: 21184 - DNA, 352 bp, Homo sapiens; identical to SEQ ID NO: 11005
  chr11:113930374-113930726
  hyper

SEQ ID NO: 21185 - DNA, 46 bp, Homo sapiens; identical to SEQ ID NO: 11006
  chr11:113931651-113931697
  hyper

SEQ ID NO: 21186 - DNA, 510 bp, Homo sapiens; identical to SEQ ID NO: 11007
  chr11:115373899-115374409
  hyper

SEQ ID NO: 21187 - DNA, 38 bp, Homo sapiens; identical to SEQ ID NO: 993
  chr11:115530058-115530096
  hyper

SEQ ID NO: 21188 - DNA, 50 bp, Homo sapiens; identical to SEQ ID NO: 3798
  chr11:115630424-115630474
  hyper

SEQ ID NO: 21189 - DNA, 74 bp, Homo sapiens
  chr11:115630910-115630984
  hyper
acagtggagccgccccctgctttgggaggagcaaaagagcctctcgcttgcctcccgctcgagctccttctcct

SEQ ID NO: 21190 - DNA, 36 bp, Homo sapiens; identical to SEQ ID NO: 11015
  chr11:116706540-116706576
  hyper

SEQ ID NO: 21191 - DNA, 30 bp, Homo sapiens; identical to SEQ ID NO: 11016
  chr11:117667351-117667381
  hyper

SEQ ID NO: 21192 - DNA, 40 bp, Homo sapiens; identical to SEQ ID NO: 11017
  chr11:117667865-117667905
  hyper

SEQ ID NO: 21193 - DNA, 40 bp, Homo sapiens; identical to SEQ ID NO: 11018
  chr11:118663162-118663202
  hyper

SEQ ID NO: 21194 - DNA, 177 bp, Homo sapiens; identical to SEQ ID NO: 11019
  chr11:119210471-119210648
  hyper

SEQ ID NO: 21195 - DNA, 32 bp, Homo sapiens; identical to SEQ ID NO: 11020
  chr11:119211201-119211233
  hyper

SEQ ID NO: 21196 - DNA, 18 bp, Homo sapiens
  chr11:119293352-119293370
  hyper
cggcactgcggcttcctt

SEQ ID NO: 21197 - DNA, 218 bp, Homo sapiens; identical to SEQ ID NO: 11023
  chr11:119293708-119293926
  hyper

SEQ ID NO: 21198 - DNA, 27 bp, Homo sapiens
  chr11:119612200-119612227
  hyper
gtccctgtccttccccgtgtgggacct

SEQ ID NO: 21199 - DNA, 25 bp, Homo sapiens
  chr11:119613075-119613100
  hyper
ctgggcgcgccggcctggggggaaa

SEQ ID NO: 21200 - DNA, 30 bp, Homo sapiens; identical to SEQ ID NO: 11027
  chr11:119613389-119613419
  hyper

SEQ ID NO: 21201 - DNA, 48 bp, Homo sapiens; identical to SEQ ID NO: 11028
  chr11:119884295-119884343
  hyper

SEQ ID NO: 21202 - DNA, 60 bp, Homo sapiens; identical to SEQ ID NO: 11029
  chr11:120110879-120110939
  hyper

SEQ ID NO: 21203 - DNA, 35 bp, Homo sapiens; identical to SEQ ID NO: 11030
  chr11:120382869-120382904
  hyper

SEQ ID NO: 21204 - DNA, 241 bp, Homo sapiens
  chr11:120435559-120435800
  hyper
cgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggc

SEQ ID NO: 21205 - DNA, 47 bp, Homo sapiens
  chr11:120435830-120435877
  hyper
tgcggagcccgcgtcatcctgcctgtggggagcgctgtgcctgctct

SEQ ID NO: 21206 - DNA, 92 bp, Homo sapiens; identical to SEQ ID NO: 11032
  chr11:121593544-121593636
  hyper

SEQ ID NO: 21207 - DNA, 95 bp, Homo sapiens
  chr11:122847170-122847265
  hyper
gaaactgcctagggccgaggggagggggcgtacgcgtaggagaacgcggtggcaaaccattcctggaaacgcgtgatcattcccagttttgccct

SEQ ID NO: 21208 - DNA, 62 bp, Homo sapiens
  chr11:122847696-122847758
  hyper
aacagggacgggagaggatggaagcgccgcccagagaaggagggagtcgccttagtatttga

SEQ ID NO: 21209 - DNA, 14 bp, Homo sapiens
  chr11:122848591-122848605
  hyper
gttttcacctgatt

SEQ ID NO: 21210 - DNA, 217 bp, Homo sapiens
  chr11:122850163-122850380
  hyper
ccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatcttt

SEQ ID NO: 21211 - DNA, 276 bp, Homo sapiens
  chr11:122850901-122851177
  hyper
gggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctt

SEQ ID NO: 21212 - DNA, 140 bp, Homo sapiens
  chr11:122852475-122852615
  hyper
gaggctcgaatctccgctgctctctcccgggcctgggctaccccgggcgctggagaggcaagaagacaagctcctgggtaggttgggtctctgtgttggagaattggcagcttggagaggggggccgggagagccaatga

SEQ ID NO: 21213 - DNA, 93 bp, Homo sapiens
  chr11:122854915-122855008
  hyper
ggccctgctctcaggcggagaagccaggagcgatgaggggcggggcggctcccggcgccctcttttccagccccgctcccgcgctgccgccgg

SEQ ID NO: 21214 - DNA, 5 bp, Homo sapiens
  chr11:122855043-122855048
  hyper
ggggc

SEQ ID NO: 21215 - DNA, 200 bp, Homo sapiens; identical to SEQ ID NO: 11041
  chr11:123065544-123065744
  hyper

SEQ ID NO: 21216 - DNA, 243 bp, Homo sapiens; identical to SEQ ID NO: 11042
  chr11:123172620-123172863
  hyper

SEQ ID NO: 21217 - DNA, 24 bp, Homo sapiens
  chr11:123172915-123172939
  hyper
cgtggttgacgaagccattccctc

SEQ ID NO: 21218 - DNA, 15 bp, Homo sapiens
  chr11:123228701-123228716
  hyper
ctttccataccttcc

SEQ ID NO: 21219 - DNA, 270 bp, Homo sapiens
  chr11:123228788-123229058
  hyper
cgttggtttccgcactaaacttgatggtctgattttaaaggttgattttaaagaaactgtctggttgtatgtccccgagttacactgcagtgctaaatgttggagcgaggcaataccgggagaatccaggctgcaggcttcacccagagagggagggtgaggggaggagagagacggagagaggagagagggggaatgaaaggggagagagagggaccaagaccggcgagcgggagacaggagcggaaaccacagaggtagagtcagggc

SEQ ID NO: 21220 - DNA, 41 bp, Homo sapiens; identical to SEQ ID NO: 11049
  chr11:123524936-123524977
  hyper

SEQ ID NO: 21221 - DNA, 152 bp, Homo sapiens; identical to SEQ ID NO: 11050
  chr11:124631577-124631729
  hyper

SEQ ID NO: 21222 - DNA, 32 bp, Homo sapiens; identical to SEQ ID NO: 11051
  chr11:124709117-124709149
  hyper

SEQ ID NO: 21223 - DNA, 126 bp, Homo sapiens; identical to SEQ ID NO: 11052
  chr11:124709539-124709665
  hyper

SEQ ID NO: 21224 - DNA, 49 bp, Homo sapiens; identical to SEQ ID NO: 11053
  chr11:124735054-124735103
  hyper

SEQ ID NO: 21225 - DNA, 442 bp, Homo sapiens
  chr11:124735482-124735924
  hyper
tacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgg

SEQ ID NO: 21226 - DNA, 74 bp, Homo sapiens; identical to SEQ ID NO: 11056
  chr11:124738461-124738535
  hyper

SEQ ID NO: 21227 - DNA, 22 bp, Homo sapiens
  chr11:124738755-124738777
  hyper
gctggtctcccgaggcgagccc

SEQ ID NO: 21228 - DNA, 204 bp, Homo sapiens; identical to SEQ ID NO: 11058
  chr11:124933444-124933648
  hyper

SEQ ID NO: 21229 - DNA, 71 bp, Homo sapiens
  chr11:125035692-125035763
  hyper
agagggaactgaaagcgatcgagagcggagagctgagggggatggcgcaggatcccgaatctgccgctcaa

SEQ ID NO: 21230 - DNA, 12 bp, Homo sapiens
  chr11:125036208-125036220
  hyper
tgaaagtagttg

SEQ ID NO: 21231 - DNA, 220 bp, Homo sapiens; identical to SEQ ID NO: 11060
  chr11:125365065-125365285
  hyper

SEQ ID NO: 21232 - DNA, 197 bp, Homo sapiens; identical to SEQ ID NO: 11061
  chr11:125365752-125365949
  hyper

SEQ ID NO: 21233 - DNA, 125 bp, Homo sapiens; identical to SEQ ID NO: 11062
  chr11:125366167-125366292
  hyper

SEQ ID NO: 21234 - DNA, 312 bp, Homo sapiens; identical to SEQ ID NO: 1004
  chr11:125774122-125774434
  hyper

SEQ ID NO: 21235 - DNA, 94 bp, Homo sapiens
  chr11:126870543-126870637
  hyper
gtggcttcggtctctttgtgcctctgggtatctgcagccagccgacacaaactgcctgttcttagccgcctcgggaagccgggattgtcagcaa

SEQ ID NO: 21236 - DNA, 204 bp, Homo sapiens
  chr11:126873186-126873390
  hyper
cctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagagg

SEQ ID NO: 21237 - DNA, 65 bp, Homo sapiens; identical to SEQ ID NO: 11068
  chr11:126873727-126873792
  hyper

SEQ ID NO: 21238 - DNA, 64 bp, Homo sapiens; identical to SEQ ID NO: 11069
  chr11:128556994-128557058
  hyper

SEQ ID NO: 21239 - DNA, 36 bp, Homo sapiens
  chr11:128562856-128562892
  hyper
cagagcgcgggcctccgggtctcaccccgggaaaag

SEQ ID NO: 21240 - DNA, 106 bp, Homo sapiens
  chr11:128563730-128563836
  hyper
tgtgtgatgcgaaaagcaggaccagcaggggaggaagagggggtgtggggggggagggaagacgagggagagcagaggggagagaagagagaggagagctcgaggc

SEQ ID NO: 21241 - DNA, 44 bp, Homo sapiens
  chr11:128563896-128563940
  hyper
cctccccgattcgcaaagtgaagtcacttcccaaaattagctga

SEQ ID NO: 21242 - DNA, 67 bp, Homo sapiens
  chr11:128564329-128564396
  hyper
tcctactcgcgggccagccggccaggcgcccgcattgagggcgaccctcccccgaaatcccagcccc

SEQ ID NO: 21243 - DNA, 55 bp, Homo sapiens
  chr11:128564685-128564740
  hyper
tgcaagtgagtgtgtcgggggatctatctgagcgggctcctccagatggaagccc

SEQ ID NO: 21244 - DNA, 93 bp, Homo sapiens
  chr11:129242783-129242876
  hyper
gagagaaaacagaagcgggaaattcgacagaggaggagaggcccaaagggcggggagcaatgcggggaagggagaagtgggagggaagaagag

SEQ ID NO: 21245 - DNA, 67 bp, Homo sapiens
  chr11:129243587-129243654
  hyper
tcaaagacgcgttgcgggccttgtctaatgctaggctgtgacttggcctcttaacatctattttctc

SEQ ID NO: 21246 - DNA, 41 bp, Homo sapiens
  chr11:129244603-129244644
  hyper
tttataaacaatgttttaaaaaaaaccgcacacttttttaa

SEQ ID NO: 21247 - DNA, 32 bp, Homo sapiens; identical to SEQ ID NO: 11083
  chr11:132864177-132864209
  hyper

SEQ ID NO: 21248 - DNA, 41 bp, Homo sapiens; identical to SEQ ID NO: 11084
  chr11:132934044-132934085
  hyper

SEQ ID NO: 21249 - DNA, 83 bp, Homo sapiens; identical to SEQ ID NO: 11085
  chr11:132934490-132934573
  hyper

SEQ ID NO: 21250 - DNA, 216 bp, Homo sapiens
  chr11:132952552-132952768
  hyper
gccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgac

SEQ ID NO: 21251 - DNA, 38 bp, Homo sapiens
  chr11:133402168-133402206
  hyper
gagcagggcagttgtcgccgagaagacgacccagtagg

SEQ ID NO: 21252 - DNA, 30 bp, Homo sapiens
  chr11:133402260-133402290
  hyper
ttctgctgctgctaccgctgctgccttcct

SEQ ID NO: 21253 - DNA, 126 bp, Homo sapiens; identical to SEQ ID NO: 11090
  chr11:133826138-133826264
  hyper

SEQ ID NO: 21254 - DNA, 80 bp, Homo sapiens; identical to SEQ ID NO: 11091
  chr11:133826978-133827058
  hyper

SEQ ID NO: 21255 - DNA, 32 bp, Homo sapiens
  chr11:133906918-133906950
  hyper
cctcgctgcagacggttcgccttgtccactct

SEQ ID NO: 21256 - DNA, 16 bp, Homo sapiens
  chr11:133938772-133938788
  hyper
agagaacccatgtgcc

SEQ ID NO: 21257 - DNA, 213 bp, Homo sapiens
  chr11:133938789-133939002
  hyper
gtccagagcatcgctgcatccgtaagcagctagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcga

SEQ ID NO: 21258 - DNA, 204 bp, Homo sapiens
  chr11:133939177-133939381
  hyper
tcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgt

SEQ ID NO: 21259 - DNA, 44 bp, Homo sapiens; identical to SEQ ID NO: 11096
  chr11:133994700-133994744
  hyper

SEQ ID NO: 21260 - DNA, 50 bp, Homo sapiens
  chr11:134145653-134145703
  hyper
tcagcctgaaacatgcggcctcccggactcctctctgtgtcaccgacctc

SEQ ID NO: 21261 - DNA, 34 bp, Homo sapiens
  chr11:134146393-134146427
  hyper
aacacctggagcgccggcggagctcggctgtccc

SEQ ID NO: 21262 - DNA, 232 bp, Homo sapiens; identical to SEQ ID NO: 1015
  chr11:134146444-134146676
  hyper

SEQ ID NO: 21263 - DNA, 5 bp, Homo sapiens
  chr11:134146677-134146682
  hyper
tcccg

SEQ ID NO: 21264 - DNA, 12 bp, Homo sapiens
  chr11:134201829-134201841
  hyper
tgagcgccggcg

SEQ ID NO: 21265 - DNA, 24 bp, Homo sapiens
  chr11:134202084-134202108
  hyper
ccagccctccgcacctcgggttct

SEQ ID NO: 21266 - DNA, 22 bp, Homo sapiens
  chr11:134281509-134281531
  hyper
ccagcccgagctcggttctcgg

SEQ ID NO: 21267 - DNA, 52 bp, Homo sapiens; identical to SEQ ID NO: 11102
  chr11:134281591-134281643
  hyper

SEQ ID NO: 21268 - DNA, 70 bp, Homo sapiens; identical to SEQ ID NO: 11103
  chr11:134282862-134282932
  hyper

SEQ ID NO: 21269 - DNA, 32 bp, Homo sapiens; identical to SEQ ID NO: 11104
  chr12:1059315-1059347
  hyper

SEQ ID NO: 21270 - DNA, 28 bp, Homo sapiens
  chr12:1639107-1639135
  hyper
cgctcgtgccaggatcgcggggcgcggg

SEQ ID NO: 21271 - DNA, 129 bp, Homo sapiens
  chr12:1639222-1639351
  hyper
gggggcagcaggcgtgcggcgccgggagaagggggccgggcggcggagactccccgtccgcacccccgcggcgaggcccccgggccgctctgcttaggggccgagggagccgggcgggaggcaggtgcg

SEQ ID NO: 21272 - DNA, 197 bp, Homo sapiens; identical to SEQ ID NO: 11106
  chr12:2161529-2161726
  hyper

SEQ ID NO: 21273 - DNA, 22 bp, Homo sapiens
  chr12:2162817-2162839
  hyper
tttccaccgggttcctgcccta

SEQ ID NO: 21274 - DNA, 54 bp, Homo sapiens
  chr12:2163110-2163164
  hyper
ggctgcctggccagccgcgcggggggcagagggcgccggcgccgcggagcccag

SEQ ID NO: 21275 - DNA, 234 bp, Homo sapiens
  chr12:2163276-2163510
  hyper
cggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 21276 - DNA, 39 bp, Homo sapiens; identical to SEQ ID NO: 11109
  chr12:2800124-2800163
  hyper

SEQ ID NO: 21277 - DNA, 37 bp, Homo sapiens
  chr12:2862031-2862068
  hyper
ggcccccagtggcaacggtgagagcagtggcccagaa

SEQ ID NO: 21278 - DNA, 30 bp, Homo sapiens; identical to SEQ ID NO: 11111
  chr12:2862442-2862472
  hyper

SEQ ID NO: 21279 - DNA, 53 bp, Homo sapiens; identical to SEQ ID NO: 11112
  chr12:3475605-3475658
  hyper

SEQ ID NO: 21280 - DNA, 61 bp, Homo sapiens; identical to SEQ ID NO: 3838
  chr12:3600168-3600229
  hyper

SEQ ID NO: 21281 - DNA, 85 bp, Homo sapiens
  chr12:3600230-3600315
  hyper
gagactaggggagggggcgggcccgggggcgctgggggccctcggtctgcgcccagccgccgccggctccagcgaacctcctacc

SEQ ID NO: 21282 - DNA, 15 bp, Homo sapiens
  chr12:3600768-3600783
  hyper
tcaccaaacccttgc

SEQ ID NO: 21283 - DNA, 30 bp, Homo sapiens; identical to SEQ ID NO: 11116
  chr12:3601542-3601572
  hyper

SEQ ID NO: 21284 - DNA, 108 bp, Homo sapiens
  chr12:3602162-3602270
  hyper
gagttcttaactctgcgctaaaacccctaccccacggcgtaggcagcaaagctttataaatcccccttctctgagagactagaagcagcatgcatctgacaattgtca

SEQ ID NO: 21285 - DNA, 83 bp, Homo sapiens
  chr12:4274188-4274271
  hyper
ggggtgccccagctcttccacccaggccgctccccgagcccagctccccgcgcccctctctctatccaggagagacgcattgg

SEQ ID NO: 21286 - DNA, 271 bp, Homo sapiens
  chr12:4377981-4378252
  hyper
gcagcaaaattcatccgatatcgctcacaatgcatgcacgggttatcttacatgtaatagccatcgtattaaccaacccagctgatactgagatggtgaatggggcgggggagcagggaggaatatgtcgcgcatgaaaaactccgggtgtaaaagtcaatgcagaactcactccccgaggaaccgaaaaagacattcacgactctcaagtggagagaggatagaaagtcaagtggcgggggtcgcgaccagtgatcgggatttcagtctg

SEQ ID NO: 21287 - DNA, 198 bp, Homo sapiens
  chr12:4378330-4378528
  hyper
agtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgc

SEQ ID NO: 21288 - DNA, 551 bp, Homo sapiens
  chr12:4378806-4379357
  hyper
agagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctcc

SEQ ID NO: 21289 - DNA, 244 bp, Homo sapiens
  chr12:4379491-4379735
  hyper
ttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatca

SEQ ID NO: 21290 - DNA, 203 bp, Homo sapiens
  chr12:4383784-4383987
  hyper
aaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctc

SEQ ID NO: 21291 - DNA, 83 bp, Homo sapiens
  chr12:5017990-5018073
  hyper
gtaggcgggaggcaacggtggtgagaagggtggtcccaaggccgcgggaggagccaatcagcggcgactctgggctcttgcag

SEQ ID NO: 21292 - DNA, 106 bp, Homo sapiens
  chr12:5018692-5018798
  hyper
tgggactgcacaaaagcaaacccgtcggaggagttttgccagaaacaccaccgcctgcattgcgtcggacctgaccatttccaatgtgaaattcccggggaaggtc

SEQ ID NO: 21293 - DNA, 6 bp, Homo sapiens
  chr12:5018799-5018805
  hyper
cgagcc

SEQ ID NO: 21294 - DNA, 229 bp, Homo sapiens; identical to SEQ ID NO: 1020
  chr12:5018806-5019035
  hyper

SEQ ID NO: 21295 - DNA, 12 bp, Homo sapiens
  chr12:5541088-5541100
  hyper
aaatgacccctt

SEQ ID NO: 21296 - DNA, 146 bp, Homo sapiens; identical to SEQ ID NO: 11131
  chr12:5541504-5541650
  hyper

SEQ ID NO: 21297 - DNA, 235 bp, Homo sapiens
  chr12:5542090-5542325
  hyper
gcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcg

SEQ ID NO: 21298 - DNA, 320 bp, Homo sapiens
  chr12:5542439-5542759
  hyper
cggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacg

SEQ ID NO: 21299 - DNA, 138 bp, Homo sapiens
  chr12:6664370-6664508
  hyper
cgttgtgagtggtatgacacagagagacctgtccccctttcccaatccctacctccgcttgtactcgtcccgctcccgcttcactttggccagcacgttgtagagagcgcggatctcgggcgtgatggtgtcgatctg

SEQ ID NO: 21300 - DNA, 32 bp, Homo sapiens; identical to SEQ ID NO: 11134
  chr12:8123148-8123180
  hyper

SEQ ID NO: 21301 - DNA, 39 bp, Homo sapiens
  chr12:8171321-8171360
  hyper
gcccggcagtgacagcgaccgcgccgctgcgctcccgcc

SEQ ID NO: 21302 - DNA, 57 bp, Homo sapiens; identical to SEQ ID NO: 11136
  chr12:10306356-10306413
  hyper

SEQ ID NO: 21303 - DNA, 48 bp, Homo sapiens; identical to SEQ ID NO: 11137
  chr12:11653509-11653557
  hyper

SEQ ID NO: 21304 - DNA, 30 bp, Homo sapiens; identical to SEQ ID NO: 11138
  chr12:11653758-11653788
  hyper

SEQ ID NO: 21305 - DNA, 30 bp, Homo sapiens; identical to SEQ ID NO: 11139
  chr12:12869188-12869218
  hyper

SEQ ID NO: 21306 - DNA, 49 bp, Homo sapiens; identical to SEQ ID NO: 11140
  chr12:13154617-13154666
  hyper

SEQ ID NO: 21307 - DNA, 50 bp, Homo sapiens; identical to SEQ ID NO: 11142
  chr12:14134167-14134217
  hyper

SEQ ID NO: 21308 - DNA, 633 bp, Homo sapiens
  chr12:14134478-14135111
  hyper
gcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtg

SEQ ID NO: 21309 - DNA, 218 bp, Homo sapiens; identical to SEQ ID NO: 11144
  chr12:15374309-15374527
  hyper

SEQ ID NO: 21310 - DNA, 30 bp, Homo sapiens; identical to SEQ ID NO: 11145
  chr12:16500494-16500524
  hyper

SEQ ID NO: 21311 - DNA, 107 bp, Homo sapiens; identical to SEQ ID NO: 11146
  chr12:16757928-16758035
  hyper

SEQ ID NO: 21312 - DNA, 39 bp, Homo sapiens; identical to SEQ ID NO: 11147
  chr12:20521231-20521270
  hyper

SEQ ID NO: 21313 - DNA, 94 bp, Homo sapiens
  chr12:20522363-20522457
  hyper
acctggtgctgcagccgctccggagctctcggaaactttcctccgcgctgtgcgcgggctccctgtcctttctgctggcgctgctggtgaggct

SEQ ID NO: 21314 - DNA, 30 bp, Homo sapiens
  chr12:20522739-20522769
  hyper
ccagattgggctgggcgtcggggaggatca

SEQ ID NO: 21315 - DNA, 337 bp, Homo sapiens
  chr12:21680683-21681020
  hyper
cagagccggagaaaggacctctccgaccggccactgccgggtgagtgaccaagggtgcaagggcgctagtcctgcgcttttggaataggatggggcgggcagggcttgctccgcgctggtgccgaaagaaagcgtctcctcaccggaaagacgcggctctgaggcgccctcagatacagtccgcccgagggcagcccgggttggcagcagcagcagctggatgccgagcgccggagctgggagctcgcgcgtccagccccgcgccaatggtggcaagggcggcccaggctggcgctgcggctccccaagccttattggcttgcggctgttcagccag

SEQ ID NO: 21316 - DNA, 85 bp, Homo sapiens; identical to SEQ ID NO: 11152
  chr12:21927273-21927358
  hyper

SEQ ID NO: 21317 - DNA, 30 bp, Homo sapiens; identical to SEQ ID NO: 11153
  chr12:21927922-21927952
  hyper

SEQ ID NO: 21318 - DNA, 238 bp, Homo sapiens
  chr12:22094810-22095048
  hyper
actgcgtaaacagtcaccctcttctcctgtttccaaccagagacataattaactctcgagataacgtgtttatattaagatcaccccacaaccactcccccgcgaaacacaagccgtgaattttgtccccgacaaccctctttaattaacaccggattttctcaagagccagttttgagtcagcttgagataagcattgttttcaggaactgtcgtattttaataaaggatggtcagc

SEQ ID NO: 21319 - DNA, 575 bp, Homo sapiens; identical to SEQ ID NO: 11159
  chr12:22487691-22488266
  hyper

SEQ ID NO: 21320 - DNA, 322 bp, Homo sapiens; identical to SEQ ID NO: 11160
  chr12:22488339-22488661
  hyper

SEQ ID NO: 21321 - DNA, 92 bp, Homo sapiens; identical to SEQ ID NO: 11161
  chr12:24714812-24714904
  hyper

SEQ ID NO: 21322 - DNA, 30 bp, Homo sapiens; identical to SEQ ID NO: 11162
  chr12:24715353-24715383
  hyper

SEQ ID NO: 21323 - DNA, 1 bp, Homo sapiens
  chr12:24716032-24716033
  hyper
t

SEQ ID NO: 21324 - DNA, 199 bp, Homo sapiens
  chr12:24716218-24716417
  hyper
cgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggtggttgaactggtttggttttgtgttaagcgaagccaaaaaaaa

SEQ ID NO: 21325 - DNA, 195 bp, Homo sapiens
  chr12:25101397-25101592
  hyper
cctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgta

SEQ ID NO: 21326 - DNA, 259 bp, Homo sapiens
  chr12:25101660-25101919
  hyper
ggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagg

SEQ ID NO: 21327 - DNA, 219 bp, Homo sapiens; identical to SEQ ID NO: 11168
  chr12:28122168-28122387
  hyper

SEQ ID NO: 21328 - DNA, 224 bp, Homo sapiens
  chr12:29937107-29937331
  hyper
ctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctc

SEQ ID NO: 21329 - DNA, 28 bp, Homo sapiens
  chr12:29937374-29937402
  hyper
ctgcccgggctttctctcacccgcccgg

SEQ ID NO: 21330 - DNA, 9 bp, Homo sapiens
  chr12:30323517-30323526
  hyper
cttctgccc

SEQ ID NO: 21331 - DNA, 184 bp, Homo sapiens
  chr12:30975388-30975572
  hyper
cgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccg

SEQ ID NO: 21332 - DNA, 165 bp, Homo sapiens
  chr12:31079499-31079664
  hyper
agccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccc

SEQ ID NO: 21333 - DNA, 117 bp, Homo sapiens; identical to SEQ ID NO: 3868
  chr12:31079693-31079810
  hyper

SEQ ID NO: 21334 - DNA, 28 bp, Homo sapiens
  chr12:33592057-33592085
  hyper
cggcgccgggaggcgggaagcggaccag

SEQ ID NO: 21335 - DNA, 73 bp, Homo sapiens; identical to SEQ ID NO: 11184
  chr12:33592961-33593034
  hyper

SEQ ID NO: 21336 - DNA, 40 bp, Homo sapiens; identical to SEQ ID NO: 11185
  chr12:33593092-33593132
  hyper

SEQ ID NO: 21337 - DNA, 30 bp, Homo sapiens; identical to SEQ ID NO: 11186
  chr12:39298600-39298630
  hyper

SEQ ID NO: 21338 - DNA, 82 bp, Homo sapiens
  chr12:39299560-39299642
  hyper
ggcgcgcggggatcccggtttcccagcccccttccggcaggcagcagcccgggcgggggacacactccgtgatcccctcctg

SEQ ID NO: 21339 - DNA, 30 bp, Homo sapiens; identical to SEQ ID NO: 11188
  chr12:39300375-39300405
  hyper

SEQ ID NO: 21340 - DNA, 41 bp, Homo sapiens; identical to SEQ ID NO: 11189
  chr12:40618628-40618669
  hyper

SEQ ID NO: 21341 - DNA, 1 bp, Homo sapiens
  chr12:41086182-41086183
  hyper
t

SEQ ID NO: 21342 - DNA, 40 bp, Homo sapiens
  chr12:41582473-41582513
  hyper
ctcatccagaagctgcgagtccagtgcgactaccgcgccc

SEQ ID NO: 21343 - DNA, 241 bp, Homo sapiens; identical to SEQ ID NO: 11193
  chr12:41583049-41583290
  hyper

SEQ ID NO: 21344 - DNA, 443 bp, Homo sapiens; identical to SEQ ID NO: 11194
  chr12:42983315-42983758
  hyper

SEQ ID NO: 21345 - DNA, 117 bp, Homo sapiens; identical to SEQ ID NO: 11196
  chr12:43945664-43945781
  hyper

SEQ ID NO: 21346 - DNA, 121 bp, Homo sapiens
  chr12:43946298-43946419
  hyper
gggttttgagctcttagatgaaatgacaagcatcagatagaacgtttctgttttttatgttttacggtacttttaggcttctcaaacaaaataaaataagctacaacggaagttcttgtag

SEQ ID NO: 21347 - DNA, 101 bp, Homo sapiens; identical to SEQ ID NO: 11198
  chr12:45269011-45269112
  hyper

SEQ ID NO: 21348 - DNA, 10 bp, Homo sapiens
  chr12:45269494-45269504
  hyper
gacctacttt

SEQ ID NO: 21349 - DNA, 32 bp, Homo sapiens
  chr12:45269624-45269656
  hyper
atgttctcagtaagacccgagactccatggtg

SEQ ID NO: 21350 - DNA, 35 bp, Homo sapiens; identical to SEQ ID NO: 11200
  chr12:45270707-45270742
  hyper

SEQ ID NO: 21351 - DNA, 141 bp, Homo sapiens
  chr12:45445258-45445399
  hyper
agtcccccaggcgtggggtctggtggacgctggcctggagcgcccggagggcggggtgggggtgggggggacgcgctgtcgtctggggtgtctccgcgtactcctgttgggcgaaccctggctctccggtgttggttgtca

SEQ ID NO: 21352 - DNA, 36 bp, Homo sapiens
  chr12:47225579-47225615
  hyper
cagcaggatcccgggcggtcgcggagccagctcccg

SEQ ID NO: 21353 - DNA, 51 bp, Homo sapiens; identical to SEQ ID NO: 11207
  chr12:48396843-48396894
  hyper

SEQ ID NO: 21354 - DNA, 72 bp, Homo sapiens
  chr12:48397123-48397195
  hyper
acaccacgcagcctggctcggtgagttccagaatttagaaaagtaactcattgtagtacctcggggcggcgg

SEQ ID NO: 21355 - DNA, 280 bp, Homo sapiens
  chr12:48398070-48398350
  hyper
gcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgcccccc

SEQ ID NO: 21356 - DNA, 374 bp, Homo sapiens; identical to SEQ ID NO: 11209
  chr12:48577898-48578272
  hyper

SEQ ID NO: 21357 - DNA, 8 bp, Homo sapiens
  chr12:49366423-49366431
  hyper
ctcaccct

SEQ ID NO: 21358 - DNA, 275 bp, Homo sapiens; identical to SEQ ID NO: 11212
  chr12:49374100-49374375
  hyper

SEQ ID NO: 21359 - DNA, 53 bp, Homo sapiens
  chr12:49375119-49375172
  hyper
gctgctgcgcctggagccggaagacccggcccacaaaccgccctccccccacg

SEQ ID NO: 21360 - DNA, 23 bp, Homo sapiens
  chr12:49390850-49390873
  hyper
gtccgcgcccagccccggccggc

SEQ ID NO: 21361 - DNA, 57 bp, Homo sapiens
  chr12:49391877-49391934
  hyper
gagtcgcagctggggctgatgaagtgggcacctgagagttcccggggcctctcttag

SEQ ID NO: 21362 - DNA, 239 bp, Homo sapiens; identical to SEQ ID NO: 11218
  chr12:49483977-49484216
  hyper

SEQ ID NO: 21363 - DNA, 272 bp, Homo sapiens
  chr12:49730090-49730362
  hyper
ttggcgcctggcgggaaggggggcacggaagcaggcgcgccgtcgggaccagggccacggggcccatgcgggtcgcacaccatgcggcagcgacccagcatctcgtagtgcgctggcccgcgggagctgtgcaccagcagcgggatggccaccagcagcagcagcaccatggccactccgacggccgcgcccgccaccctcttgcggcggctcagccgcgacgctgccagggccagcaaatcttcctcactcttgggcgcaatggctgccgg

SEQ ID NO: 21364 - DNA, 36 bp, Homo sapiens
  chr12:50297461-50297497
  hyper
aggggaggatgctttcgtggtccagagggcttgctg

SEQ ID NO: 21365 - DNA, 33 bp, Homo sapiens
  chr12:50298055-50298088
  hyper
ctcctccctctttggatgcggccctgatttctg

SEQ ID NO: 21366 - DNA, 186 bp, Homo sapiens; identical to SEQ ID NO: 11223
  chr12:50355598-50355784
  hyper

SEQ ID NO: 21367 - DNA, 41 bp, Homo sapiens
  chr12:50426799-50426840
  hyper
catcgacgatccctggacgcgggcgtcgggggcagggaggc

SEQ ID NO: 21368 - DNA, 51 bp, Homo sapiens; identical to SEQ ID NO: 11225
  chr12:50444372-50444423
  hyper

SEQ ID NO: 21369 - DNA, 41 bp, Homo sapiens; identical to SEQ ID NO: 11226
  chr12:52208682-52208723
  hyper

SEQ ID NO: 21370 - DNA, 23 bp, Homo sapiens
  chr12:52262960-52262983
  hyper
ctctcggttcacccccgcactcg

SEQ ID NO: 21371 - DNA, 88 bp, Homo sapiens
  chr12:52301192-52301280
  hyper
tgggcaataaggaaacggtttattaggagggagtggtggagctgggccaggcaggaagacgctggaataagaaacatttttgctccag

SEQ ID NO: 21372 - DNA, 122 bp, Homo sapiens
  chr12:52400709-52400831
  hyper
gacccgcggcccgcccggctggcatcccccagccgccgccagccccgccgaggggagccagcgccgtctctgaggggcgtccggcgccggagccatgaccctccgccgactcaggaagctgc

SEQ ID NO: 21373 - DNA, 12 bp, Homo sapiens
  chr12:52652141-52652153
  hyper
gtccgcaggagc

SEQ ID NO: 21374 - DNA, 211 bp, Homo sapiens; identical to SEQ ID NO: 11234
  chr12:52702362-52702573
  hyper

SEQ ID NO: 21375 - DNA, 9 bp, Homo sapiens
  chr12:53108080-53108089
  hyper
actggggtc

SEQ ID NO: 21376 - DNA, 248 bp, Homo sapiens
  chr12:53108218-53108466
  hyper
gccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggca

SEQ ID NO: 21377 - DNA, 15 bp, Homo sapiens
  chr12:53359301-53359316
  hyper
tagggagctgctccc

SEQ ID NO: 21378 - DNA, 48 bp, Homo sapiens; identical to SEQ ID NO: 11239
  chr12:54145906-54145954
  hyper

SEQ ID NO: 21379 - DNA, 30 bp, Homo sapiens; identical to SEQ ID NO: 11241
  chr12:54322140-54322170
  hyper

SEQ ID NO: 21380 - DNA, 236 bp, Homo sapiens; identical to SEQ ID NO: 11242
  chr12:54324560-54324796
  hyper

SEQ ID NO: 21381 - DNA, 68 bp, Homo sapiens
  chr12:54333337-54333405
  hyper
ctgggctctctccaatggctgggacagtcaggtgtactgctccaaggagcagtcgcagtccgcccacc

SEQ ID NO: 21382 - DNA, 147 bp, Homo sapiens
  chr12:54343665-54343812
  hyper
acacagaggaggtgtcgtctccagtctagacaagggcgctaataacgcccataaaaggcggcctctccagagatgctctggcaactccgctcccgcgcgcctgccgctggccgctttctccacctccccccgccccgcccttctctg

SEQ ID NO: 21383 - DNA, 73 bp, Homo sapiens
  chr12:54354621-54354694
  hyper
agagcagagcagggaccgctggccccggtccgcgaacaaagcaaactccggggacttggggttccggccaggc

SEQ ID NO: 21384 - DNA, 38 bp, Homo sapiens; identical to SEQ ID NO: 1043
  chr12:54354814-54354852
  hyper

SEQ ID NO: 21385 - DNA, 19 bp, Homo sapiens
  chr12:54359664-54359683
  hyper
ttgctctccctcgcccggg

SEQ ID NO: 21386 - DNA, 30 bp, Homo sapiens; identical to SEQ ID NO: 11257
  chr12:54366936-54366966
  hyper

SEQ ID NO: 21387 - DNA, 95 bp, Homo sapiens; identical to SEQ ID NO: 11258
  chr12:54367200-54367295
  hyper

SEQ ID NO: 21388 - DNA, 39 bp, Homo sapiens; identical to SEQ ID NO: 11259
  chr12:54367525-54367564
  hyper

SEQ ID NO: 21389 - DNA, 64 bp, Homo sapiens
  chr12:54378115-54378179
  hyper
tctggcttcctctttcccctaccccgcgtccattcggaacctccttttccgagcagccatgaag

SEQ ID NO: 21390 - DNA, 256 bp, Homo sapiens
  chr12:54387959-54388215
  hyper
tcccgagaacaggtgaagaagacggcggcagcggggactgggggcttcgggtgggaacgccagggctcagggctttgtgtgggtcgtgcagggggcgaggttcgaagtcctgggctggaccgcagcacgagtgtggcccggacggctgcgtggccagaaggggtgttcgggcagggtgcgagagcaccggcaaggtggattgtgtatggactttggccgcagacagagcagagcgggctcccgggctgtggccggc

SEQ ID NO: 21391 - DNA, 64 bp, Homo sapiens
  chr12:54388245-54388309
  hyper
tagaaaggaccttgaggtctgctgggtgtttgggctgccctgggggcggcggcccagagtgtgg

SEQ ID NO: 21392 - DNA, 30 bp, Homo sapiens; identical to SEQ ID NO: 11265
  chr12:54388653-54388683
  hyper

SEQ ID NO: 21393 - DNA, 11 bp, Homo sapiens
  chr12:54391403-54391414
  hyper
tccctctctgc

SEQ ID NO: 21394 - DNA, 40 bp, Homo sapiens
  chr12:54393684-54393724
  hyper
accggtgccttgggtccagagttccggacccccaggaaat

SEQ ID NO: 21395 - DNA, 152 bp, Homo sapiens
  chr12:54393798-54393950
  hyper
cgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatctt

SEQ ID NO: 21396 - DNA, 248 bp, Homo sapiens
  chr12:54394162-54394410
  hyper
cgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgccc

SEQ ID NO: 21397 - DNA, 195 bp, Homo sapiens; identical to SEQ ID NO: 11269
  chr12:54394466-54394661
  hyper

SEQ ID NO: 21398 - DNA, 137 bp, Homo sapiens
  chr12:54398959-54399096
  hyper
tcccagcccagcctgcaggtcaggattggaatcattttttattcgctatcatttacgaattaacaacacaacacgcatctggggaaagaaatgaaagctgggggtagagaggggctagcaaacgccctcttccccta

SEQ ID NO: 21399 - DNA, 76 bp, Homo sapiens
  chr12:54399540-54399616
  hyper
gaggactttagggtgcgcgccgcgggcaagccgtcgtgggagcctcggagcgtgcatccgcgttcgcggagatgtt

SEQ ID NO: 21400 - DNA, 14 bp, Homo sapiens
  chr12:54402676-54402690
  hyper
tcatgtcgtggatt

SEQ ID NO: 21401 - DNA, 211 bp, Homo sapiens
  chr12:54402856-54403067
  hyper
ccgcgccccagccccgggagctctgctgatccggccgagctcagcaccgaggcgccccccaacctgcccagcccccagcccaccagcccagcccagtcccggggagccagctggcctggggttcggtcccggggggaggggagtttcgggggtactgggcggggtactcgtgagccagaggggagggggccgcgggttttcatgtacccag

SEQ ID NO: 21402 - DNA, 68 bp, Homo sapiens
  chr12:54408343-54408411
  hyper
agcattaaatggctccgaagggcctcgccgccttttccccacaccaaatgtgccatttatcccttgtc

SEQ ID NO: 21403 - DNA, 22 bp, Homo sapiens
  chr12:54425119-54425141
  hyper
gaccgcgggactggagccctgt

SEQ ID NO: 21404 - DNA, 30 bp, Homo sapiens; identical to SEQ ID NO: 11276
  chr12:54440926-54440956
  hyper

SEQ ID NO: 21405 - DNA, 129 bp, Homo sapiens; identical to SEQ ID NO: 11278
  chr12:54520065-54520194
  hyper

SEQ ID NO: 21406 - DNA, 129 bp, Homo sapiens; identical to SEQ ID NO: 11279
  chr12:54520221-54520350
  hyper

SEQ ID NO: 21407 - DNA, 35 bp, Homo sapiens
  chr12:54520710-54520745
  hyper
aacttgggggaacttcggaaaagttttttgagggg

SEQ ID NO: 21408 - DNA, 92 bp, Homo sapiens
  chr12:54520868-54520960
  hyper
aaaaacccagccgcgtcccaaacccgctcaccccagcaggcccttagagacgcttggagatccccagacacgccccgcggaaagggaaggaa

SEQ ID NO: 21409 - DNA, 169 bp, Homo sapiens
  chr12:54812069-54812238
  hyper
cagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggc

SEQ ID NO: 21410 - DNA, 263 bp, Homo sapiens
  chr12:54812359-54812622
  hyper
cccccaaaagcccttcccggcctctgcgccccctctgcgcccccacccgccccaggtcccagcagcccacagacttcagccagagaccctcagctctccattcacgcgctctcctctcccttggcccggagacccctgcccagacttctccagctccgtgtcctctccccaccggacacatgtctccccactgatctcaaacgccagggcccctcctcacccgccacggtgccctccctactccagcgcgggcccccaactct

SEQ ID NO: 21411 - DNA, 37 bp, Homo sapiens; identical to SEQ ID NO: 11282
  chr12:54943371-54943408
  hyper

SEQ ID NO: 21412 - DNA, 14 bp, Homo sapiens
  chr12:57619110-57619124
  hyper
gggcctgtccccca

SEQ ID NO: 21413 - DNA, 37 bp, Homo sapiens; identical to SEQ ID NO: 11284
  chr12:57870111-57870148
  hyper

SEQ ID NO: 21414 - DNA, 236 bp, Homo sapiens
  chr12:57943845-57944081
  hyper
gacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagc

SEQ ID NO: 21415 - DNA, 68 bp, Homo sapiens
  chr12:57944117-57944185
  hyper
gctgagattctgcggggagacaagttcatccccattttccaaggggacgacagcgtcgttattggggt

SEQ ID NO: 21416 - DNA, 94 bp, Homo sapiens; identical to SEQ ID NO: 11286
  chr12:58004814-58004908
  hyper

SEQ ID NO: 21417 - DNA, 158 bp, Homo sapiens; identical to SEQ ID NO: 11287
  chr12:58015011-58015169
  hyper

SEQ ID NO: 21418 - DNA, 27 bp, Homo sapiens
  chr12:58021293-58021320
  hyper
ccgctggcggctgggcgcgggtgcagc

SEQ ID NO: 21419 - DNA, 156 bp, Homo sapiens; identical to SEQ ID NO: 11290
  chr12:58026100-58026256
  hyper

SEQ ID NO: 21420 - DNA, 15 bp, Homo sapiens
  chr12:62584823-62584838
  hyper
cgcccctaccctgac

SEQ ID NO: 21421 - DNA, 30 bp, Homo sapiens; identical to SEQ ID NO: 11293
  chr12:62829269-62829299
  hyper

SEQ ID NO: 21422 - DNA, 146 bp, Homo sapiens; identical to SEQ ID NO: 1050
  chr12:63544728-63544874
  hyper

SEQ ID NO: 21423 - DNA, 36 bp, Homo sapiens
  chr12:64061785-64061821
  hyper
aagaaaagcgccatgcggctccctcctagggctctc

SEQ ID NO: 21424 - DNA, 164 bp, Homo sapiens
  chr12:64062205-64062369
  hyper
caggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccc

SEQ ID NO: 21425 - DNA, 343 bp, Homo sapiens
  chr12:64062578-64062921
  hyper
ccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacacgttaattaacgaggtattaaagggaaagatctcagctgaaagaaatgactgtaggaagtgtgtcag

SEQ ID NO: 21426 - DNA, 55 bp, Homo sapiens
  chr12:64063096-64063151
  hyper
cagagcctcaggttgacgccacttccttggcacgggacagcgtttactgaatctt

SEQ ID NO: 21427 - DNA, 144 bp, Homo sapiens
  chr12:64784390-64784534
  hyper
agctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccag

SEQ ID NO: 21428 - DNA, 25 bp, Homo sapiens
  chr12:65219156-65219181
  hyper
gttccaggctcgcaggaagccagac

SEQ ID NO: 21429 - DNA, 93 bp, Homo sapiens
  chr12:65220112-65220205
  hyper
ctatgagaaggcaatcggcatgatgcccagcaggtgccccggaaaagtcagaagagcatattggtcagacatacagggaatccttgtagtgtg

SEQ ID NO: 21430 - DNA, 89 bp, Homo sapiens
  chr12:65220350-65220439
  hyper
aaacactcccgtggccgttgttatcaccgttctatgtttgggcaggacttcgtttaaaccacctcagagagaggcggatccatgtggta

SEQ ID NO: 21431 - DNA, 28 bp, Homo sapiens
  chr12:65514835-65514863
  hyper
ttgcctggtgagcatcgatccataggta

SEQ ID NO: 21432 - DNA, 151 bp, Homo sapiens; identical to SEQ ID NO: 11310
  chr12:66122419-66122570
  hyper

SEQ ID NO: 21433 - DNA, 48 bp, Homo sapiens; identical to SEQ ID NO: 11313
  chr12:66135151-66135199
  hyper

SEQ ID NO: 21434 - DNA, 117 bp, Homo sapiens; identical to SEQ ID NO: 11314
  chr12:66135452-66135569
  hyper

SEQ ID NO: 21435 - DNA, 82 bp, Homo sapiens
  chr12:66136014-66136096
  hyper
ggtcgcgccggcgcacgctcgtccccttctgccccggagcccgcccgcgccgcacggtggccccttgcgctggcctgatcgt

SEQ ID NO: 21436 - DNA, 72 bp, Homo sapiens; identical to SEQ ID NO: 11316
  chr12:66217530-66217602
  hyper

SEQ ID NO: 21437 - DNA, 30 bp, Homo sapiens; identical to SEQ ID NO: 11317
  chr12:66219066-66219096
  hyper

SEQ ID NO: 21438 - DNA, 119 bp, Homo sapiens
  chr12:66583137-66583256
  hyper
tgccgcccgcgctgctcggagagctctgcgctgttctggacagctgcgacggcgcgctgggctggcgcggcctgggtgagtcggcggggaccggccgggggcggcgggggagcccagcg

SEQ ID NO: 21439 - DNA, 30 bp, Homo sapiens; identical to SEQ ID NO: 11320
  chr12:68759101-68759131
  hyper

SEQ ID NO: 21440 - DNA, 61 bp, Homo sapiens; identical to SEQ ID NO: 11321
  chr12:69326653-69326714
  hyper

SEQ ID NO: 21441 - DNA, 177 bp, Homo sapiens
  chr12:69327082-69327259
  hyper
cgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcc

SEQ ID NO: 21442 - DNA, 176 bp, Homo sapiens; identical to SEQ ID NO: 11323
  chr12:71314436-71314612
  hyper

SEQ ID NO: 21443 - DNA, 63 bp, Homo sapiens; identical to SEQ ID NO: 11324
  chr12:71314613-71314676
  hyper

SEQ ID NO: 21444 - DNA, 27 bp, Homo sapiens
  chr12:72666686-72666713
  hyper
cttcgctgtgtccctcgtggcattgct

SEQ ID NO: 21445 - DNA, 30 bp, Homo sapiens; identical to SEQ ID NO: 11330
  chr12:75601190-75601220
  hyper

SEQ ID NO: 21446 - DNA, 32 bp, Homo sapiens
  chr12:75601910-75601942
  hyper
ccccgggaggggatcagcgtccagcgctgtcc

SEQ ID NO: 21447 - DNA, 118 bp, Homo sapiens
  chr12:75603231-75603349
  hyper
ccaacctccgcgcccagagtcaccatcgcgcagggttgggcaaaccatggagctcggggcgggtccagccggcactgcccgacccctccgggagcgggcagatcggctggccgtgaat

SEQ ID NO: 21448 - DNA, 64 bp, Homo sapiens; identical to SEQ ID NO: 11335
  chr12:77719516-77719580
  hyper

SEQ ID NO: 21449 - DNA, 271 bp, Homo sapiens; identical to SEQ ID NO: 11336
  chr12:79257826-79258097
  hyper

SEQ ID NO: 21450 - DNA, 122 bp, Homo sapiens; identical to SEQ ID NO: 11337
  chr12:79258316-79258438
  hyper

SEQ ID NO: 21451 - DNA, 411 bp, Homo sapiens; identical to SEQ ID NO: 11338
  chr12:79258439-79258850
  hyper

SEQ ID NO: 21452 - DNA, 30 bp, Homo sapiens; identical to SEQ ID NO: 11340
  chr12:81330816-81330846
  hyper

SEQ ID NO: 21453 - DNA, 48 bp, Homo sapiens; identical to SEQ ID NO: 11341
  chr12:81331829-81331877
  hyper

SEQ ID NO: 21454 - DNA, 30 bp, Homo sapiens; identical to SEQ ID NO: 11343
  chr12:82153211-82153241
  hyper

SEQ ID NO: 21455 - DNA, 191 bp, Homo sapiens; identical to SEQ ID NO: 11344
  chr12:85305054-85305245
  hyper

SEQ ID NO: 21456 - DNA, 37 bp, Homo sapiens; identical to SEQ ID NO: 11345
  chr12:85305657-85305694
  hyper

SEQ ID NO: 21457 - DNA, 8 bp, Homo sapiens
  chr12:85306789-85306797
  hyper
cgagcggc

SEQ ID NO: 21458 - DNA, 28 bp, Homo sapiens
  chr12:85306798-85306826
  hyper
tcttcccagagcccggggctgtgcccgc

SEQ ID NO: 21459 - DNA, 79 bp, Homo sapiens
  chr12:85673127-85673206
  hyper
caaagggaagggtggcgaagagggtgtagggaattggttggcattagtataatggcttcattgcctcttgctcggcttc

SEQ ID NO: 21460 - DNA, 50 bp, Homo sapiens
  chr12:93966603-93966653
  hyper
gaaggacgcgaacccttctctgaccccagctcgggcggccacctgtcttt

SEQ ID NO: 21461 - DNA, 231 bp, Homo sapiens
  chr12:94543178-94543409
  hyper
caactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggg

SEQ ID NO: 21462 - DNA, 277 bp, Homo sapiens
  chr12:94543445-94543722
  hyper
cttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccacc

SEQ ID NO: 21463 - DNA, 272 bp, Homo sapiens; identical to SEQ ID NO: 11357
  chr12:95266922-95267194
  hyper

SEQ ID NO: 21464 - DNA, 7 bp, Homo sapiens
  chr12:95267247-95267254
  hyper
cgaagag

SEQ ID NO: 21465 - DNA, 15 bp, Homo sapiens
  chr12:95267666-95267681
  hyper
ccggggcctttctgc

SEQ ID NO: 21466 - DNA, 1 bp, Homo sapiens
  chr12:95267706-95267707
  hyper
c

SEQ ID NO: 21467 - DNA, 269 bp, Homo sapiens; identical to SEQ ID NO: 11362
  chr12:96883445-96883714
  hyper

SEQ ID NO: 21468 - DNA, 30 bp, Homo sapiens; identical to SEQ ID NO: 11363
  chr12:99287423-99287453
  hyper

SEQ ID NO: 21469 - DNA, 11 bp, Homo sapiens
  chr12:99288301-99288312
  hyper
cgactcggctt

SEQ ID NO: 21470 - DNA, 71 bp, Homo sapiens
  chr12:101111302-101111373
  hyper
gatggcctccctcaccgcatacggtaactggggccgtcgcgggttcctggggcggcggggcggaagggagg

SEQ ID NO: 21471 - DNA, 30 bp, Homo sapiens; identical to SEQ ID NO: 11369
  chr12:103311260-103311290
  hyper

SEQ ID NO: 21472 - DNA, 60 bp, Homo sapiens; identical to SEQ ID NO: 11370
  chr12:103350244-103350304
  hyper

SEQ ID NO: 21473 - DNA, 139 bp, Homo sapiens; identical to SEQ ID NO: 11371
  chr12:103350383-103350522
  hyper

SEQ ID NO: 21474 - DNA, 63 bp, Homo sapiens
  chr12:103351501-103351564
  hyper
tccggccagggagggcgagtgaaagaaggaaatcagaaaggaagggagttaacaaaataataa

SEQ ID NO: 21475 - DNA, 180 bp, Homo sapiens
  chr12:103358685-103358865
  hyper
atggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttga

SEQ ID NO: 21476 - DNA, 161 bp, Homo sapiens
  chr12:103359395-103359556
  hyper
actttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttg

SEQ ID NO: 21477 - DNA, 56 bp, Homo sapiens
  chr12:103359586-103359642
  hyper
cgcctccggactcgaccccaccatagccccgccgtccgaatcgtctctgaaccaaa

SEQ ID NO: 21478 - DNA, 263 bp, Homo sapiens; identical to SEQ ID NO: 1062
  chr12:103889253-103889516
  hyper

SEQ ID NO: 21479 - DNA, 197 bp, Homo sapiens; identical to SEQ ID NO: 1063
  chr12:103889517-103889714
  hyper

SEQ ID NO: 21480 - DNA, 57 bp, Homo sapiens
  chr12:104851020-104851077
  hyper
ccgggctgggggctccgagagcggccgcgaagcgactccgatcctccctctgagcct

SEQ ID NO: 21481 - DNA, 28 bp, Homo sapiens
  chr12:104851186-104851214
  hyper
gccatgaagccagcgctgctggaagtga

SEQ ID NO: 21482 - DNA, 60 bp, Homo sapiens; identical to SEQ ID NO: 11390
  chr12:104852725-104852785
  hyper

SEQ ID NO: 21483 - DNA, 41 bp, Homo sapiens; identical to SEQ ID NO: 11392
  chr12:106974919-106974960
  hyper

SEQ ID NO: 21484 - DNA, 38 bp, Homo sapiens; identical to SEQ ID NO: 11393
  chr12:106975290-106975328
  hyper

SEQ ID NO: 21485 - DNA, 39 bp, Homo sapiens; identical to SEQ ID NO: 11394
  chr12:106975543-106975582
  hyper

SEQ ID NO: 21486 - DNA, 50 bp, Homo sapiens; identical to SEQ ID NO: 11395
  chr12:106976472-106976522
  hyper

SEQ ID NO: 21487 - DNA, 11 bp, Homo sapiens
  chr12:106976842-106976853
  hyper
cgctttttctc

SEQ ID NO: 21488 - DNA, 258 bp, Homo sapiens
  chr12:106977497-106977755
  hyper
ccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttt

SEQ ID NO: 21489 - DNA, 124 bp, Homo sapiens
  chr12:106980333-106980457
  hyper
ctgccaagctggagctggaaacttctgcctccatccactttccgctcccatctccagaacccagagctgaggcggccaaagtacttcctggagccggatttgagttccccgggccgcatcggtg

SEQ ID NO: 21490 - DNA, 133 bp, Homo sapiens
  chr12:106981406-106981539
  hyper
cctcccccctcacccgtccggaggttaggcgccagctgggcagtgcgcccgcctccccaggagccacaggctcaccaacgtgaaaggttctggcttttcttccccacgacccgtgggtcgcccagggtgagtt

SEQ ID NO: 21491 - DNA, 11 bp, Homo sapiens
  chr12:107715153-107715164
  hyper
tccagccgaag

SEQ ID NO: 21492 - DNA, 49 bp, Homo sapiens
  chr12:108168922-108168971
  hyper
tctaagattctgtttcgtcttcttctattgagagattgacctcttgagt

SEQ ID NO: 21493 - DNA, 10 bp, Homo sapiens
  chr12:108169573-108169583
  hyper
aacctaaggt

SEQ ID NO: 21494 - DNA, 290 bp, Homo sapiens
  chr12:108297466-108297756
  hyper
ggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccggcgccgacttggcgatggccagctacacaggtccggcgggggcggcagccatgtggggcgcgggctggcgtggggagcagccc

SEQ ID NO: 21495 - DNA, 43 bp, Homo sapiens; identical to SEQ ID NO: 11407
  chr12:110271088-110271131
  hyper

SEQ ID NO: 21496 - DNA, 372 bp, Homo sapiens; identical to SEQ ID NO: 11409
  chr12:111284662-111285034
  hyper

SEQ ID NO: 21497 - DNA, 389 bp, Homo sapiens
  chr12:111471559-111471948
  hyper
gggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaa

SEQ ID NO: 21498 - DNA, 166 bp, Homo sapiens; identical to SEQ ID NO: 3946
  chr12:111472851-111473017
  hyper

SEQ ID NO: 21499 - DNA, 122 bp, Homo sapiens
  chr12:113013157-113013279
  hyper
tgccctcccaagctgcagcacgcgctggctggggggtcgtgggggctcccgtgggggcgcggccggacgcgggacgctgcctccgggaatggggctgctggagcgggaggatgcgctagaac

SEQ ID NO: 21500 - DNA, 502 bp, Homo sapiens; identical to SEQ ID NO: 11416
  chr12:113494535-113495037
  hyper

SEQ ID NO: 21501 - DNA, 13 bp, Homo sapiens
  chr12:113495038-113495051
  hyper
ccccccaggcgga

SEQ ID NO: 21502 - DNA, 79 bp, Homo sapiens; identical to SEQ ID NO: 1071
  chr12:113541522-113541601
  hyper

SEQ ID NO: 21503 - DNA, 6 bp, Homo sapiens
  chr12:113541661-113541667
  hyper
aggttg

SEQ ID NO: 21504 - DNA, 111 bp, Homo sapiens
  chr12:113592127-113592238
  hyper
tccaataataaggaacgctggcggccaggtgggatggagagggtaaggcactgcaggcccatgtgagtcccttccccgcccccgactctagttccaagaggttccggagct

SEQ ID NO: 21505 - DNA, 39 bp, Homo sapiens
  chr12:113592359-113592398
  hyper
gacgaggtgctcgcacagggccagcggcgggcacagctg

SEQ ID NO: 21506 - DNA, 309 bp, Homo sapiens
  chr12:113900765-113901074
  hyper
agtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattggga

SEQ ID NO: 21507 - DNA, 447 bp, Homo sapiens
  chr12:113903021-113903468
  hyper
taatttaattctccccgaaagtgaaggggaagatggggagcggcaaatttggagccccaaagggacagggatgggagacggccgcggcccgcggcgagccggaaaaccagcgaaggccgctgcccccgcgccgtgcgcgccgcctccgcccatatggcggccgggccggaggtaattggaacaaacgccgtctgaaaagggcacaaaagccgcagctggggctttgtccgcgctcccacggggagccgccggccccgccgcccggcccctttctcgcccgctgccggtcgccaccgccgggatctcccagcgcggattaggcggggctgcctcgctgggggctggggagtcttccccaccattacggggaacgaggggcccccagtatccagctccccacctcatccagcgcgcagggagaggaggcggtgggataggtcggggcgg

SEQ ID NO: 21508 - DNA, 45 bp, Homo sapiens
  chr12:113903498-113903543
  hyper
taattatccaggcggggaaaaattccgggccggtaccgcccccac

SEQ ID NO: 21509 - DNA, 13 bp, Homo sapiens
  chr12:113905016-113905029
  hyper
gaataggacaggt

SEQ ID NO: 21510 - DNA, 66 bp, Homo sapiens; identical to SEQ ID NO: 11426
  chr12:113905673-113905739
  hyper

SEQ ID NO: 21511 - DNA, 122 bp, Homo sapiens; identical to SEQ ID NO: 11427
  chr12:113906312-113906434
  hyper

SEQ ID NO: 21512 - DNA, 190 bp, Homo sapiens; identical to SEQ ID NO: 11428
  chr12:113909902-113910092
  hyper

SEQ ID NO: 21513 - DNA, 157 bp, Homo sapiens; identical to SEQ ID NO: 11429
  chr12:113910529-113910686
  hyper

SEQ ID NO: 21514 - DNA, 30 bp, Homo sapiens; identical to SEQ ID NO: 11430
  chr12:113913002-113913032
  hyper

SEQ ID NO: 21515 - DNA, 174 bp, Homo sapiens
  chr12:113914050-113914224
  hyper
tattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccgg

SEQ ID NO: 21516 - DNA, 35 bp, Homo sapiens; identical to SEQ ID NO: 11433
  chr12:113914300-113914335
  hyper

SEQ ID NO: 21517 - DNA, 273 bp, Homo sapiens
  chr12:113916316-113916589
  hyper
gtgtgtgtgtgtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccc

SEQ ID NO: 21518 - DNA, 84 bp, Homo sapiens; identical to SEQ ID NO: 11435
  chr12:113917379-113917463
  hyper

SEQ ID NO: 21519 - DNA, 24 bp, Homo sapiens
  chr12:113917751-113917775
  hyper
gcagtgacagtgaaacgaattcca

SEQ ID NO: 21520 - DNA, 170 bp, Homo sapiens; identical to SEQ ID NO: 11437
  chr12:113952952-113953122
  hyper

SEQ ID NO: 21521 - DNA, 295 bp, Homo sapiens; identical to SEQ ID NO: 11438
  chr12:113957660-113957955
  hyper

SEQ ID NO: 21522 - DNA, 66 bp, Homo sapiens; identical to SEQ ID NO: 11439
  chr12:114029765-114029831
  hyper

SEQ ID NO: 21523 - DNA, 41 bp, Homo sapiens; identical to SEQ ID NO: 11440
  chr12:114075780-114075821
  hyper

SEQ ID NO: 21524 - DNA, 12 bp, Homo sapiens
  chr12:114838726-114838738
  hyper
ctccaccctccc

SEQ ID NO: 21525 - DNA, 48 bp, Homo sapiens
  chr12:114841084-114841132
  hyper
gaggcaggaggaggcgggaggaggcgaaggctacggaagatcagaaga

SEQ ID NO: 21526 - DNA, 72 bp, Homo sapiens; identical to SEQ ID NO: 11445
  chr12:114843007-114843079
  hyper

SEQ ID NO: 21527 - DNA, 260 bp, Homo sapiens
  chr12:114843285-114843545
  hyper
cggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttact

SEQ ID NO: 21528 - DNA, 17 bp, Homo sapiens
  chr12:114844184-114844201
  hyper
acaaatcatttcaaacg

SEQ ID NO: 21529 - DNA, 30 bp, Homo sapiens; identical to SEQ ID NO: 11448
  chr12:114846013-114846043
  hyper

SEQ ID NO: 21530 - DNA, 244 bp, Homo sapiens
  chr12:114846471-114846715
  hyper
cgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttg

SEQ ID NO: 21531 - DNA, 179 bp, Homo sapiens
  chr12:114846768-114846947
  hyper
gcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcc

SEQ ID NO: 21532 - DNA, 30 bp, Homo sapiens; identical to SEQ ID NO: 11453
  chr12:114877303-114877333
  hyper

SEQ ID NO: 21533 - DNA, 10 bp, Homo sapiens
  chr12:114878584-114878594
  hyper
ggctaaatcc

SEQ ID NO: 21534 - DNA, 5 bp, Homo sapiens
  chr12:114878808-114878813
  hyper
cggga

SEQ ID NO: 21535 - DNA, 282 bp, Homo sapiens
  chr12:114881764-114882046
  hyper
tccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgac

SEQ ID NO: 21536 - DNA, 7 bp, Homo sapiens
  chr12:114918587-114918594
  hyper
ggagaag

SEQ ID NO: 21537 - DNA, 38 bp, Homo sapiens; identical to SEQ ID NO: 11459
  chr12:115106464-115106502
  hyper

SEQ ID NO: 21538 - DNA, 36 bp, Homo sapiens; identical to SEQ ID NO: 11460
  chr12:115121885-115121921
  hyper

SEQ ID NO: 21539 - DNA, 261 bp, Homo sapiens; identical to SEQ ID NO: 11462
  chr12:117319805-117320066
  hyper

SEQ ID NO: 21540 - DNA, 271 bp, Homo sapiens
  chr12:117798095-117798366
  hyper
ggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagag

SEQ ID NO: 21541 - DNA, 83 bp, Homo sapiens
  chr12:117799330-117799413
  hyper
cgctgctcgctgcccggccgcccctcggaggagccgcggcgctaagtagctcctcacccagcggctggaaacgcggcataaat

SEQ ID NO: 21542 - DNA, 58 bp, Homo sapiens; identical to SEQ ID NO: 3960
  chr12:119212142-119212200
  hyper

SEQ ID NO: 21543 - DNA, 18 bp, Homo sapiens
  chr12:119418576-119418594
  hyper
actctttcctctggacgg

SEQ ID NO: 21544 - DNA, 92 bp, Homo sapiens
  chr12:119418847-119418939
  hyper
tgagggtctgggggaggccggctggggtggatagattaagttttttacgagcccccccaaccccccccccccccccacgcagaagatcagct

SEQ ID NO: 21545 - DNA, 254 bp, Homo sapiens
  chr12:119419466-119419720
  hyper
acccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctt

SEQ ID NO: 21546 - DNA, 25 bp, Homo sapiens
  chr12:120032837-120032862
  hyper
ctctctaggagtggccgctggggcc

SEQ ID NO: 21547 - DNA, 32 bp, Homo sapiens
  chr12:120033169-120033201
  hyper
ccgcccacacttgcccacgggtggtggcacca

SEQ ID NO: 21548 - DNA, 30 bp, Homo sapiens; identical to SEQ ID NO: 11470
  chr12:120807882-120807912
  hyper

SEQ ID NO: 21549 - DNA, 30 bp, Homo sapiens; identical to SEQ ID NO: 11471
  chr12:121566850-121566880
  hyper

SEQ ID NO: 21550 - DNA, 372 bp, Homo sapiens; identical to SEQ ID NO: 11472
  chr12:122688669-122689041
  hyper

SEQ ID NO: 21551 - DNA, 58 bp, Homo sapiens; identical to SEQ ID NO: 11473
  chr12:123920539-123920597
  hyper

SEQ ID NO: 21552 - DNA, 72 bp, Homo sapiens; identical to SEQ ID NO: 11476
  chr12:125670334-125670406
  hyper

SEQ ID NO: 21553 - DNA, 84 bp, Homo sapiens; identical to SEQ ID NO: 11477
  chr12:125671581-125671665
  hyper

SEQ ID NO: 21554 - DNA, 128 bp, Homo sapiens; identical to SEQ ID NO: 11478
  chr12:125672764-125672892
  hyper

SEQ ID NO: 21555 - DNA, 49 bp, Homo sapiens
  chr12:126168505-126168554
  hyper
tggaggctgggccagcgttgcgagtcttgccagggacgcgcgctctagc

SEQ ID NO: 21556 - DNA, 2 bp, Homo sapiens
  chr12:126168620-126168622
  hyper
gc

SEQ ID NO: 21557 - DNA, 30 bp, Homo sapiens; identical to SEQ ID NO: 11480
  chr12:126675806-126675836
  hyper

SEQ ID NO: 21558 - DNA, 30 bp, Homo sapiens; identical to SEQ ID NO: 11481
  chr12:127212512-127212542
  hyper

SEQ ID NO: 21559 - DNA, 17 bp, Homo sapiens
  chr12:127765432-127765449
  hyper
cacgaggggccgacagg

SEQ ID NO: 21560 - DNA, 127 bp, Homo sapiens; identical to SEQ ID NO: 11483
  chr12:127865735-127865862
  hyper

SEQ ID NO: 21561 - DNA, 44 bp, Homo sapiens
  chr12:128751340-128751384
  hyper
cagctccgccttgagcgtcgggtccctgggcaggaccctccggg

SEQ ID NO: 21562 - DNA, 27 bp, Homo sapiens
  chr12:128752240-128752267
  hyper
ggtcccgagtcccgaatctcccacccc

SEQ ID NO: 21563 - DNA, 266 bp, Homo sapiens
  chr12:128752944-128753210
  hyper
ggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgag

SEQ ID NO: 21564 - DNA, 53 bp, Homo sapiens; identical to SEQ ID NO: 1075
  chr12:129337857-129337910
  hyper

SEQ ID NO: 21565 - DNA, 10 bp, Homo sapiens
  chr12:129338816-129338826
  hyper
gcgttaatcc

SEQ ID NO: 21566 - DNA, 55 bp, Homo sapiens; identical to SEQ ID NO: 1077
  chr12:129338851-129338906
  hyper

SEQ ID NO: 21567 - DNA, 103 bp, Homo sapiens
  chr12:130387811-130387914
  hyper
aaaacagggcggccaggctgatgagtaccggcgaccagtggtgccacagcgtccccatctcagacgggcacatcctggagacccggagcgcagatcctccgct

SEQ ID NO: 21568 - DNA, 131 bp, Homo sapiens
  chr12:130388279-130388410
  hyper
gctagcgggcgctggcgcaggcggcgccggggtggcggggctgcggagcccgggacgcgggcagaggcggctcggagccccccgggcgggtggccgggctcgctgggcggcccggggctccctggcccgca

SEQ ID NO: 21569 - DNA, 42 bp, Homo sapiens; identical to SEQ ID NO: 11494
  chr12:130526846-130526888
  hyper

SEQ ID NO: 21570 - DNA, 121 bp, Homo sapiens; identical to SEQ ID NO: 11495
  chr12:130526931-130527052
  hyper

SEQ ID NO: 21571 - DNA, 43 bp, Homo sapiens
  chr12:130589266-130589309
  hyper
ttcagccctaagctcaaagccggagctccgaccagcactctca

SEQ ID NO: 21572 - DNA, 30 bp, Homo sapiens; identical to SEQ ID NO: 11498
  chr12:130646183-130646213
  hyper

SEQ ID NO: 21573 - DNA, 21 bp, Homo sapiens
  chr12:130646633-130646654
  hyper
cgccgggaaagggggcgccgg

SEQ ID NO: 21574 - DNA, 77 bp, Homo sapiens; identical to SEQ ID NO: 11503
  chr12:132312753-132312830
  hyper

SEQ ID NO: 21575 - DNA, 33 bp, Homo sapiens; identical to SEQ ID NO: 11504
  chr12:132312856-132312889
  hyper

SEQ ID NO: 21576 - DNA, 298 bp, Homo sapiens; identical to SEQ ID NO: 11505
  chr12:132313288-132313586
  hyper

SEQ ID NO: 21577 - DNA, 78 bp, Homo sapiens; identical to SEQ ID NO: 11506
  chr12:133194973-133195051
  hyper

SEQ ID NO: 21578 - DNA, 30 bp, Homo sapiens; identical to SEQ ID NO: 11507
  chr12:133195488-133195518
  hyper

SEQ ID NO: 21579 - DNA, 33 bp, Homo sapiens; identical to SEQ ID NO: 11508
  chr12:133463690-133463723
  hyper

SEQ ID NO: 21580 - DNA, 61 bp, Homo sapiens; identical to SEQ ID NO: 11509
  chr12:133464480-133464541
  hyper

SEQ ID NO: 21581 - DNA, 15 bp, Homo sapiens
  chr12:133481368-133481383
  hyper
gaagcttttcctcac

SEQ ID NO: 21582 - DNA, 118 bp, Homo sapiens
  chr12:133485439-133485557
  hyper
cgcctcgggccgtccccgcccagacgcttgtccccgcgagaagctgagcgcactgaagtgagcccggcggctgccgccggaggaggagcccggctctggacacggccgtcaggaagct

SEQ ID NO: 21583 - DNA, 67 bp, Homo sapiens; identical to SEQ ID NO: 11515
  chr13:20735465-20735532
  hyper

SEQ ID NO: 21584 - DNA, 271 bp, Homo sapiens
  chr13:20735533-20735804
  hyper
cccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgg

SEQ ID NO: 21585 - DNA, 30 bp, Homo sapiens; identical to SEQ ID NO: 11517
  chr13:20805970-20806000
  hyper

SEQ ID NO: 21586 - DNA, 43 bp, Homo sapiens; identical to SEQ ID NO: 11518
  chr13:21520313-21520356
  hyper

SEQ ID NO: 21587 - DNA, 30 bp, Homo sapiens; identical to SEQ ID NO: 11519
  chr13:21634799-21634829
  hyper

SEQ ID NO: 21588 - DNA, 13 bp, Homo sapiens
  chr13:21649623-21649636
  hyper
aaataatcacaga

SEQ ID NO: 21589 - DNA, 267 bp, Homo sapiens
  chr13:21649775-21650042
  hyper
gggcgcggagcctgcgccagcttcacaaaagcggtgtggacgcctgagccagtccgctcttgctggacggctccccatagtttagcccaaaaatccccctctgggtggctctggcaggagtgatttagggccacaattaggttggacgaggagtggggacttgccccgagctgcctttgcagacccggcggcggcgttctccccaaggctgcccgcttggctgcgcggctgaggcgagttgaggacccagcccgtccccaactctcc

SEQ ID NO: 21590 - DNA, 123 bp, Homo sapiens
  chr13:23489728-23489851
  hyper
aaagccgtagcgccacgggagtgggcgggagggagagggggtacccgagggccacaagagtatgacggggctgtaagagctggtgtggcgggtgctgcccccctgctctgtctgcaccgcaag

SEQ ID NO: 21591 - DNA, 57 bp, Homo sapiens
  chr13:23489914-23489971
  hyper
gccgcctctgccgcggtcctagcgccgctcggcttcacgctccgcaagtcccaggcg

SEQ ID NO: 21592 - DNA, 90 bp, Homo sapiens
  chr13:23734020-23734110
  hyper
gaggggctcggagtgggagtgcaggggtgcggggagggagtgcagggacgcggggagggagtggaggggtggggacgtgctggaggggcg

SEQ ID NO: 21593 - DNA, 59 bp, Homo sapiens; identical to SEQ ID NO: 11524
  chr13:24153660-24153719
  hyper

SEQ ID NO: 21594 - DNA, 30 bp, Homo sapiens
  chr13:24477613-24477643
  hyper
aggatccaattagtccgtgtaaaatgagag

SEQ ID NO: 21595 - DNA, 138 bp, Homo sapiens; identical to SEQ ID NO: 11526
  chr13:25255004-25255142
  hyper

SEQ ID NO: 21596 - DNA, 26 bp, Homo sapiens
  chr13:25319830-25319856
  hyper
ccagaacaacgagggcgacgaagaca

SEQ ID NO: 21597 - DNA, 349 bp, Homo sapiens
  chr13:25321350-25321699
  hyper
ggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaag

SEQ ID NO: 21598 - DNA, 242 bp, Homo sapiens
  chr13:25321942-25322184
  hyper
cagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgac

SEQ ID NO: 21599 - DNA, 32 bp, Homo sapiens; identical to SEQ ID NO: 11531
  chr13:25620922-25620954
  hyper

SEQ ID NO: 21600 - DNA, 13 bp, Homo sapiens
  chr13:25620955-25620968
  hyper
aggagccctggag

SEQ ID NO: 21601 - DNA, 7 bp, Homo sapiens
  chr13:25744709-25744716
  hyper
aggcagg

SEQ ID NO: 21602 - DNA, 39 bp, Homo sapiens; identical to SEQ ID NO: 11537
  chr13:25945978-25946017
  hyper

SEQ ID NO: 21603 - DNA, 18 bp, Homo sapiens
  chr13:25946801-25946819
  hyper
cggcgcagagaagatgca

SEQ ID NO: 21604 - DNA, 30 bp, Homo sapiens; identical to SEQ ID NO: 11543
  chr13:26624792-26624822
  hyper

SEQ ID NO: 21605 - DNA, 30 bp, Homo sapiens; identical to SEQ ID NO: 11545
  chr13:27050496-27050526
  hyper

SEQ ID NO: 21606 - DNA, 168 bp, Homo sapiens; identical to SEQ ID NO: 11546
  chr13:27131553-27131721
  hyper

SEQ ID NO: 21607 - DNA, 308 bp, Homo sapiens; identical to SEQ ID NO: 11547
  chr13:27132002-27132310
  hyper

SEQ ID NO: 21608 - DNA, 107 bp, Homo sapiens; identical to SEQ ID NO: 11548
  chr13:27132629-27132736
  hyper

SEQ ID NO: 21609 - DNA, 160 bp, Homo sapiens
  chr13:27334563-27334723
  hyper
tgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctc

SEQ ID NO: 21610 - DNA, 48 bp, Homo sapiens
  chr13:27334724-27334772
  hyper
cccaggccgagggggctcctccggtgcttccgaagcgcgtgggctact

SEQ ID NO: 21611 - DNA, 68 bp, Homo sapiens
  chr13:27334894-27334962
  hyper
agcagcctcggctcgcgcgcccagctttccccgccgcgcccgcccggcccacacgctccccgcgcgcg

SEQ ID NO: 21612 - DNA, 30 bp, Homo sapiens; identical to SEQ ID NO: 11551
  chr13:28363673-28363703
  hyper

SEQ ID NO: 21613 - DNA, 46 bp, Homo sapiens
  chr13:28365659-28365705
  hyper
gcagcggtttcccagcgcactgctggaagtgtgctccagtagacag

SEQ ID NO: 21614 - DNA, 19 bp, Homo sapiens
  chr13:28367005-28367024
  hyper
tctgcgtcaccgcctcgca

SEQ ID NO: 21615 - DNA, 69 bp, Homo sapiens
  chr13:28368168-28368237
  hyper
acccgcagccaaaccactgcctggcatggatttggcactgctttgcagaggtcccgggcctgggcaggg

SEQ ID NO: 21616 - DNA, 21 bp, Homo sapiens
  chr13:28369990-28370011
  hyper
gaaagacggtccacctgaggt

SEQ ID NO: 21617 - DNA, 301 bp, Homo sapiens
  chr13:28371061-28371362
  hyper
acctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagtttt

SEQ ID NO: 21618 - DNA, 23 bp, Homo sapiens
  chr13:28394743-28394766
  hyper
ccaggcagagagggccggaaagg

SEQ ID NO: 21619 - DNA, 246 bp, Homo sapiens
  chr13:28395255-28395501
  hyper
gttttcagtcaaatgcgcaaagccaggtggctcctttaacacccccagagattgtccccatgatctcctctgcgccatggggcgctgggtgctgggggcgccgtctgtatcctctgcctggtaactgcccccatcgcgccccactgcgccccagcccaggctggaaaactgggccaacagggaggcttggatggggggaaacccagcctgaggctggaaacggctagaagtgaacgggacgagtgg

SEQ ID NO: 21620 - DNA, 104 bp, Homo sapiens
  chr13:28395553-28395657
  hyper
gaactttacgcaagataggcgagaggggtggccgcactaaaagaaaaagaaaaattaaaaaaaaagacattccaactactttatccttgcgcagggaccccttc

SEQ ID NO: 21621 - DNA, 140 bp, Homo sapiens; identical to SEQ ID NO: 11563
  chr13:28396578-28396718
  hyper

SEQ ID NO: 21622 - DNA, 30 bp, Homo sapiens; identical to SEQ ID NO: 11564
  chr13:28397439-28397469
  hyper

SEQ ID NO: 21623 - DNA, 43 bp, Homo sapiens
  chr13:28491946-28491989
  hyper
ctgagagcctcttttctttctgcagggccgagcaaaaatatta

SEQ ID NO: 21624 - DNA, 36 bp, Homo sapiens; identical to SEQ ID NO: 11568
  chr13:28527866-28527902
  hyper

SEQ ID NO: 21625 - DNA, 309 bp, Homo sapiens
  chr13:28528225-28528534
  hyper
cggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttc

SEQ ID NO: 21626 - DNA, 117 bp, Homo sapiens; identical to SEQ ID NO: 11570
  chr13:28535406-28535523
  hyper

SEQ ID NO: 21627 - DNA, 37 bp, Homo sapiens; identical to SEQ ID NO: 11571
  chr13:28541213-28541250
  hyper

SEQ ID NO: 21628 - DNA, 50 bp, Homo sapiens; identical to SEQ ID NO: 11572
  chr13:28542677-28542727
  hyper

SEQ ID NO: 21629 - DNA, 33 bp, Homo sapiens; identical to SEQ ID NO: 11573
  chr13:28542728-28542761
  hyper

SEQ ID NO: 21630 - DNA, 137 bp, Homo sapiens; identical to SEQ ID NO: 11574
  chr13:28542969-28543106
  hyper

SEQ ID NO: 21631 - DNA, 58 bp, Homo sapiens; identical to SEQ ID NO: 11575
  chr13:28543378-28543436
  hyper

SEQ ID NO: 21632 - DNA, 7 bp, Homo sapiens
  chr13:28544390-28544397
  hyper
ctttaca

SEQ ID NO: 21633 - DNA, 132 bp, Homo sapiens
  chr13:28551285-28551417
  hyper
tgtggtgggctcctccgcaggatgctaatgtactttcccccagtggacagtctggctgctggtacaggaagctgcccagcctaataggggtctgaaactccagggctgacaagcaaagatttctatgggcac

SEQ ID NO: 21634 - DNA, 88 bp, Homo sapiens
  chr13:28551461-28551549
  hyper
tccaaatacccagcgctgctcaatgttactattttaataactgatgggtttcccggggcagtcgagccacccccccaaagccgacctc

SEQ ID NO: 21635 - DNA, 37 bp, Homo sapiens; identical to SEQ ID NO: 4004
  chr13:28551658-28551695
  hyper

SEQ ID NO: 21636 - DNA, 37 bp, Homo sapiens
  chr13:28552167-28552204
  hyper
cccaggacgcacagctccgggccgtggcccccgcgcg

SEQ ID NO: 21637 - DNA, 30 bp, Homo sapiens; identical to SEQ ID NO: 11583
  chr13:28553143-28553173
  hyper

SEQ ID NO: 21638 - DNA, 422 bp, Homo sapiens
  chr13:28674734-28675156
  hyper
tcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccg

SEQ ID NO: 21639 - DNA, 510 bp, Homo sapiens
  chr13:29068416-29068926
  hyper
cggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaag

SEQ ID NO: 21640 - DNA, 110 bp, Homo sapiens
  chr13:29069065-29069175
  hyper
cgccgccggccccgcgccctgagcgcccgtctcgcggctccagccaggagacaaccacttccccgggtaatcctcgccgccaggcgcccgctggccgctgcacccgagcc

SEQ ID NO: 21641 - DNA, 32 bp, Homo sapiens; identical to SEQ ID NO: 11588
  chr13:29069551-29069583
  hyper

SEQ ID NO: 21642 - DNA, 44 bp, Homo sapiens; identical to SEQ ID NO: 11592
  chr13:29393656-29393700
  hyper

SEQ ID NO: 21643 - DNA, 62 bp, Homo sapiens; identical to SEQ ID NO: 11593
  chr13:29394849-29394911
  hyper

SEQ ID NO: 21644 - DNA, 81 bp, Homo sapiens
  chr13:33591219-33591300
  hyper
ccacttcagggattacgcggagctctgcttccgccacttcggcggtcaggtcaagtactggatcaccatcgacaaccccta

SEQ ID NO: 21645 - DNA, 12 bp, Homo sapiens
  chr13:33591419-33591431
  hyper
agggccacgcag

SEQ ID NO: 21646 - DNA, 7 bp, Homo sapiens
  chr13:36705559-36705566
  hyper
gctcaca

SEQ ID NO: 21647 - DNA, 30 bp, Homo sapiens; identical to SEQ ID NO: 11596
  chr13:36729247-36729277
  hyper

SEQ ID NO: 21648 - DNA, 68 bp, Homo sapiens; identical to SEQ ID NO: 11597
  chr13:36919889-36919957
  hyper

SEQ ID NO: 21649 - DNA, 30 bp, Homo sapiens
  chr13:36920598-36920628
  hyper
tcccgccacagagcccgcagcacgccgccg

SEQ ID NO: 21650 - DNA, 108 bp, Homo sapiens; identical to SEQ ID NO: 4013
  chr13:37005473-37005581
  hyper

SEQ ID NO: 21651 - DNA, 30 bp, Homo sapiens; identical to SEQ ID NO: 11602
  chr13:37248608-37248638
  hyper

SEQ ID NO: 21652 - DNA, 124 bp, Homo sapiens; identical to SEQ ID NO: 11604
  chr13:39261149-39261273
  hyper

SEQ ID NO: 21653 - DNA, 112 bp, Homo sapiens; identical to SEQ ID NO: 11605
  chr13:39262129-39262241
  hyper

SEQ ID NO: 21654 - DNA, 188 bp, Homo sapiens
  chr13:43566059-43566247
  hyper
agtatgtttggggcccgggctcccgccccgaagccaggttgttaaaatactcaccgcctctggcccgcgtgcacgacgctctcccgcgaagggcccttaggggctgcctccaaaccctctctctggtcttccacggggctcagctccccttgccgcccagaagggtcctggggatcccgggtcgggcg

SEQ ID NO: 21655 - DNA, 62 bp, Homo sapiens; identical to SEQ ID NO: 11607
  chr13:44360732-44360794
  hyper

SEQ ID NO: 21656 - DNA, 9 bp, Homo sapiens
  chr13:44947737-44947746
  hyper
cgacgcgct

SEQ ID NO: 21657 - DNA, 279 bp, Homo sapiens
  chr13:44948197-44948476
  hyper
aagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctggg

SEQ ID NO: 21658 - DNA, 67 bp, Homo sapiens; identical to SEQ ID NO: 11609
  chr13:46189867-46189934
  hyper

SEQ ID NO: 21659 - DNA, 3 bp, Homo sapiens
  chr13:46961491-46961494
  hyper
gca

SEQ ID NO: 21660 - DNA, 60 bp, Homo sapiens
  chr13:46961533-46961593
  hyper
atggaagaaactctggagatgcgcgctcctacaccggtgccgcggcgcccgggcccagca

SEQ ID NO: 21661 - DNA, 106 bp, Homo sapiens; identical to SEQ ID NO: 11612
  chr13:50070552-50070658
  hyper

SEQ ID NO: 21662 - DNA, 30 bp, Homo sapiens; identical to SEQ ID NO: 11613
  chr13:52979780-52979810
  hyper

SEQ ID NO: 21663 - DNA, 43 bp, Homo sapiens; identical to SEQ ID NO: 11614
  chr13:52980066-52980109
  hyper

SEQ ID NO: 21664 - DNA, 13 bp, Homo sapiens
  chr13:53312978-53312991
  hyper
cttgcttttctac

SEQ ID NO: 21665 - DNA, 32 bp, Homo sapiens; identical to SEQ ID NO: 11620
  chr13:53422842-53422874
  hyper

SEQ ID NO: 21666 - DNA, 30 bp, Homo sapiens; identical to SEQ ID NO: 11621
  chr13:53423168-53423198
  hyper

SEQ ID NO: 21667 - DNA, 68 bp, Homo sapiens
  chr13:53423978-53424046
  hyper
accatctgcttaggaaagtgtggagcttcggcactgccaaaatctgggctgggcggatcctggggctg

SEQ ID NO: 21668 - DNA, 207 bp, Homo sapiens
  chr13:58203644-58203851
  hyper
acacactcaccgaaatacacatctcagcccgtggaagcgcattcacacacacccacgtacactcctccgcacctcattcagatgggtccacgcggagtcagggctgcgcttcccttggcatgggcgtgtgtgcggcgagggcgtgtgtgcgtgcgtgtgtgagagtgtgtgtagagaaaccctttaggcagaccgcagctacgttat

SEQ ID NO: 21669 - DNA, 111 bp, Homo sapiens
  chr13:58204239-58204350
  hyper
tcagtcagcaagagacgctggggagagagcagggatcgcgagcccggcggatgcggcagcggcggaaggcggctggggagacgctactccaactgttgaattgaattttca

SEQ ID NO: 21670 - DNA, 153 bp, Homo sapiens
  chr13:58205889-58206042
  hyper
ctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcag

SEQ ID NO: 21671 - DNA, 161 bp, Homo sapiens
  chr13:58208334-58208495
  hyper
tgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctat

SEQ ID NO: 21672 - DNA, 69 bp, Homo sapiens; identical to SEQ ID NO: 11630
  chr13:67804675-67804744
  hyper

SEQ ID NO: 21673 - DNA, 23 bp, Homo sapiens
  chr13:67804745-67804768
  hyper
cgctggcgctccccaggcccggg

SEQ ID NO: 21674 - DNA, 236 bp, Homo sapiens; identical to SEQ ID NO: 11632
  chr13:67804863-67805099
  hyper

SEQ ID NO: 21675 - DNA, 30 bp, Homo sapiens; identical to SEQ ID NO: 11635
  chr13:74707261-74707291
  hyper

SEQ ID NO: 21676 - DNA, 130 bp, Homo sapiens; identical to SEQ ID NO: 11636
  chr13:75149921-75150051
  hyper

SEQ ID NO: 21677 - DNA, 56 bp, Homo sapiens
  chr13:78493110-78493166
  hyper
agcgtgcgtgggaaccgcggaattaaggcacctagaggccaagggcttgtgtcaag

SEQ ID NO: 21678 - DNA, 125 bp, Homo sapiens
  chr13:78493809-78493934
  hyper
ctttccccttgggcgatgcctggacagcatcagtagtagttgcccgagggaggggggcagtcctcgtccggggacaggtcccaaaaggctgtttatttgttagagttctacgctcttcaaatgaa

SEQ ID NO: 21679 - DNA, 35 bp, Homo sapiens; identical to SEQ ID NO: 11639
  chr13:79161007-79161042
  hyper

SEQ ID NO: 21680 - DNA, 68 bp, Homo sapiens
  chr13:79175702-79175770
  hyper
ggagcgcttctcgggcgcggcgatggaagtccgcttgcgcttcttctcgccgccgttgaagagctcag

SEQ ID NO: 21681 - DNA, 49 bp, Homo sapiens
  chr13:79176783-79176832
  hyper
gcgaagggcaaacacaaagcaaccaaaataacaacgggtttgggggcag

SEQ ID NO: 21682 - DNA, 62 bp, Homo sapiens
  chr13:79177998-79178060
  hyper
tcagaaggtccagctattgtctaagggtgggcaccttttagaataaaaaagacgagatgcgc

SEQ ID NO: 21683 - DNA, 60 bp, Homo sapiens; identical to SEQ ID NO: 11649
  chr13:79182844-79182904
  hyper

SEQ ID NO: 21684 - DNA, 9 bp, Homo sapiens
  chr13:84455572-84455581
  hyper
aaacgtccc

SEQ ID NO: 21685 - DNA, 236 bp, Homo sapiens; identical to SEQ ID NO: 11652
  chr13:84456111-84456347
  hyper

SEQ ID NO: 21686 - DNA, 111 bp, Homo sapiens
  chr13:88323468-88323579
  hyper
ctccctttcccaatccgagaattgcacagtcccacgctcgaattacacacatggtccaagacttctctctcttcctacgaatgtgacatccaagggggccccggttgcgcc

SEQ ID NO: 21687 - DNA, 174 bp, Homo sapiens
  chr13:88324342-88324516
  hyper
gggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgc

SEQ ID NO: 21688 - DNA, 30 bp, Homo sapiens; identical to SEQ ID NO: 11655
  chr13:88325619-88325649
  hyper

SEQ ID NO: 21689 - DNA, 31 bp, Homo sapiens
  chr13:92051108-92051139
  hyper
gcttagggcctcctccgggaagagctaactg

SEQ ID NO: 21690 - DNA, 206 bp, Homo sapiens
  chr13:92051168-92051374
  hyper
gtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcga

SEQ ID NO: 21691 - DNA, 5 bp, Homo sapiens
  chr13:93879283-93879288
  hyper
tcccg

SEQ ID NO: 21692 - DNA, 86 bp, Homo sapiens
  chr13:93879375-93879461
  hyper
attgcagctctgaacccccatggtggttttttaaacacttcttttccttctcttcctcgttttgattgcaccgtttccatctgggg

SEQ ID NO: 21693 - DNA, 30 bp, Homo sapiens; identical to SEQ ID NO: 11663
  chr13:95354328-95354358
  hyper

SEQ ID NO: 21694 - DNA, 28 bp, Homo sapiens
  chr13:95359719-95359747
  hyper
cttgcctggaggacacggcggcccaggc

SEQ ID NO: 21695 - DNA, 21 bp, Homo sapiens
  chr13:95359803-95359824
  hyper
ctgctccggggagagtggaat

SEQ ID NO: 21696 - DNA, 91 bp, Homo sapiens
  chr13:95360231-95360322
  hyper
aaacagggagagagacggagatagataaagagatggagatagagatcgcgagccagcagcagctctctgcccaatcacagcgctgcatttg

SEQ ID NO: 21697 - DNA, 33 bp, Homo sapiens
  chr13:95360371-95360404
  hyper
gccctcttgccccggagccgctccccccgctcc

SEQ ID NO: 21698 - DNA, 201 bp, Homo sapiens
  chr13:95363009-95363210
  hyper
gcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcac

SEQ ID NO: 21699 - DNA, 204 bp, Homo sapiens
  chr13:95363592-95363796
  hyper
cgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagta

SEQ ID NO: 21700 - DNA, 142 bp, Homo sapiens
  chr13:95364800-95364942
  hyper
ggttctcctcggtgactttctcatttgacagaagcagatgggggtggggaaggcggggaggtggccctggaggaggaagaggagggggaggcggaggagtgtccaggcgtgccacgagaacgcagagcgcagcaatggatat

SEQ ID NO: 21701 - DNA, 129 bp, Homo sapiens; identical to SEQ ID NO: 11672
  chr13:95365239-95365368
  hyper

SEQ ID NO: 21702 - DNA, 218 bp, Homo sapiens
  chr13:95619803-95620021
  hyper
agagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcggg

SEQ ID NO: 21703 - DNA, 228 bp, Homo sapiens
  chr13:95620078-95620306
  hyper
ctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacac

SEQ ID NO: 21704 - DNA, 340 bp, Homo sapiens
  chr13:95620307-95620647
  hyper
ctcggctacctgcaggggttcgccactgcaagccgggccagtagaagtttgggggcgaaggcagagagcatttccttctcggcttttggcgcctccacgctgcacagaggcaggggcgactctgcaggccccgtttcccccatcctcccctccaccccagttccccgcaggacgtaggcgccgtccctagctcccccttctgtcctcgccctaacaccgcagggcctctcctggggatgtggggtcctgcgtgcttttgggggctacaaaaagtgggggccgtcgcagagcagagggaagctaggagcgggcaacgaattgaatcctggagacccgggag

SEQ ID NO: 21705 - DNA, 93 bp, Homo sapiens; identical to SEQ ID NO: 11676
  chr13:95655093-95655186
  hyper

SEQ ID NO: 21706 - DNA, 83 bp, Homo sapiens
  chr13:96296473-96296556
  hyper
ggcaaacaggcagtgggggcagcggcggctactccagctggatctgcagaggctcggctcgcagcctggagaggcaggagggc

SEQ ID NO: 21707 - DNA, 83 bp, Homo sapiens
  chr13:96297137-96297220
  hyper
ccctcagcaagctaatttcccagaggagcttcaggtgaattatcttccaaaaagagatgcgttttaatcgcagaagtctgcag

SEQ ID NO: 21708 - DNA, 150 bp, Homo sapiens; identical to SEQ ID NO: 11681
  chr13:96743424-96743574
  hyper

SEQ ID NO: 21709 - DNA, 30 bp, Homo sapiens; identical to SEQ ID NO: 11686
  chr13:100611911-100611941
  hyper

SEQ ID NO: 21710 - DNA, 33 bp, Homo sapiens; identical to SEQ ID NO: 11688
  chr13:100622452-100622485
  hyper

SEQ ID NO: 21711 - DNA, 34 bp, Homo sapiens; identical to SEQ ID NO: 11689
  chr13:100622959-100622993
  hyper

SEQ ID NO: 21712 - DNA, 28 bp, Homo sapiens
  chr13:100624559-100624587
  hyper
acccaacctgcctagcgctcacctaggg

SEQ ID NO: 21713 - DNA, 90 bp, Homo sapiens; identical to SEQ ID NO: 11692
  chr13:100635085-100635175
  hyper

SEQ ID NO: 21714 - DNA, 34 bp, Homo sapiens; identical to SEQ ID NO: 11694
  chr13:100637006-100637040
  hyper

SEQ ID NO: 21715 - DNA, 39 bp, Homo sapiens
  chr13:100637485-100637524
  hyper
tgggggtgctctcccccaggggcccggccccacagcagc

SEQ ID NO: 21716 - DNA, 156 bp, Homo sapiens; identical to SEQ ID NO: 11696
  chr13:100637800-100637956
  hyper

SEQ ID NO: 21717 - DNA, 187 bp, Homo sapiens; identical to SEQ ID NO: 11697
  chr13:100640972-100641159
  hyper

SEQ ID NO: 21718 - DNA, 30 bp, Homo sapiens
  chr13:100644025-100644055
  hyper
cagtggttaggtggccgagtgtggtttccc

SEQ ID NO: 21719 - DNA, 32 bp, Homo sapiens; identical to SEQ ID NO: 11700
  chr13:100647898-100647930
  hyper

SEQ ID NO: 21720 - DNA, 26 bp, Homo sapiens
  chr13:102069045-102069071
  hyper
gcagttccttcttgccggctgccacc

SEQ ID NO: 21721 - DNA, 32 bp, Homo sapiens
  chr13:102568422-102568454
  hyper
ctgcgagcggtggctcgaccccgggtgtggca

SEQ ID NO: 21722 - DNA, 60 bp, Homo sapiens; identical to SEQ ID NO: 11706
  chr13:102569830-102569890
  hyper

SEQ ID NO: 21723 - DNA, 56 bp, Homo sapiens
  chr13:103046665-103046721
  hyper
cacatggggtgcccccgcgtcaacgccggaggagtgaccttgcaaacccgcgcccc

SEQ ID NO: 21724 - DNA, 58 bp, Homo sapiens
  chr13:103046995-103047053
  hyper
ggcgagccgaggctgggagcgcggtgatggccggtccccgtgagcagagggcagcggc

SEQ ID NO: 21725 - DNA, 247 bp, Homo sapiens; identical to SEQ ID NO: 11708
  chr13:103047054-103047301
  hyper

SEQ ID NO: 21726 - DNA, 30 bp, Homo sapiens; identical to SEQ ID NO: 11709
  chr13:103052128-103052158
  hyper

SEQ ID NO: 21727 - DNA, 254 bp, Homo sapiens
  chr13:103052574-103052828
  hyper
cccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgcc

SEQ ID NO: 21728 - DNA, 63 bp, Homo sapiens
  chr13:103052829-103052892
  hyper
ccgccaccaccatgcagccctccagcctgcctcccctgggttgctcgcccacagctccgcggc

SEQ ID NO: 21729 - DNA, 269 bp, Homo sapiens
  chr13:103052940-103053209
  hyper
tccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctca

SEQ ID NO: 21730 - DNA, 30 bp, Homo sapiens; identical to SEQ ID NO: 11712
  chr13:103054590-103054620
  hyper

SEQ ID NO: 21731 - DNA, 208 bp, Homo sapiens
  chr13:108518605-108518813
  hyper
ggactcccccatgctcgccaggagcgcgggccaggagggctcctgctgccgccgctgctgctgctgctgctgccgctgcctctgctgctgctgctgctgctgctgctgccgctgctgctgctggtgctccttgtcccgggcccgggtcagcttggcctcggcgcagaaccacaagtgatcagagagcaggactgtgaaaaacaagaga

SEQ ID NO: 21732 - DNA, 63 bp, Homo sapiens
  chr13:108519674-108519737
  hyper
ccgctgccgcagggccgcccgcgggcgccgccgccggggctccgactgctgacgccgcctccc

SEQ ID NO: 21733 - DNA, 80 bp, Homo sapiens; identical to SEQ ID NO: 11717
  chr13:109148480-109148560
  hyper

SEQ ID NO: 21734 - DNA, 89 bp, Homo sapiens
  chr13:110958727-110958816
  hyper
gccttaggcagcagtcgtgggaaagctcagatacagctgtttccaggcaaagggcccagagcttttcagcctcagccaccagggtctcc

SEQ ID NO: 21735 - DNA, 132 bp, Homo sapiens; identical to SEQ ID NO: 4051
  chr13:110959517-110959649
  hyper

SEQ ID NO: 21736 - DNA, 57 bp, Homo sapiens
  chr13:110959970-110960027
  hyper
gagtagaaagggggagggtgggagagcgaagaccgagctcctcggccaaggagcacc

SEQ ID NO: 21737 - DNA, 96 bp, Homo sapiens
  chr13:110960445-110960541
  hyper
gttcctcgcccagagcgtcttggcggtaagtcctggctcccgcgcttggacttgcgcgcccgagagtggttgggacgtttgagtggccttggagaa

SEQ ID NO: 21738 - DNA, 83 bp, Homo sapiens; identical to SEQ ID NO: 11724
  chr13:110960909-110960992
  hyper

SEQ ID NO: 21739 - DNA, 33 bp, Homo sapiens; identical to SEQ ID NO: 11725
  chr13:111767955-111767988
  hyper

SEQ ID NO: 21740 - DNA, 50 bp, Homo sapiens
  chr13:112707869-112707919
  hyper
gccgcagggggttggggtcatttttttgatgccgccgcccttaagagttc

SEQ ID NO: 21741 - DNA, 14 bp, Homo sapiens
  chr13:112710745-112710759
  hyper
gaggggactgggga

SEQ ID NO: 21742 - DNA, 16 bp, Homo sapiens
  chr13:112715354-112715370
  hyper
gggaacgctcccagcc

SEQ ID NO: 21743 - DNA, 49 bp, Homo sapiens
  chr13:112715936-112715985
  hyper
tctttaagagccacccgacagaactgcgcgctacatctgcgccagctgg

SEQ ID NO: 21744 - DNA, 40 bp, Homo sapiens
  chr13:112716313-112716353
  hyper
gacgtctctcccccaactgctctgccgttaacccaattac

SEQ ID NO: 21745 - DNA, 34 bp, Homo sapiens; identical to SEQ ID NO: 11736
  chr13:112716636-112716670
  hyper

SEQ ID NO: 21746 - DNA, 299 bp, Homo sapiens
  chr13:112717536-112717835
  hyper
atttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctgg

SEQ ID NO: 21747 - DNA, 205 bp, Homo sapiens
  chr13:112720518-112720723
  hyper
tactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcact

SEQ ID NO: 21748 - DNA, 245 bp, Homo sapiens
  chr13:112720767-112721012
  hyper
ccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtg

SEQ ID NO: 21749 - DNA, 65 bp, Homo sapiens; identical to SEQ ID NO: 11743
  chr13:112724425-112724490
  hyper

SEQ ID NO: 21750 - DNA, 60 bp, Homo sapiens
  chr13:112726560-112726620
  hyper
cggactccagcgccccctcgaccccgtcgggctccggccgactcccgccccctccccacc

SEQ ID NO: 21751 - DNA, 157 bp, Homo sapiens; identical to SEQ ID NO: 11745
  chr13:112726982-112727139
  hyper

SEQ ID NO: 21752 - DNA, 95 bp, Homo sapiens
  chr13:112758012-112758107
  hyper
tgcaggcggggggaccgcgcgcttggctcgaagaccccgccctgggcaggggacagaaaatatgaaatcagatggggagttatgaataactgtcc

SEQ ID NO: 21753 - DNA, 17 bp, Homo sapiens
  chr13:112758257-112758274
  hyper
acttttctcagtgtggg

SEQ ID NO: 21754 - DNA, 78 bp, Homo sapiens
  chr13:112758613-112758691
  hyper
gccctattcagcggggcccggggaccctgggggccgagcgaggccagcccgggcgggagcaccgccgccagcgcgcgc

SEQ ID NO: 21755 - DNA, 159 bp, Homo sapiens
  chr13:112759248-112759407
  hyper
tgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcggg

SEQ ID NO: 21756 - DNA, 40 bp, Homo sapiens
  chr13:112759642-112759682
  hyper
tcacaatcacttatctggaaacctgcggttggattaatcg

SEQ ID NO: 21757 - DNA, 30 bp, Homo sapiens; identical to SEQ ID NO: 11752
  chr13:113547121-113547151
  hyper

SEQ ID NO: 21758 - DNA, 51 bp, Homo sapiens; identical to SEQ ID NO: 11753
  chr13:114462901-114462952
  hyper

SEQ ID NO: 21759 - DNA, 82 bp, Homo sapiens
  chr14:21093631-21093713
  hyper
aggatcctgaagtactaacactttctaactagtaaaataattaaatcttcctttcccaggattctcccggattacacagcat

SEQ ID NO: 21760 - DNA, 165 bp, Homo sapiens; identical to SEQ ID NO: 11756
  chr14:21100842-21101007
  hyper

SEQ ID NO: 21761 - DNA, 3 bp, Homo sapiens
  chr14:21101008-21101011
  hyper
gaa

SEQ ID NO: 21762 - DNA, 19 bp, Homo sapiens
  chr14:21101037-21101056
  hyper
cgcacgttgactttcctgg

SEQ ID NO: 21763 - DNA, 30 bp, Homo sapiens; identical to SEQ ID NO: 11759
  chr14:21121400-21121430
  hyper

SEQ ID NO: 21764 - DNA, 15 bp, Homo sapiens
  chr14:21121902-21121917
  hyper
ctcatcccccacccc

SEQ ID NO: 21765 - DNA, 44 bp, Homo sapiens; identical to SEQ ID NO: 11761
  chr14:21769210-21769254
  hyper

SEQ ID NO: 21766 - DNA, 30 bp, Homo sapiens; identical to SEQ ID NO: 11762
  chr14:23291877-23291907
  hyper

SEQ ID NO: 21767 - DNA, 112 bp, Homo sapiens; identical to SEQ ID NO: 11763
  chr14:23821464-23821576
  hyper

SEQ ID NO: 21768 - DNA, 21 bp, Homo sapiens
  chr14:23821601-23821622
  hyper
cgctcccgctcaccctgcagc

SEQ ID NO: 21769 - DNA, 23 bp, Homo sapiens
  chr14:24804424-24804447
  hyper
cgcctccccgcttcagccccttc

SEQ ID NO: 21770 - DNA, 190 bp, Homo sapiens; identical to SEQ ID NO: 11768
  chr14:25518450-25518640
  hyper

SEQ ID NO: 21771 - DNA, 193 bp, Homo sapiens
  chr14:26674384-26674577
  hyper
ggaaggcgagagggagatggggagaaggagactcggagacttctctattaaagccgcgctgaactctagccttctggcaagccgcggcaagccgccaatttgaagtgtgtgagctttaatctgctcctagcctgatgggctcccgtgtccacagggagctgggaggcatccattacgccggaccaaggagatg

SEQ ID NO: 21772 - DNA, 30 bp, Homo sapiens; identical to SEQ ID NO: 11770
  chr14:27066218-27066248
  hyper

SEQ ID NO: 21773 - DNA, 60 bp, Homo sapiens; identical to SEQ ID NO: 11772
  chr14:27067097-27067157
  hyper

SEQ ID NO: 21774 - DNA, 44 bp, Homo sapiens; identical to SEQ ID NO: 11773
  chr14:27067635-27067679
  hyper

SEQ ID NO: 21775 - DNA, 30 bp, Homo sapiens; identical to SEQ ID NO: 11774
  chr14:29225698-29225728
  hyper

SEQ ID NO: 21776 - DNA, 38 bp, Homo sapiens
  chr14:29226033-29226071
  hyper
gagatctcagatcttcgcgtttggggtggggagtgggg

SEQ ID NO: 21777 - DNA, 43 bp, Homo sapiens; identical to SEQ ID NO: 11776
  chr14:29226360-29226403
  hyper

SEQ ID NO: 21778 - DNA, 30 bp, Homo sapiens; identical to SEQ ID NO: 11777
  chr14:29227895-29227925
  hyper

SEQ ID NO: 21779 - DNA, 151 bp, Homo sapiens; identical to SEQ ID NO: 11778
  chr14:29228268-29228419
  hyper

SEQ ID NO: 21780 - DNA, 26 bp, Homo sapiens
  chr14:29228628-29228654
  hyper
agaaaacctcttcaccgcggtgattc

SEQ ID NO: 21781 - DNA, 206 bp, Homo sapiens
  chr14:29228778-29228984
  hyper
gattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgtta

SEQ ID NO: 21782 - DNA, 30 bp, Homo sapiens; identical to SEQ ID NO: 11782
  chr14:29230911-29230941
  hyper

SEQ ID NO: 21783 - DNA, 38 bp, Homo sapiens; identical to SEQ ID NO: 11783
  chr14:29231293-29231331
  hyper

SEQ ID NO: 21784 - DNA, 150 bp, Homo sapiens
  chr14:29234853-29235003
  hyper
tgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaagga

SEQ ID NO: 21785 - DNA, 61 bp, Homo sapiens; identical to SEQ ID NO: 11785
  chr14:29236023-29236084
  hyper

SEQ ID NO: 21786 - DNA, 89 bp, Homo sapiens; identical to SEQ ID NO: 11786
  chr14:29236672-29236761
  hyper

SEQ ID NO: 21787 - DNA, 63 bp, Homo sapiens; identical to SEQ ID NO: 11788
  chr14:29243208-29243271
  hyper

SEQ ID NO: 21788 - DNA, 199 bp, Homo sapiens
  chr14:29243888-29244087
  hyper
tccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccat

SEQ ID NO: 21789 - DNA, 163 bp, Homo sapiens; identical to SEQ ID NO: 11791
  chr14:29247187-29247350
  hyper

SEQ ID NO: 21790 - DNA, 15 bp, Homo sapiens
  chr14:29254425-29254440
  hyper
ggcgcccgcagaagc

SEQ ID NO: 21791 - DNA, 137 bp, Homo sapiens; identical to SEQ ID NO: 11794
  chr14:31343407-31343544
  hyper

SEQ ID NO: 21792 - DNA, 31 bp, Homo sapiens
  chr14:31344315-31344346
  hyper
gggggagctggggtgcgtccaggcggtcgca

SEQ ID NO: 21793 - DNA, 90 bp, Homo sapiens; identical to SEQ ID NO: 11796
  chr14:33402367-33402457
  hyper

SEQ ID NO: 21794 - DNA, 81 bp, Homo sapiens
  chr14:33402762-33402843
  hyper
ggctcgccagccggaagaaagaggaggaagtgggacaacgggggtcctgggcaggggtaggggaaacgatcaactcccact

SEQ ID NO: 21795 - DNA, 16 bp, Homo sapiens
  chr14:33403316-33403332
  hyper
gcgctgcctgatgtgc

SEQ ID NO: 21796 - DNA, 30 bp, Homo sapiens; identical to SEQ ID NO: 11799
  chr14:33403549-33403579
  hyper

SEQ ID NO: 21797 - DNA, 20 bp, Homo sapiens
  chr14:33403846-33403866
  hyper
ccccagcccgctgcgcgcac

SEQ ID NO: 21798 - DNA, 218 bp, Homo sapiens
  chr14:36004493-36004711
  hyper
attgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccag

SEQ ID NO: 21799 - DNA, 83 bp, Homo sapiens; identical to SEQ ID NO: 11804
  chr14:36972706-36972789
  hyper

SEQ ID NO: 21800 - DNA, 46 bp, Homo sapiens; identical to SEQ ID NO: 11807
  chr14:36975034-36975080
  hyper

SEQ ID NO: 21801 - DNA, 58 bp, Homo sapiens
  chr14:36975399-36975457
  hyper
tgcgctcgcggagaataaagggggcgctgtccaacctcaggttcggggaaaaccaagg

SEQ ID NO: 21802 - DNA, 142 bp, Homo sapiens
  chr14:36977503-36977645
  hyper
ggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggc

SEQ ID NO: 21803 - DNA, 30 bp, Homo sapiens; identical to SEQ ID NO: 11810
  chr14:36983330-36983360
  hyper

SEQ ID NO: 21804 - DNA, 437 bp, Homo sapiens; identical to SEQ ID NO: 11816
  chr14:36989763-36990200
  hyper

SEQ ID NO: 21805 - DNA, 41 bp, Homo sapiens; identical to SEQ ID NO: 11817
  chr14:36990493-36990534
  hyper

SEQ ID NO: 21806 - DNA, 30 bp, Homo sapiens; identical to SEQ ID NO: 11818
  chr14:36990535-36990565
  hyper

SEQ ID NO: 21807 - DNA, 9 bp, Homo sapiens
  chr14:36991177-36991186
  hyper
tgagtcccg

SEQ ID NO: 21808 - DNA, 165 bp, Homo sapiens
  chr14:36991613-36991778
  hyper
cccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctgggg

SEQ ID NO: 21809 - DNA, 35 bp, Homo sapiens
  chr14:36993438-36993473
  hyper
cccctcagttgctcccgcagtctcccacagctagg

SEQ ID NO: 21810 - DNA, 10 bp, Homo sapiens
  chr14:36994999-36995009
  hyper
catcatccac

SEQ ID NO: 21811 - DNA, 40 bp, Homo sapiens; identical to SEQ ID NO: 4090
  chr14:36995010-36995050
  hyper

SEQ ID NO: 21812 - DNA, 387 bp, Homo sapiens; identical to SEQ ID NO: 11829
  chr14:37116983-37117370
  hyper

SEQ ID NO: 21813 - DNA, 107 bp, Homo sapiens
  chr14:37125545-37125652
  hyper
gactgggggcgactcgcaagggcatcatgccacctagaggaaacgcgcagtgagtgagccctgggtcactgaaaatgggagaacgttcgagtcggtcaagatgactc

SEQ ID NO: 21814 - DNA, 85 bp, Homo sapiens
  chr14:37126156-37126241
  hyper
gcaaccctggcaagacgaaatccccctccctctggctagatcagcccagcctcccctcagggaccttcctgcccctccctacccc

SEQ ID NO: 21815 - DNA, 32 bp, Homo sapiens
  chr14:37126297-37126329
  hyper
cttgcaatcccgcagcccggagttttgccccg

SEQ ID NO: 21816 - DNA, 18 bp, Homo sapiens
  chr14:37126548-37126566
  hyper
gaaaacttccaaatgcgc

SEQ ID NO: 21817 - DNA, 169 bp, Homo sapiens; identical to SEQ ID NO: 11836
  chr14:37126964-37127133
  hyper

SEQ ID NO: 21818 - DNA, 118 bp, Homo sapiens
  chr14:37127537-37127655
  hyper
cgagtggacaagaggcgggcaccgtcgcctgggcctcgcttggggggggggggtcctgtccccagcagggggcaagttggaggaatcagctccttaatattttctgctagctctgctt

SEQ ID NO: 21819 - DNA, 30 bp, Homo sapiens; identical to SEQ ID NO: 11839
  chr14:37130494-37130524
  hyper

SEQ ID NO: 21820 - DNA, 85 bp, Homo sapiens
  chr14:37132290-37132375
  hyper
cgatcttgccaggagccatcgggggcagcaagccccgggtcactacccccaccgtggtgaaacacatccggacctacaagcagag

SEQ ID NO: 21821 - DNA, 163 bp, Homo sapiens
  chr14:37132838-37133001
  hyper
tttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttcca

SEQ ID NO: 21822 - DNA, 59 bp, Homo sapiens
  chr14:37133052-37133111
  hyper
gagagtgcggccggggctggacttggggcgcagcccgggaggcccgagcctgcttgggg

SEQ ID NO: 21823 - DNA, 16 bp, Homo sapiens
  chr14:37136345-37136361
  hyper
gcggagaggggcaccc

SEQ ID NO: 21824 - DNA, 30 bp, Homo sapiens; identical to SEQ ID NO: 11845
  chr14:38052911-38052941
  hyper

SEQ ID NO: 21825 - DNA, 30 bp, Homo sapiens; identical to SEQ ID NO: 11846
  chr14:38057303-38057333
  hyper

SEQ ID NO: 21826 - DNA, 102 bp, Homo sapiens
  chr14:38725258-38725360
  hyper
aacttggatctgtcccgctcgaggacgcagagctgtgtctggagcgcggtcaccgccctctacagctggcttccccaacccggttccccctcccttcccctc

SEQ ID NO: 21827 - DNA, 183 bp, Homo sapiens; identical to SEQ ID NO: 11850
  chr14:42075097-42075280
  hyper

SEQ ID NO: 21828 - DNA, 50 bp, Homo sapiens
  chr14:42075538-42075588
  hyper
gttcttttcagaatccgctcccatctgattagtaagcaaatcaccaccca

SEQ ID NO: 21829 - DNA, 20 bp, Homo sapiens
  chr14:42076803-42076823
  hyper
gcaaatgtgttaactcggcg

SEQ ID NO: 21830 - DNA, 114 bp, Homo sapiens
  chr14:42076853-42076967
  hyper
ctctgaggacgcccagacccattttcctggctggatttggagcggctgctgggctgtggacccaggtgtgtggatcgctttacccagaagcttggaaagcgccaatattaacct

SEQ ID NO: 21831 - DNA, 227 bp, Homo sapiens
  chr14:42079062-42079289
  hyper
tgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacgg

SEQ ID NO: 21832 - DNA, 100 bp, Homo sapiens
  chr14:42079328-42079428
  hyper
gaccccctggcagacagcaagcgcatcgtggccgaggcggccgcctggatgcgagaggagggagatgcccagagccacagaggagcgtggagggcggtgg

SEQ ID NO: 21833 - DNA, 102 bp, Homo sapiens; identical to SEQ ID NO: 11855
  chr14:48143617-48143719
  hyper

SEQ ID NO: 21834 - DNA, 105 bp, Homo sapiens
  chr14:48145257-48145362
  hyper
gctgctgggctgctgggctgccggggaggaaggctgtgtgtggtcacgttgtgcgctacgtgctgagagcgcgagctgctagccgcagccgggcgacgtcaaagc

SEQ ID NO: 21835 - DNA, 197 bp, Homo sapiens; identical to SEQ ID NO: 4105
  chr14:48145469-48145666
  hyper

SEQ ID NO: 21836 - DNA, 51 bp, Homo sapiens; identical to SEQ ID NO: 11859
  chr14:51410612-51410663
  hyper

SEQ ID NO: 21837 - DNA, 92 bp, Homo sapiens
  chr14:51561428-51561520
  hyper
cgctgtccgcctcgctgtataggctcatcttgtccaggtccagatagtcatagtcggagaccccggagcccgcggcccgatggctctggggg

SEQ ID NO: 21838 - DNA, 74 bp, Homo sapiens; identical to SEQ ID NO: 11863
  chr14:51562419-51562493
  hyper

SEQ ID NO: 21839 - DNA, 221 bp, Homo sapiens
  chr14:52534791-52535012
  hyper
gatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctgg

SEQ ID NO: 21840 - DNA, 220 bp, Homo sapiens
  chr14:54422431-54422651
  hyper
aagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaag

SEQ ID NO: 21841 - DNA, 34 bp, Homo sapiens; identical to SEQ ID NO: 11874
  chr14:54422926-54422960
  hyper

SEQ ID NO: 21842 - DNA, 260 bp, Homo sapiens; identical to SEQ ID NO: 11875
  chr14:54430156-54430416
  hyper

SEQ ID NO: 21843 - DNA, 71 bp, Homo sapiens
  chr14:57260875-57260946
  hyper
attcgttaaaccagccgtctaaacgggccctggcactgggtatccgaccgctccacgcgccagctggtgag

SEQ ID NO: 21844 - DNA, 26 bp, Homo sapiens
  chr14:57261821-57261847
  hyper
gcaccggagcccgaagtcttccccac

SEQ ID NO: 21845 - DNA, 30 bp, Homo sapiens; identical to SEQ ID NO: 11880
  chr14:57263831-57263861
  hyper

SEQ ID NO: 21846 - DNA, 57 bp, Homo sapiens; identical to SEQ ID NO: 11884
  chr14:57265517-57265574
  hyper

SEQ ID NO: 21847 - DNA, 30 bp, Homo sapiens; identical to SEQ ID NO: 11888
  chr14:57273051-57273081
  hyper

SEQ ID NO: 21848 - DNA, 69 bp, Homo sapiens
  chr14:57274417-57274486
  hyper
gattctctccacaaccggcctaggtatgcactctgcatagaaggcatgggcccttcaatctaactttca

SEQ ID NO: 21849 - DNA, 111 bp, Homo sapiens
  chr14:57275485-57275596
  hyper
agggtcggcgccgctcggccttcgctccccgcgcaccagttctatctgtgaaggaagcaaaagccaactcggtggaatcctgacaggggacttgggtttccaaaaatatgt

SEQ ID NO: 21850 - DNA, 336 bp, Homo sapiens
  chr14:57276104-57276440
  hyper
gggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatc

SEQ ID NO: 21851 - DNA, 30 bp, Homo sapiens; identical to SEQ ID NO: 11897
  chr14:57281138-57281168
  hyper

SEQ ID NO: 21852 - DNA, 15 bp, Homo sapiens
  chr14:57283299-57283314
  hyper
catacctgagataca

SEQ ID NO: 21853 - DNA, 43 bp, Homo sapiens
  chr14:58332254-58332297
  hyper
cagcaccgaggacagcggacatacttttctccccggggggtcc

SEQ ID NO: 21854 - DNA, 68 bp, Homo sapiens; identical to SEQ ID NO: 11902
  chr14:58332640-58332708
  hyper

SEQ ID NO: 21855 - DNA, 30 bp, Homo sapiens; identical to SEQ ID NO: 11903
  chr14:60043273-60043303
  hyper

SEQ ID NO: 21856 - DNA, 44 bp, Homo sapiens
  chr14:60097566-60097610
  hyper
aggtttgggaggaggggaaaaagggctgacggtgggggtgagag

SEQ ID NO: 21857 - DNA, 42 bp, Homo sapiens; identical to SEQ ID NO: 11906
  chr14:60336952-60336994
  hyper

SEQ ID NO: 21858 - DNA, 18 bp, Homo sapiens
  chr14:60386701-60386719
  hyper
ttccgctgattggttgga

SEQ ID NO: 21859 - DNA, 162 bp, Homo sapiens
  chr14:60794473-60794635
  hyper
ttaaaaaaatatcctcgtggcttaatgaccaaggcgggtttattctcaaggaagggggagcggcgtggtggtgttactaaacataacagatggcagctgtctgcggctatatagggcgcgctgacaaatccctctggatggccacgcggcgctgggctgcgg

SEQ ID NO: 21860 - DNA, 136 bp, Homo sapiens
  chr14:60794667-60794803
  hyper
gcgccgcctgcgggaggacctccgggagccgagctgcctccccgcaaacccggcccgggcccacgcgggctcagggcgccaggcggggtgcgccgaggtgcagctccccggccctaggcttcgctggggtgggggt

SEQ ID NO: 21861 - DNA, 17 bp, Homo sapiens
  chr14:60978147-60978164
  hyper
ggcgccctttggccgcg

SEQ ID NO: 21862 - DNA, 408 bp, Homo sapiens
  chr14:60981268-60981676
  hyper
gacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcg

SEQ ID NO: 21863 - DNA, 40 bp, Homo sapiens
  chr14:60982911-60982951
  hyper
acaagcagtttcacgcctccctgcccgctcatgctgtttc

SEQ ID NO: 21864 - DNA, 50 bp, Homo sapiens
  chr14:61104241-61104291
  hyper
cggttgcaccccggacccctgcagctgtggacgccggagctgtgcgcagt

SEQ ID NO: 21865 - DNA, 111 bp, Homo sapiens
  chr14:61109728-61109839
  hyper
ctgtgccaggtgtcccgttggccctcagcggacaagggagagccgctaataagggtcgctgctcagcaaactcagagctcatccataagtgccaacgccactgcttctttc

SEQ ID NO: 21866 - DNA, 257 bp, Homo sapiens
  chr14:61114456-61114713
  hyper
gccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgagga

SEQ ID NO: 21867 - DNA, 314 bp, Homo sapiens
  chr14:61114997-61115311
  hyper
caacatttcactgcccgttgatttagaaactcactctccacccaccactcatagccgcggccagccagggaggcataaagaccaaatctagcgccaatatttcccgacactcacatcccagagaaacccacgcgcgggtgctcaaagcaaatgaggccccatccttagcaaggaacctcagagttcatgaactttcgctgcagcgccgcggagggcctgcgcgccgccccgtggacgggctccggccggcggggaggacttggtggctggtgcctgcgggggcgggagggggcggaggagaaaggacggcttcc

SEQ ID NO: 21868 - DNA, 122 bp, Homo sapiens; identical to SEQ ID NO: 11927
  chr14:61115927-61116049
  hyper

SEQ ID NO: 21869 - DNA, 30 bp, Homo sapiens; identical to SEQ ID NO: 11928
  chr14:61116998-61117028
  hyper

SEQ ID NO: 21870 - DNA, 30 bp, Homo sapiens; identical to SEQ ID NO: 11929
  chr14:61655802-61655832
  hyper

SEQ ID NO: 21871 - DNA, 73 bp, Homo sapiens; identical to SEQ ID NO: 11930
  chr14:61788757-61788830
  hyper

SEQ ID NO: 21872 - DNA, 154 bp, Homo sapiens; identical to SEQ ID NO: 4151
  chr14:62279322-62279476
  hyper

SEQ ID NO: 21873 - DNA, 59 bp, Homo sapiens
  chr14:62279519-62279578
  hyper
cgactgacagtgagtgcgctccggccgcggaggccaggggtggggggaggccgcggtgc

SEQ ID NO: 21874 - DNA, 59 bp, Homo sapiens
  chr14:62583750-62583809
  hyper
agccaaggcctgcagcgagtgacctgcccggggaggcgcgggaccgaggctcacctacc

SEQ ID NO: 21875 - DNA, 348 bp, Homo sapiens; identical to SEQ ID NO: 11936
  chr14:62583918-62584266
  hyper

SEQ ID NO: 21876 - DNA, 124 bp, Homo sapiens; identical to SEQ ID NO: 4155
  chr14:63511883-63512007
  hyper

SEQ ID NO: 21877 - DNA, 37 bp, Homo sapiens
  chr14:63512063-63512100
  hyper
cgacccggatgagcagctctggggaggaggaccaggc

SEQ ID NO: 21878 - DNA, 282 bp, Homo sapiens
  chr14:63512291-63512573
  hyper
tctgcatctctccccctgctggggagcgcaagcgggaactcaagcccccaccctcccaatccccctcagctcagaccgagaccccttccccgcgccttcgtctcccggtctcctcgtccaccccctcgcgcagcgagctccgggctgaacagcgtagcccaacttctgggctgtgcgcctggtggttgctcctctccccggagatcgaggcaagcgatcgctgtccaatcgggccggtggaatgggagaagagggtgccagagagagcagtggccagtcgga

SEQ ID NO: 21879 - DNA, 5 bp, Homo sapiens
  chr14:63512816-63512821
  hyper
ccacc

SEQ ID NO: 21880 - DNA, 73 bp, Homo sapiens; identical to SEQ ID NO: 4158
  chr14:63513035-63513108
  hyper

SEQ ID NO: 21881 - DNA, 66 bp, Homo sapiens; identical to SEQ ID NO: 11941
  chr14:64761073-64761139
  hyper

SEQ ID NO: 21882 - DNA, 15 bp, Homo sapiens
  chr14:65007522-65007537
  hyper
tctccctggttttcc

SEQ ID NO: 21883 - DNA, 15 bp, Homo sapiens
  chr14:65007552-65007567
  hyper
cgcctttcagtcagg

SEQ ID NO: 21884 - DNA, 7 bp, Homo sapiens
  chr14:65009193-65009200
  hyper
aacgccc

SEQ ID NO: 21885 - DNA, 282 bp, Homo sapiens; identical to SEQ ID NO: 11945
  chr14:69726381-69726663
  hyper

SEQ ID NO: 21886 - DNA, 34 bp, Homo sapiens; identical to SEQ ID NO: 11946
  chr14:69727831-69727865
  hyper

SEQ ID NO: 21887 - DNA, 24 bp, Homo sapiens
  chr14:70014699-70014723
  hyper
acagacaaagccttgcgggctcca

SEQ ID NO: 21888 - DNA, 116 bp, Homo sapiens
  chr14:70346020-70346136
  hyper
cacctgccagagggtcggcttcaacaggcctcttggcccgtcaatcaggcccgccgtgctccgccccgcccctcccgggggtttataacgggaattcccatggcccgggctcaggc

SEQ ID NO: 21889 - DNA, 39 bp, Homo sapiens
  chr14:70346491-70346530
  hyper
agggtaagtgcgcccccagctttgcgcccacctgcggag

SEQ ID NO: 21890 - DNA, 66 bp, Homo sapiens; identical to SEQ ID NO: 11949
  chr14:70653713-70653779
  hyper

SEQ ID NO: 21891 - DNA, 220 bp, Homo sapiens; identical to SEQ ID NO: 1184
  chr14:70654070-70654290
  hyper

SEQ ID NO: 21892 - DNA, 52 bp, Homo sapiens
  chr14:70654291-70654343
  hyper
ctagcctctgaatcagggctttgactgtgtgtgtgtgtgtgtgtgtgtgtgt

SEQ ID NO: 21893 - DNA, 74 bp, Homo sapiens
  chr14:70654713-70654787
  hyper
acacacaacacagcagtcagtctccccaaacagcacccgctaccaacccagcatgctcacgatccaactgtacc

SEQ ID NO: 21894 - DNA, 498 bp, Homo sapiens
  chr14:70655032-70655530
  hyper
ctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctc

SEQ ID NO: 21895 - DNA, 57 bp, Homo sapiens
  chr14:72398686-72398743
  hyper
ttttaatttagagggcgccagcaacacgtcagtgagggagattcagaagccgccggg

SEQ ID NO: 21896 - DNA, 214 bp, Homo sapiens
  chr14:72399019-72399233
  hyper
gcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgc

SEQ ID NO: 21897 - DNA, 61 bp, Homo sapiens; identical to SEQ ID NO: 11959
  chr14:74208236-74208297
  hyper

SEQ ID NO: 21898 - DNA, 175 bp, Homo sapiens
  chr14:74706222-74706397
  hyper
agctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccc

SEQ ID NO: 21899 - DNA, 38 bp, Homo sapiens
  chr14:74707873-74707911
  hyper
ccgcttttcagattctgaagatgtttcctccagcgatc

SEQ ID NO: 21900 - DNA, 418 bp, Homo sapiens; identical to SEQ ID NO: 1192
  chr14:74707912-74708330
  hyper

SEQ ID NO: 21901 - DNA, 81 bp, Homo sapiens
  chr14:74708955-74709036
  hyper
gggccgccacagactctgcgccctttcaagacatttctccactagggcgttctctggcacccccgccgccacatcgttttc

SEQ ID NO: 21902 - DNA, 30 bp, Homo sapiens; identical to SEQ ID NO: 11967
  chr14:75077906-75077936
  hyper

SEQ ID NO: 21903 - DNA, 185 bp, Homo sapiens; identical to SEQ ID NO: 11968
  chr14:75078651-75078836
  hyper

SEQ ID NO: 21904 - DNA, 85 bp, Homo sapiens
  chr14:76604597-76604682
  hyper
tcagggttggcttcacggaggagggggtatctgagctgagctttgatgaatacgtcagatttgggggaaaggttgctgctggata

SEQ ID NO: 21905 - DNA, 89 bp, Homo sapiens
  chr14:76604716-76604805
  hyper
tgccaacaggtcagggggggaaagttggggaatggggtgggaggaggaagaattagactggccccttccatcatcgccatccttctgtg

SEQ ID NO: 21906 - DNA, 32 bp, Homo sapiens
  chr14:76605040-76605072
  hyper
caagaaaaaagggagcgcagcgccgttcccac

SEQ ID NO: 21907 - DNA, 92 bp, Homo sapiens; identical to SEQ ID NO: 11971
  chr14:76819300-76819392
  hyper

SEQ ID NO: 21908 - DNA, 10 bp, Homo sapiens
  chr14:76843732-76843742
  hyper
cgctccacct

SEQ ID NO: 21909 - DNA, 41 bp, Homo sapiens
  chr14:76843953-76843994
  hyper
ccaagtcagcgtttctccagttccaccgtgctttcatttgt

SEQ ID NO: 21910 - DNA, 102 bp, Homo sapiens; identical to SEQ ID NO: 11973
  chr14:77227622-77227724
  hyper

SEQ ID NO: 21911 - DNA, 60 bp, Homo sapiens; identical to SEQ ID NO: 11974
  chr14:77228674-77228734
  hyper

SEQ ID NO: 21912 - DNA, 46 bp, Homo sapiens; identical to SEQ ID NO: 11975
  chr14:77591352-77591398
  hyper

SEQ ID NO: 21913 - DNA, 43 bp, Homo sapiens; identical to SEQ ID NO: 11976
  chr14:77606813-77606856
  hyper

SEQ ID NO: 21914 - DNA, 89 bp, Homo sapiens; identical to SEQ ID NO: 11978
  chr14:77607253-77607342
  hyper

SEQ ID NO: 21915 - DNA, 177 bp, Homo sapiens; identical to SEQ ID NO: 11979
  chr14:77607930-77608107
  hyper

SEQ ID NO: 21916 - DNA, 75 bp, Homo sapiens; identical to SEQ ID NO: 11980
  chr14:77737071-77737146
  hyper

SEQ ID NO: 21917 - DNA, 65 bp, Homo sapiens
  chr14:77737147-77737212
  hyper
aggcagcctccacccgcatccccgggcgctcgtgtagccctcacctggcaaacaggacggtgccg

SEQ ID NO: 21918 - DNA, 148 bp, Homo sapiens; identical to SEQ ID NO: 11982
  chr14:77964498-77964646
  hyper

SEQ ID NO: 21919 - DNA, 30 bp, Homo sapiens; identical to SEQ ID NO: 11983
  chr14:78624601-78624631
  hyper

SEQ ID NO: 21920 - DNA, 10 bp, Homo sapiens
  chr14:85999522-85999532
  hyper
gctccaggag

SEQ ID NO: 21921 - DNA, 57 bp, Homo sapiens
  chr14:85999613-85999670
  hyper
aaacatatccgggggtgtcaggaggggtaggggtgggggccgcggcgcctacattag

SEQ ID NO: 21922 - DNA, 120 bp, Homo sapiens; identical to SEQ ID NO: 11990
  chr14:88789455-88789575
  hyper

SEQ ID NO: 21923 - DNA, 90 bp, Homo sapiens; identical to SEQ ID NO: 11991
  chr14:88790076-88790166
  hyper

SEQ ID NO: 21924 - DNA, 67 bp, Homo sapiens; identical to SEQ ID NO: 11992
  chr14:88790467-88790534
  hyper

SEQ ID NO: 21925 - DNA, 80 bp, Homo sapiens; identical to SEQ ID NO: 11993
  chr14:88793005-88793085
  hyper

SEQ ID NO: 21926 - DNA, 487 bp, Homo sapiens; identical to SEQ ID NO: 4176
  chr14:90084100-90084587
  hyper

SEQ ID NO: 21927 - DNA, 266 bp, Homo sapiens; identical to SEQ ID NO: 11996
  chr14:90526555-90526821
  hyper

SEQ ID NO: 21928 - DNA, 173 bp, Homo sapiens
  chr14:90527758-90527931
  hyper
tcggacgccgcagccctcggacgccgctcagcacagcccctctctccgtgcgcccgccctggaccccctccatccctaagccccggcagccgattcggagactcgggaggccacaggctcagcgcgacaccacgaccacaactaggaggcaccatcgtcgatctacctgggga

SEQ ID NO: 21929 - DNA, 118 bp, Homo sapiens; identical to SEQ ID NO: 11998
  chr14:90528584-90528702
  hyper

SEQ ID NO: 21930 - DNA, 53 bp, Homo sapiens; identical to SEQ ID NO: 11999
  chr14:90850275-90850328
  hyper

SEQ ID NO: 21931 - DNA, 53 bp, Homo sapiens; identical to SEQ ID NO: 12000
  chr14:91580352-91580405
  hyper

SEQ ID NO: 21932 - DNA, 38 bp, Homo sapiens; identical to SEQ ID NO: 12001
  chr14:92040828-92040866
  hyper

SEQ ID NO: 21933 - DNA, 10 bp, Homo sapiens
  chr14:92789502-92789512
  hyper
cctctcagac

SEQ ID NO: 21934 - DNA, 20 bp, Homo sapiens
  chr14:92789802-92789822
  hyper
agggctgtggccgggcgagc

SEQ ID NO: 21935 - DNA, 201 bp, Homo sapiens
  chr14:92790436-92790637
  hyper
gccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctc

SEQ ID NO: 21936 - DNA, 53 bp, Homo sapiens; identical to SEQ ID NO: 12006
  chr14:92979781-92979834
  hyper

SEQ ID NO: 21937 - DNA, 232 bp, Homo sapiens; identical to SEQ ID NO: 12007
  chr14:92980429-92980661
  hyper

SEQ ID NO: 21938 - DNA, 242 bp, Homo sapiens; identical to SEQ ID NO: 12010
  chr14:93897200-93897442
  hyper

SEQ ID NO: 21939 - DNA, 54 bp, Homo sapiens
  chr14:94254335-94254389
  hyper
agctccagaatactgcgtgcataccttggccccatggacacctccagaaacagc

SEQ ID NO: 21940 - DNA, 124 bp, Homo sapiens
  chr14:94254513-94254637
  hyper
atccccgtgcacacccaccgactcctgcctgcaccctcgctgaccctgcatgcacggccccaagaaatctcacgctgcctgcacccacactgcccagccggcctcattgcgcacactgcaacat

SEQ ID NO: 21941 - DNA, 7 bp, Homo sapiens
  chr14:94255277-94255284
  hyper
accctca

SEQ ID NO: 21942 - DNA, 42 bp, Homo sapiens; identical to SEQ ID NO: 12014
  chr14:94255304-94255346
  hyper

SEQ ID NO: 21943 - DNA, 23 bp, Homo sapiens
  chr14:94255584-94255607
  hyper
cccccaagcctctcccgaggctg

SEQ ID NO: 21944 - DNA, 46 bp, Homo sapiens; identical to SEQ ID NO: 12016
  chr14:94255669-94255715
  hyper

SEQ ID NO: 21945 - DNA, 33 bp, Homo sapiens
  chr14:94405701-94405734
  hyper
ttgtgcgcaggcagccgtggcggatggccacga

SEQ ID NO: 21946 - DNA, 203 bp, Homo sapiens
  chr14:94405785-94405988
  hyper
gctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcgg

SEQ ID NO: 21947 - DNA, 14 bp, Homo sapiens
  chr14:95235369-95235383
  hyper
ctggaagaggttct

SEQ ID NO: 21948 - DNA, 30 bp, Homo sapiens; identical to SEQ ID NO: 12019
  chr14:95235665-95235695
  hyper

SEQ ID NO: 21949 - DNA, 79 bp, Homo sapiens
  chr14:95236111-95236190
  hyper
tgtagccgaggcgggagccgctgaccgcggccgggaggcccgcgccgccgggggccacggggcgcgggtagaaggcgcc

SEQ ID NO: 21950 - DNA, 30 bp, Homo sapiens; identical to SEQ ID NO: 12021
  chr14:95237011-95237041
  hyper

SEQ ID NO: 21951 - DNA, 30 bp, Homo sapiens; identical to SEQ ID NO: 12023
  chr14:95240484-95240514
  hyper

SEQ ID NO: 21952 - DNA, 24 bp, Homo sapiens
  chr14:96342286-96342310
  hyper
aagccacattcgccacgctcccgc

SEQ ID NO: 21953 - DNA, 26 bp, Homo sapiens
  chr14:96342605-96342631
  hyper
cgcagcgcgcgtcagcgggggctccc

SEQ ID NO: 21954 - DNA, 5 bp, Homo sapiens
  chr14:96342892-96342897
  hyper
ttgcg

SEQ ID NO: 21955 - DNA, 2 bp, Homo sapiens
  chr14:96343433-96343435
  hyper
cc

SEQ ID NO: 21956 - DNA, 84 bp, Homo sapiens
  chr14:96343701-96343785
  hyper
ctttcttctgccttctggagaaagatgtgggtttgacatgcaggcgggagacctgtctggtctagataacggcatgtgtatgca

SEQ ID NO: 21957 - DNA, 173 bp, Homo sapiens
  chr14:97499315-97499488
  hyper
gatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccc

SEQ ID NO: 21958 - DNA, 73 bp, Homo sapiens
  chr14:97684971-97685044
  hyper
agtgacgactggattcggaattttcctctcacttcgtggtagtgaagaatttaactacaacagtaacaacact

SEQ ID NO: 21959 - DNA, 131 bp, Homo sapiens; identical to SEQ ID NO: 4180
  chr14:97685497-97685628
  hyper

SEQ ID NO: 21960 - DNA, 6 bp, Homo sapiens
  chr14:99736183-99736189
  hyper
ccagag

SEQ ID NO: 21961 - DNA, 32 bp, Homo sapiens; identical to SEQ ID NO: 12035
  chr14:99740538-99740570
  hyper

SEQ ID NO: 21962 - DNA, 84 bp, Homo sapiens; identical to SEQ ID NO: 12036
  chr14:100111793-100111877
  hyper

SEQ ID NO: 21963 - DNA, 333 bp, Homo sapiens; identical to SEQ ID NO: 12037
  chr14:100125656-100125989
  hyper

SEQ ID NO: 21964 - DNA, 234 bp, Homo sapiens
  chr14:100437560-100437794
  hyper
ggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggcc

SEQ ID NO: 21965 - DNA, 160 bp, Homo sapiens; identical to SEQ ID NO: 12039
  chr14:100438017-100438177
  hyper

SEQ ID NO: 21966 - DNA, 30 bp, Homo sapiens; identical to SEQ ID NO: 12040
  chr14:100438385-100438415
  hyper

SEQ ID NO: 21967 - DNA, 74 bp, Homo sapiens
  chr14:100438631-100438705
  hyper
tctgcaaggggcaggcggcgctggctttggctgcttgtggggtcctcttaggctccggggggcctgcggcggcc

SEQ ID NO: 21968 - DNA, 120 bp, Homo sapiens
  chr14:100438811-100438931
  hyper
tgaagcccccaggcgttgccgaagcctccccctgccagcgcccagagccgcgtttgggcttttacaggtgtagtttcccctcgacttggagcccgtcaaccccttcgtctcctaattctc

SEQ ID NO: 21969 - DNA, 45 bp, Homo sapiens; identical to SEQ ID NO: 12042
  chr14:101033483-101033528
  hyper

SEQ ID NO: 21970 - DNA, 50 bp, Homo sapiens; identical to SEQ ID NO: 12043
  chr14:101034056-101034106
  hyper

SEQ ID NO: 21971 - DNA, 328 bp, Homo sapiens; identical to SEQ ID NO: 12044
  chr14:101035152-101035480
  hyper

SEQ ID NO: 21972 - DNA, 40 bp, Homo sapiens
  chr14:101543828-101543868
  hyper
gggatgcaatttccccggtgtttttcaggcccagagctat

SEQ ID NO: 21973 - DNA, 40 bp, Homo sapiens
  chr14:101923560-101923600
  hyper
aaaagaggttctcagcggagcgtgtgtgaggcggggggtt

SEQ ID NO: 21974 - DNA, 10 bp, Homo sapiens
  chr14:101924047-101924057
  hyper
tccccgacgc

SEQ ID NO: 21975 - DNA, 6 bp, Homo sapiens
  chr14:101924432-101924438
  hyper
aaaggc

SEQ ID NO: 21976 - DNA, 5 bp, Homo sapiens
  chr14:101924457-101924462
  hyper
cgttg

SEQ ID NO: 21977 - DNA, 191 bp, Homo sapiens
  chr14:101924858-101925049
  hyper
ggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgc

SEQ ID NO: 21978 - DNA, 81 bp, Homo sapiens
  chr14:101925901-101925982
  hyper
acccaggaaggacgcccgccgttcccagcaccccagcgtctgaaaaatgaatgtgaactccgcaagcgtgctcccgcggac

SEQ ID NO: 21979 - DNA, 146 bp, Homo sapiens
  chr14:102026214-102026360
  hyper
cgctggcggcggcggcggcttccgacttgggctcagaccccgccgctccagacaagtccccgcgactgcgacagtgtctcgggcagttcagctccccagacgggagacagaccctcgcgacctggttcaggccttgccctggggga

SEQ ID NO: 21980 - DNA, 274 bp, Homo sapiens; identical to SEQ ID NO: 12055
  chr14:102029904-102030178
  hyper

SEQ ID NO: 21981 - DNA, 48 bp, Homo sapiens; identical to SEQ ID NO: 12056
  chr14:102030756-102030804
  hyper

SEQ ID NO: 21982 - DNA, 120 bp, Homo sapiens
  chr14:102247792-102247912
  hyper
acccgcgtgggctcccgccgggccctcctgccgccccccagcctccccgcccctgcccttgccagcctgcgccttcctgggcgcctgacgcacccctctgccccaaccacgttttctcaa

SEQ ID NO: 21983 - DNA, 49 bp, Homo sapiens
  chr14:103021342-103021391
  hyper
cgctttgggtcttgtcgcgcccaggccagcgccagcccaggcttgccat

SEQ ID NO: 21984 - DNA, 85 bp, Homo sapiens
  chr14:103022003-103022088
  hyper
agcttctctggaagacctggtgctggtccgctctcccgggacctcattttccttatgtggacaacgggggcggggtcacagcagc

SEQ ID NO: 21985 - DNA, 90 bp, Homo sapiens; identical to SEQ ID NO: 12059
  chr14:103389798-103389888
  hyper

SEQ ID NO: 21986 - DNA, 101 bp, Homo sapiens; identical to SEQ ID NO: 12060
  chr14:103394683-103394784
  hyper

SEQ ID NO: 21987 - DNA, 112 bp, Homo sapiens
  chr14:103395101-103395213
  hyper
tgccgtcttccgcgactctgaccgcttctcctggcatgacccgcacctgtggcgctctggggacgaggcacctggcctcttcttcgtggacgccgagcgcgtgccctgccgc

SEQ ID NO: 21988 - DNA, 92 bp, Homo sapiens; identical to SEQ ID NO: 12062
  chr14:103550468-103550560
  hyper

SEQ ID NO: 21989 - DNA, 45 bp, Homo sapiens
  chr14:103655601-103655646
  hyper
agtgtgcaggggccaccctctccccagccccgccccccgagtcca

SEQ ID NO: 21990 - DNA, 44 bp, Homo sapiens; identical to SEQ ID NO: 12065
  chr14:103687345-103687389
  hyper

SEQ ID NO: 21991 - DNA, 18 bp, Homo sapiens
  chr14:103739949-103739967
  hyper
ctccgaggcttcctacgt

SEQ ID NO: 21992 - DNA, 7 bp, Homo sapiens
  chr14:103740430-103740437
  hyper
agtgcac

SEQ ID NO: 21993 - DNA, 102 bp, Homo sapiens; identical to SEQ ID NO: 12069
  chr14:103989352-103989454
  hyper

SEQ ID NO: 21994 - DNA, 35 bp, Homo sapiens; identical to SEQ ID NO: 12070
  chr14:104602310-104602345
  hyper

SEQ ID NO: 21995 - DNA, 65 bp, Homo sapiens; identical to SEQ ID NO: 12071
  chr14:104602711-104602776
  hyper

SEQ ID NO: 21996 - DNA, 36 bp, Homo sapiens; identical to SEQ ID NO: 12072
  chr14:104604637-104604673
  hyper

SEQ ID NO: 21997 - DNA, 130 bp, Homo sapiens
  chr14:104604902-104605032
  hyper
agccaccgcgctcctcgcgacactcgcaggctctgcgaacttccgagcggctgggccgggccatgggggcgcctcggggccggatcacgtagccgcggcgcccccggagagccagcgtggccgggagcgc

SEQ ID NO: 21998 - DNA, 156 bp, Homo sapiens
  chr14:104605114-104605270
  hyper
ggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcc

SEQ ID NO: 21999 - DNA, 91 bp, Homo sapiens; identical to SEQ ID NO: 12074
  chr14:105070996-105071087
  hyper

SEQ ID NO: 22000 - DNA, 47 bp, Homo sapiens; identical to SEQ ID NO: 12075
  chr14:105310190-105310237
  hyper

SEQ ID NO: 22001 - DNA, 77 bp, Homo sapiens; identical to SEQ ID NO: 12076
  chr14:105310576-105310653
  hyper

SEQ ID NO: 22002 - DNA, 62 bp, Homo sapiens
  chr14:105714334-105714396
  hyper
gctccagggctgcaggcccagggccagatcctgacttgcccacccgccggctgtgtgacctt

SEQ ID NO: 22003 - DNA, 60 bp, Homo sapiens
  chr15:23158337-23158397
  hyper
cgggtcaccgcaccccgagatgtgcccccaaggctctttcgaccgccgtgaagtggcggg

SEQ ID NO: 22004 - DNA, 38 bp, Homo sapiens
  chr15:23158489-23158527
  hyper
ggctcagtgtctagggccggtcccggcagccctctctc

SEQ ID NO: 22005 - DNA, 236 bp, Homo sapiens
  chr15:26107860-26108096
  hyper
cacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcg

SEQ ID NO: 22006 - DNA, 17 bp, Homo sapiens
  chr15:26327547-26327564
  hyper
ctgcgcctgcgcctgcg

SEQ ID NO: 22007 - DNA, 213 bp, Homo sapiens; identical to SEQ ID NO: 12082
  chr15:26327610-26327823
  hyper

SEQ ID NO: 22008 - DNA, 30 bp, Homo sapiens; identical to SEQ ID NO: 12083
  chr15:27016662-27016692
  hyper

SEQ ID NO: 22009 - DNA, 30 bp, Homo sapiens; identical to SEQ ID NO: 12084
  chr15:27017778-27017808
  hyper

SEQ ID NO: 22010 - DNA, 28 bp, Homo sapiens
  chr15:27018301-27018329
  hyper
cgcgcgggcgcggggcgggggaggaggc

SEQ ID NO: 22011 - DNA, 17 bp, Homo sapiens
  chr15:27113012-27113029
  hyper
cgcgctcccagcccagg

SEQ ID NO: 22012 - DNA, 139 bp, Homo sapiens; identical to SEQ ID NO: 12088
  chr15:28340433-28340572
  hyper

SEQ ID NO: 22013 - DNA, 15 bp, Homo sapiens
  chr15:28342521-28342536
  hyper
cggccccaaggagct

SEQ ID NO: 22014 - DNA, 30 bp, Homo sapiens; identical to SEQ ID NO: 12092
  chr15:28344134-28344164
  hyper

SEQ ID NO: 22015 - DNA, 61 bp, Homo sapiens; identical to SEQ ID NO: 12093
  chr15:28351758-28351819
  hyper

SEQ ID NO: 22016 - DNA, 77 bp, Homo sapiens; identical to SEQ ID NO: 4192
  chr15:28352021-28352098
  hyper

SEQ ID NO: 22017 - DNA, 22 bp, Homo sapiens
  chr15:28352099-28352121
  hyper
ggctctggccccacggtgagcc

SEQ ID NO: 22018 - DNA, 88 bp, Homo sapiens
  chr15:28352152-28352240
  hyper
cgcgcggggagggagagtccggcagggtcacgaggcgccggccccggggccgcttgaaacccgaagagaccccgctcgctcgcgcgcc

SEQ ID NO: 22019 - DNA, 38 bp, Homo sapiens
  chr15:29077246-29077284
  hyper
acttccgtaggagtgcgggtgtgcgtgcgtgccgcgga

SEQ ID NO: 22020 - DNA, 11 bp, Homo sapiens
  chr15:29077383-29077394
  hyper
gagcggcgaag

SEQ ID NO: 22021 - DNA, 170 bp, Homo sapiens; identical to SEQ ID NO: 4196
  chr15:29077428-29077598
  hyper

SEQ ID NO: 22022 - DNA, 50 bp, Homo sapiens
  chr15:29130757-29130807
  hyper
caaggtgcggagcctcgcgttcaccggctctacctgcggagcctcgcgtt

SEQ ID NO: 22023 - DNA, 32 bp, Homo sapiens
  chr15:29131875-29131907
  hyper
acccaagcccagatcttcgcccccttcccttt

SEQ ID NO: 22024 - DNA, 30 bp, Homo sapiens; identical to SEQ ID NO: 12102
  chr15:29407444-29407474
  hyper

SEQ ID NO: 22025 - DNA, 97 bp, Homo sapiens; identical to SEQ ID NO: 12103
  chr15:29862098-29862195
  hyper

SEQ ID NO: 22026 - DNA, 47 bp, Homo sapiens; identical to SEQ ID NO: 12104
  chr15:29863563-29863610
  hyper

SEQ ID NO: 22027 - DNA, 90 bp, Homo sapiens; identical to SEQ ID NO: 12105
  chr15:30260547-30260637
  hyper

SEQ ID NO: 22028 - DNA, 95 bp, Homo sapiens; identical to SEQ ID NO: 12106
  chr15:30261046-30261141
  hyper

SEQ ID NO: 22029 - DNA, 6 bp, Homo sapiens
  chr15:31775468-31775474
  hyper
cctcgc

SEQ ID NO: 22030 - DNA, 113 bp, Homo sapiens
  chr15:31775483-31775596
  hyper
cgcgccgcgccgctcagggccgggccccgcgcgcctcgcgccgccgccgcagctcctcgcggtagcagtaggagcagtagtgctcggtctcggcgcgcccgtagaacgcacag

SEQ ID NO: 22031 - DNA, 76 bp, Homo sapiens
  chr15:33603118-33603194
  hyper
ggaggaggtggaggacgaggacgaaaaggaggaggagaaagagcgcagcagcagtcagcgcacgccgagcggctgc

SEQ ID NO: 22032 - DNA, 114 bp, Homo sapiens; identical to SEQ ID NO: 4206
  chr15:33603647-33603761
  hyper

SEQ ID NO: 22033 - DNA, 594 bp, Homo sapiens
  chr15:34728884-34729478
  hyper
gccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgct

SEQ ID NO: 22034 - DNA, 13 bp, Homo sapiens
  chr15:34729582-34729595
  hyper
aggttccccagct

SEQ ID NO: 22035 - DNA, 31 bp, Homo sapiens
  chr15:34787304-34787335
  hyper
cgttacctggcgccgtcggggcccagcggca

SEQ ID NO: 22036 - DNA, 34 bp, Homo sapiens; identical to SEQ ID NO: 12120
  chr15:34806507-34806541
  hyper

SEQ ID NO: 22037 - DNA, 69 bp, Homo sapiens; identical to SEQ ID NO: 12121
  chr15:34806978-34807047
  hyper

SEQ ID NO: 22038 - DNA, 16 bp, Homo sapiens
  chr15:35047133-35047149
  hyper
ccggcgcggcagcctg

SEQ ID NO: 22039 - DNA, 13 bp, Homo sapiens
  chr15:35047293-35047306
  hyper
cgtcggagcccga

SEQ ID NO: 22040 - DNA, 55 bp, Homo sapiens
  chr15:37180743-37180798
  hyper
aggtgagggccagggtagccctctgcacgcccctctgccgcggcccaagcctctg

SEQ ID NO: 22041 - DNA, 29 bp, Homo sapiens
  chr15:40211790-40211819
  hyper
gaggagggggactcccgcctggatcccgc

SEQ ID NO: 22042 - DNA, 54 bp, Homo sapiens
  chr15:40212190-40212244
  hyper
tggcatttggagagatccagctcccgttatgtcccatggcgaggctgggactcc

SEQ ID NO: 22043 - DNA, 41 bp, Homo sapiens
  chr15:40575589-40575630
  hyper
ccacatgcacccaaccgggccaatcccaaagtcgcagtctt

SEQ ID NO: 22044 - DNA, 137 bp, Homo sapiens; identical to SEQ ID NO: 12128
  chr15:41787125-41787262
  hyper

SEQ ID NO: 22045 - DNA, 79 bp, Homo sapiens; identical to SEQ ID NO: 12129
  chr15:41804733-41804812
  hyper

SEQ ID NO: 22046 - DNA, 35 bp, Homo sapiens; identical to SEQ ID NO: 12131
  chr15:41877632-41877667
  hyper

SEQ ID NO: 22047 - DNA, 17 bp, Homo sapiens
  chr15:41913733-41913750
  hyper
tccgggacccgcgagcg

SEQ ID NO: 22048 - DNA, 64 bp, Homo sapiens
  chr15:41913807-41913871
  hyper
tgccacgcgctacgcccgtccccacgcgcctggtggcgtgttcttggcgcgaagtgttaagagt

SEQ ID NO: 22049 - DNA, 30 bp, Homo sapiens
  chr15:41952542-41952572
  hyper
ccttttgcgcctgcgcggcgggctccgagc

SEQ ID NO: 22050 - DNA, 35 bp, Homo sapiens
  chr15:41952711-41952746
  hyper
acgccccgcacggtaactctcgggcctgggtggag

SEQ ID NO: 22051 - DNA, 31 bp, Homo sapiens
  chr15:45403605-45403636
  hyper
gcccggtggcggggtcgggcgccgcccacat

SEQ ID NO: 22052 - DNA, 42 bp, Homo sapiens
  chr15:45405117-45405159
  hyper
cagggcctttcgcgccccggcccttcgcgagccacggcccca

SEQ ID NO: 22053 - DNA, 124 bp, Homo sapiens; identical to SEQ ID NO: 12137
  chr15:45406627-45406751
  hyper

SEQ ID NO: 22054 - DNA, 192 bp, Homo sapiens; identical to SEQ ID NO: 12138
  chr15:45421473-45421665
  hyper

SEQ ID NO: 22055 - DNA, 14 bp, Homo sapiens
  chr15:45479446-45479460
  hyper
agagtttggggctt

SEQ ID NO: 22056 - DNA, 3 bp, Homo sapiens
  chr15:45479774-45479777
  hyper
ggg

SEQ ID NO: 22057 - DNA, 63 bp, Homo sapiens; identical to SEQ ID NO: 12142
  chr15:48009607-48009670
  hyper

SEQ ID NO: 22058 - DNA, 449 bp, Homo sapiens; identical to SEQ ID NO: 12143
  chr15:48010067-48010516
  hyper

SEQ ID NO: 22059 - DNA, 62 bp, Homo sapiens; identical to SEQ ID NO: 12144
  chr15:48010760-48010822
  hyper

SEQ ID NO: 22060 - DNA, 63 bp, Homo sapiens; identical to SEQ ID NO: 12145
  chr15:48470388-48470451
  hyper

SEQ ID NO: 22061 - DNA, 225 bp, Homo sapiens
  chr15:48937987-48938212
  hyper
ttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgg

SEQ ID NO: 22062 - DNA, 49 bp, Homo sapiens
  chr15:51385864-51385913
  hyper
cgggagctgtgggcacgtgaggagggcgagcgggtcctaggtgcgtaga

SEQ ID NO: 22063 - DNA, 25 bp, Homo sapiens
  chr15:51386181-51386206
  hyper
ccttctccgccggctgcgcggcagc

SEQ ID NO: 22064 - DNA, 414 bp, Homo sapiens; identical to SEQ ID NO: 12151
  chr15:51559380-51559794
  hyper

SEQ ID NO: 22065 - DNA, 165 bp, Homo sapiens
  chr15:53077361-53077526
  hyper
ctcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatg

SEQ ID NO: 22066 - DNA, 24 bp, Homo sapiens
  chr15:53078040-53078064
  hyper
ctgttatttcgtgaccggaaggcg

SEQ ID NO: 22067 - DNA, 70 bp, Homo sapiens; identical to SEQ ID NO: 12156
  chr15:53078922-53078992
  hyper

SEQ ID NO: 22068 - DNA, 76 bp, Homo sapiens
  chr15:53079264-53079340
  hyper
ggaacctcagttgctcgcgggcagcccacgggtggagatatggtgccggtagcacaagagctagagagtggaaaac

SEQ ID NO: 22069 - DNA, 243 bp, Homo sapiens; identical to SEQ ID NO: 4229
  chr15:53081054-53081297
  hyper

SEQ ID NO: 22070 - DNA, 14 bp, Homo sapiens
  chr15:53081677-53081691
  hyper
gggtggtggtggtg

SEQ ID NO: 22071 - DNA, 56 bp, Homo sapiens; identical to SEQ ID NO: 12164
  chr15:53082987-53083043
  hyper

SEQ ID NO: 22072 - DNA, 19 bp, Homo sapiens
  chr15:53083116-53083135
  hyper
cgttgacccggcacccttc

SEQ ID NO: 22073 - DNA, 3 bp, Homo sapiens
  chr15:53083136-53083139
  hyper
tcc

SEQ ID NO: 22074 - DNA, 401 bp, Homo sapiens; identical to SEQ ID NO: 12167
  chr15:53095746-53096147
  hyper

SEQ ID NO: 22075 - DNA, 36 bp, Homo sapiens; identical to SEQ ID NO: 12168
  chr15:53096459-53096495
  hyper

SEQ ID NO: 22076 - DNA, 133 bp, Homo sapiens
  chr15:53097098-53097231
  hyper
tggtcaggccagcctcgcatttggggatgcaacttgcatttgaatagctgcctgggcttgttatggacccgggaaagctctgaaagggaatcactatgcaaattgtcccagttacaatcgaaaggttcgatct

SEQ ID NO: 22077 - DNA, 75 bp, Homo sapiens
  chr15:53097261-53097336
  hyper
gctatctatgcattagggttgcattaccgccttcgtcggcctcctcgccacccccgctcgcgcctgcaggggagg

SEQ ID NO: 22078 - DNA, 15 bp, Homo sapiens
  chr15:53097554-53097569
  hyper
tttttttcgctttgc

SEQ ID NO: 22079 - DNA, 32 bp, Homo sapiens
  chr15:53098658-53098690
  hyper
agtagggtgaagggcaacggtcattagcactt

SEQ ID NO: 22080 - DNA, 45 bp, Homo sapiens; identical to SEQ ID NO: 12173
  chr15:54051776-54051821
  hyper

SEQ ID NO: 22081 - DNA, 190 bp, Homo sapiens
  chr15:54270707-54270897
  hyper
ctcaaatgttgatgagcctgggcgctcctcaacacacgggagagatcccattttgctttctgggagaaagagatgagaaatgagccgcggaaggtatttggcaatgagaagagtgaaaggcagtttcttgccagcagctaagttgtagaattgcttcggaggctacccgggagtgcgatagaattgacaa

SEQ ID NO: 22082 - DNA, 45 bp, Homo sapiens; identical to SEQ ID NO: 12175
  chr15:56034885-56034930
  hyper

SEQ ID NO: 22083 - DNA, 155 bp, Homo sapiens; identical to SEQ ID NO: 12177
  chr15:58358573-58358728
  hyper

SEQ ID NO: 22084 - DNA, 205 bp, Homo sapiens
  chr15:60295917-60296122
  hyper
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccat

SEQ ID NO: 22085 - DNA, 61 bp, Homo sapiens
  chr15:60298108-60298169
  hyper
cctccgccttgcactcggtggcggtgcactgacccgcaggagcccacgccccctctcgttc

SEQ ID NO: 22086 - DNA, 82 bp, Homo sapiens; identical to SEQ ID NO: 12187
  chr15:61519939-61520021
  hyper

SEQ ID NO: 22087 - DNA, 30 bp, Homo sapiens; identical to SEQ ID NO: 12188
  chr15:61520432-61520462
  hyper

SEQ ID NO: 22088 - DNA, 30 bp, Homo sapiens; identical to SEQ ID NO: 12190
  chr15:61521442-61521472
  hyper

SEQ ID NO: 22089 - DNA, 75 bp, Homo sapiens; identical to SEQ ID NO: 12192
  chr15:62457193-62457268
  hyper

SEQ ID NO: 22090 - DNA, 91 bp, Homo sapiens; identical to SEQ ID NO: 12193
  chr15:65669680-65669771
  hyper

SEQ ID NO: 22091 - DNA, 35 bp, Homo sapiens; identical to SEQ ID NO: 12194
  chr15:65715528-65715563
  hyper

SEQ ID NO: 22092 - DNA, 126 bp, Homo sapiens; identical to SEQ ID NO: 12195
  chr15:68113248-68113374
  hyper

SEQ ID NO: 22093 - DNA, 204 bp, Homo sapiens
  chr15:68114195-68114399
  hyper
ggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgaggga

SEQ ID NO: 22094 - DNA, 775 bp, Homo sapiens
  chr15:68115594-68116369
  hyper
cggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccagga

SEQ ID NO: 22095 - DNA, 165 bp, Homo sapiens
  chr15:68117665-68117830
  hyper
cttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcaga

SEQ ID NO: 22096 - DNA, 24 bp, Homo sapiens
  chr15:68118633-68118657
  hyper
gcgagaggccgaacgcctgtgcaa

SEQ ID NO: 22097 - DNA, 10 bp, Homo sapiens
  chr15:68122673-68122683
  hyper
ccaggagctg

SEQ ID NO: 22098 - DNA, 38 bp, Homo sapiens
  chr15:68125223-68125261
  hyper
gattgaacttcttatcgcggcaatttccatggtttcta

SEQ ID NO: 22099 - DNA, 47 bp, Homo sapiens
  chr15:68125664-68125711
  hyper
atagtgggactagtgaggaaggccacgatccacgtggatcaggatct

SEQ ID NO: 22100 - DNA, 33 bp, Homo sapiens; identical to SEQ ID NO: 12203
  chr15:68126071-68126104
  hyper

SEQ ID NO: 22101 - DNA, 35 bp, Homo sapiens
  chr15:68127766-68127801
  hyper
ggctagtgggggtcccgggttgagcccttctttta

SEQ ID NO: 22102 - DNA, 63 bp, Homo sapiens
  chr15:68128350-68128413
  hyper
gggcgggacagcgcgggtgtgggagtttgccggcccctttccccaccgcggattgcacctttg

SEQ ID NO: 22103 - DNA, 44 bp, Homo sapiens; identical to SEQ ID NO: 12205
  chr15:68723523-68723567
  hyper

SEQ ID NO: 22104 - DNA, 124 bp, Homo sapiens; identical to SEQ ID NO: 12206
  chr15:68723898-68724022
  hyper

SEQ ID NO: 22105 - DNA, 121 bp, Homo sapiens; identical to SEQ ID NO: 12207
  chr15:69136224-69136345
  hyper

SEQ ID NO: 22106 - DNA, 34 bp, Homo sapiens; identical to SEQ ID NO: 12208
  chr15:71408553-71408587
  hyper

SEQ ID NO: 22107 - DNA, 132 bp, Homo sapiens; identical to SEQ ID NO: 12209
  chr15:72476743-72476875
  hyper

SEQ ID NO: 22108 - DNA, 404 bp, Homo sapiens
  chr15:73659600-73660004
  hyper
aatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcct

SEQ ID NO: 22109 - DNA, 260 bp, Homo sapiens
  chr15:73660067-73660327
  hyper
gctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaag

SEQ ID NO: 22110 - DNA, 267 bp, Homo sapiens; identical to SEQ ID NO: 12211
  chr15:73660446-73660713
  hyper

SEQ ID NO: 22111 - DNA, 69 bp, Homo sapiens
  chr15:73661666-73661735
  hyper
tcccggccttcccgcaaccctcctggagagggggcttccggaaatgcgccgcgtcggggaggctcccac

SEQ ID NO: 22112 - DNA, 30 bp, Homo sapiens; identical to SEQ ID NO: 12214
  chr15:74428205-74428235
  hyper

SEQ ID NO: 22113 - DNA, 59 bp, Homo sapiens; identical to SEQ ID NO: 12215
  chr15:74429026-74429085
  hyper

SEQ ID NO: 22114 - DNA, 8 bp, Homo sapiens
  chr15:74658143-74658151
  hyper
tggatgct

SEQ ID NO: 22115 - DNA, 58 bp, Homo sapiens
  chr15:74658587-74658645
  hyper
gtgctctgaccttcaaatctccctcccccgattttttttttttttttttttttgagac

SEQ ID NO: 22116 - DNA, 10 bp, Homo sapiens
  chr15:75471217-75471227
  hyper
cggtttcccc

SEQ ID NO: 22117 - DNA, 462 bp, Homo sapiens; identical to SEQ ID NO: 4252
  chr15:76628564-76629026
  hyper

SEQ ID NO: 22118 - DNA, 38 bp, Homo sapiens; identical to SEQ ID NO: 12228
  chr15:76638937-76638975
  hyper

SEQ ID NO: 22119 - DNA, 83 bp, Homo sapiens; identical to SEQ ID NO: 12229
  chr15:77924565-77924648
  hyper

SEQ ID NO: 22120 - DNA, 148 bp, Homo sapiens; identical to SEQ ID NO: 12230
  chr15:78111627-78111775
  hyper

SEQ ID NO: 22121 - DNA, 111 bp, Homo sapiens; identical to SEQ ID NO: 12231
  chr15:78236783-78236894
  hyper

SEQ ID NO: 22122 - DNA, 59 bp, Homo sapiens; identical to SEQ ID NO: 12232
  chr15:78633047-78633106
  hyper

SEQ ID NO: 22123 - DNA, 182 bp, Homo sapiens
  chr15:78912441-78912623
  hyper
cggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaa

SEQ ID NO: 22124 - DNA, 174 bp, Homo sapiens; identical to SEQ ID NO: 12236
  chr15:78913296-78913470
  hyper

SEQ ID NO: 22125 - DNA, 55 bp, Homo sapiens
  chr15:78913480-78913535
  hyper
cgaccagatctgagcaggtgctgtcaccaccaccaggaaggagagggactcagtt

SEQ ID NO: 22126 - DNA, 26 bp, Homo sapiens
  chr15:78913651-78913677
  hyper
atgctattaaataattgttaaatatt

SEQ ID NO: 22127 - DNA, 230 bp, Homo sapiens; identical to SEQ ID NO: 12238
  chr15:78933407-78933637
  hyper

SEQ ID NO: 22128 - DNA, 215 bp, Homo sapiens
  chr15:79382571-79382786
  hyper
tccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgc

SEQ ID NO: 22129 - DNA, 67 bp, Homo sapiens; identical to SEQ ID NO: 1226
  chr15:79383317-79383384
  hyper

SEQ ID NO: 22130 - DNA, 81 bp, Homo sapiens; identical to SEQ ID NO: 1227
  chr15:79383438-79383519
  hyper

SEQ ID NO: 22131 - DNA, 169 bp, Homo sapiens
  chr15:79383977-79384146
  hyper
aacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 22132 - DNA, 41 bp, Homo sapiens
  chr15:79502170-79502211
  hyper
actgtaagtgttggacggagaactgataagggtaggtgatt

SEQ ID NO: 22133 - DNA, 94 bp, Homo sapiens; identical to SEQ ID NO: 12245
  chr15:79574968-79575062
  hyper

SEQ ID NO: 22134 - DNA, 25 bp, Homo sapiens
  chr15:79575474-79575499
  hyper
gggtgctggacgccccctgattttg

SEQ ID NO: 22135 - DNA, 85 bp, Homo sapiens
  chr15:79576060-79576145
  hyper
gctggcacactctgccggcgcggccggagccccggagttcagcacctcggacagagcccgagccccgccgcccgaggcgcacagt

SEQ ID NO: 22136 - DNA, 6 bp, Homo sapiens
  chr15:79576277-79576283
  hyper
atctgc

SEQ ID NO: 22137 - DNA, 151 bp, Homo sapiens
  chr15:79724351-79724502
  hyper
cgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggg

SEQ ID NO: 22138 - DNA, 162 bp, Homo sapiens; identical to SEQ ID NO: 12252
  chr15:80544504-80544666
  hyper

SEQ ID NO: 22139 - DNA, 197 bp, Homo sapiens
  chr15:82336972-82337169
  hyper
aggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccat

SEQ ID NO: 22140 - DNA, 63 bp, Homo sapiens
  chr15:82340007-82340070
  hyper
tgccctgcctgaccccggctacaggaacgagcgctgtgggcctcggtttctcacccgtaaaat

SEQ ID NO: 22141 - DNA, 30 bp, Homo sapiens
  chr15:82340157-82340187
  hyper
agacagttccgcaagcgcctttacttttga

SEQ ID NO: 22142 - DNA, 35 bp, Homo sapiens; identical to SEQ ID NO: 12255
  chr15:83314969-83315004
  hyper

SEQ ID NO: 22143 - DNA, 39 bp, Homo sapiens
  chr15:83315297-83315336
  hyper
ccccagctgagagcacggtgcaaggggccagggctgcag

SEQ ID NO: 22144 - DNA, 20 bp, Homo sapiens
  chr15:83316231-83316251
  hyper
cgtgcgacggcagtgtgaga

SEQ ID NO: 22145 - DNA, 164 bp, Homo sapiens
  chr15:83349070-83349234
  hyper
gggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcg

SEQ ID NO: 22146 - DNA, 23 bp, Homo sapiens
  chr15:83349686-83349709
  hyper
agagtttccggtagtttttgtga

SEQ ID NO: 22147 - DNA, 165 bp, Homo sapiens; identical to SEQ ID NO: 12261
  chr15:83378857-83379022
  hyper

SEQ ID NO: 22148 - DNA, 69 bp, Homo sapiens; identical to SEQ ID NO: 4272
  chr15:83775933-83776002
  hyper

SEQ ID NO: 22149 - DNA, 116 bp, Homo sapiens; identical to SEQ ID NO: 4273
  chr15:83776022-83776138
  hyper

SEQ ID NO: 22150 - DNA, 98 bp, Homo sapiens
  chr15:83776157-83776255
  hyper
cgtggcgcccctggcaggagcactgcaaggacgcctcccgggactgcaccgcggccctgcgcacttggggcgacggggccaggcgcgggggacggctg

SEQ ID NO: 22151 - DNA, 260 bp, Homo sapiens; identical to SEQ ID NO: 12268
  chr15:83876223-83876483
  hyper

SEQ ID NO: 22152 - DNA, 34 bp, Homo sapiens; identical to SEQ ID NO: 12269
  chr15:83876788-83876822
  hyper

SEQ ID NO: 22153 - DNA, 19 bp, Homo sapiens
  chr15:83877036-83877055
  hyper
agtgggggacaaaggcgct

SEQ ID NO: 22154 - DNA, 159 bp, Homo sapiens
  chr15:84115966-84116125
  hyper
gccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcga

SEQ ID NO: 22155 - DNA, 41 bp, Homo sapiens; identical to SEQ ID NO: 12274
  chr15:84116828-84116869
  hyper

SEQ ID NO: 22156 - DNA, 33 bp, Homo sapiens; identical to SEQ ID NO: 12275
  chr15:84322478-84322511
  hyper

SEQ ID NO: 22157 - DNA, 109 bp, Homo sapiens
  chr15:84749260-84749369
  hyper
gggatcctcaaatagaacgaatccgggaccctgcagaaatgaagggcatgtagtgtagaggtttttcctttttatttagaaaggaatgaaagaccgacagtgcacctgc

SEQ ID NO: 22158 - DNA, 41 bp, Homo sapiens; identical to SEQ ID NO: 12279
  chr15:88799221-88799262
  hyper

SEQ ID NO: 22159 - DNA, 30 bp, Homo sapiens
  chr15:88799507-88799537
  hyper
cctctgcctttgaaacgccgagcgatcaga

SEQ ID NO: 22160 - DNA, 129 bp, Homo sapiens
  chr15:88800412-88800541
  hyper
cgcgctacccggttttgctgcaatccggaccgcggtaggaagtgaaatgaacgtggcggaggtgattggggagtgctcccaagccttgggtggggggcgctcccaagcctgggtgggtggggggcgcag

SEQ ID NO: 22161 - DNA, 30 bp, Homo sapiens; identical to SEQ ID NO: 12283
  chr15:88801202-88801232
  hyper

SEQ ID NO: 22162 - DNA, 30 bp, Homo sapiens; identical to SEQ ID NO: 12284
  chr15:89147617-89147647
  hyper

SEQ ID NO: 22163 - DNA, 35 bp, Homo sapiens; identical to SEQ ID NO: 12285
  chr15:89148146-89148181
  hyper

SEQ ID NO: 22164 - DNA, 231 bp, Homo sapiens; identical to SEQ ID NO: 12286
  chr15:89148437-89148668
  hyper

SEQ ID NO: 22165 - DNA, 40 bp, Homo sapiens; identical to SEQ ID NO: 12287
  chr15:89148879-89148919
  hyper

SEQ ID NO: 22166 - DNA, 30 bp, Homo sapiens
  chr15:89149139-89149169
  hyper
gcccctcagaccccacgcggaggaggtcag

SEQ ID NO: 22167 - DNA, 53 bp, Homo sapiens; identical to SEQ ID NO: 12289
  chr15:89248428-89248481
  hyper

SEQ ID NO: 22168 - DNA, 58 bp, Homo sapiens
  chr15:89248695-89248753
  hyper
ggggagggactggatcgggcgccaatcccgcccgccgcgcgccgcccgggctccctcg

SEQ ID NO: 22169 - DNA, 12 bp, Homo sapiens
  chr15:89346038-89346050
  hyper
agactcgcagct

SEQ ID NO: 22170 - DNA, 68 bp, Homo sapiens
  chr15:89346393-89346461
  hyper
ccgccagccccggagctgccgggtccgcgccgccccggggagcgctcctctcccgccctgagcgcagg

SEQ ID NO: 22171 - DNA, 273 bp, Homo sapiens
  chr15:89346943-89347216
  hyper
gcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagca

SEQ ID NO: 22172 - DNA, 53 bp, Homo sapiens
  chr15:89903431-89903484
  hyper
cccacaagaatcatccgaggctgcaccgtgaccagcccctcaagacagagcga

SEQ ID NO: 22173 - DNA, 86 bp, Homo sapiens; identical to SEQ ID NO: 12295
  chr15:89906156-89906242
  hyper

SEQ ID NO: 22174 - DNA, 30 bp, Homo sapiens; identical to SEQ ID NO: 12296
  chr15:89909322-89909352
  hyper

SEQ ID NO: 22175 - DNA, 290 bp, Homo sapiens
  chr15:89910748-89911038
  hyper
ggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcag

SEQ ID NO: 22176 - DNA, 486 bp, Homo sapiens; identical to SEQ ID NO: 12298
  chr15:89911610-89912096
  hyper

SEQ ID NO: 22177 - DNA, 95 bp, Homo sapiens; identical to SEQ ID NO: 12299
  chr15:89913460-89913555
  hyper

SEQ ID NO: 22178 - DNA, 345 bp, Homo sapiens
  chr15:89914895-89915240
  hyper
ccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccct

SEQ ID NO: 22179 - DNA, 201 bp, Homo sapiens
  chr15:89922546-89922747
  hyper
acggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggcca

SEQ ID NO: 22180 - DNA, 90 bp, Homo sapiens
  chr15:89942665-89942755
  hyper
ggcagaaccactgaccggcaggcggcgctccccggggctcccggctcgagccccagggcaccgggaggagtaaggaccccgagcgggagg

SEQ ID NO: 22181 - DNA, 310 bp, Homo sapiens
  chr15:89942945-89943255
  hyper
agcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaa

SEQ ID NO: 22182 - DNA, 176 bp, Homo sapiens
  chr15:89951113-89951289
  hyper
ggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacaca

SEQ ID NO: 22183 - DNA, 28 bp, Homo sapiens
  chr15:89951349-89951377
  hyper
gataaactcgcttttcttccggtaagtg

SEQ ID NO: 22184 - DNA, 8 bp, Homo sapiens
  chr15:89952145-89952153
  hyper
tgggggag

SEQ ID NO: 22185 - DNA, 19 bp, Homo sapiens
  chr15:89953055-89953074
  hyper
agggcggggagtagggatt

SEQ ID NO: 22186 - DNA, 19 bp, Homo sapiens
  chr15:89954335-89954354
  hyper
ctggcgctgccttccagga

SEQ ID NO: 22187 - DNA, 42 bp, Homo sapiens; identical to SEQ ID NO: 12313
  chr15:89954800-89954842
  hyper

SEQ ID NO: 22188 - DNA, 28 bp, Homo sapiens
  chr15:89955001-89955029
  hyper
gggatagtcgcaccgacaaaaatcacag

SEQ ID NO: 22189 - DNA, 15 bp, Homo sapiens
  chr15:89956339-89956354
  hyper
tatattttaagcccc

SEQ ID NO: 22190 - DNA, 30 bp, Homo sapiens; identical to SEQ ID NO: 12316
  chr15:89962817-89962847
  hyper

SEQ ID NO: 22191 - DNA, 97 bp, Homo sapiens
  chr15:90039711-90039808
  hyper
taatcacctgcaggagcaggcaggtgagcggcagccgccagcggaggttggtgttccaggccatgctgcaggggtgcctggccgggctggcagcggg

SEQ ID NO: 22192 - DNA, 177 bp, Homo sapiens; identical to SEQ ID NO: 12318
  chr15:90357883-90358060
  hyper

SEQ ID NO: 22193 - DNA, 248 bp, Homo sapiens; identical to SEQ ID NO: 12319
  chr15:90358102-90358350
  hyper

SEQ ID NO: 22194 - DNA, 120 bp, Homo sapiens; identical to SEQ ID NO: 12320
  chr15:91427788-91427908
  hyper

SEQ ID NO: 22195 - DNA, 42 bp, Homo sapiens; identical to SEQ ID NO: 12321
  chr15:92936971-92937013
  hyper

SEQ ID NO: 22196 - DNA, 35 bp, Homo sapiens; identical to SEQ ID NO: 4298
  chr15:92937700-92937735
  hyper

SEQ ID NO: 22197 - DNA, 191 bp, Homo sapiens
  chr15:92937736-92937927
  hyper
ggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagaca

SEQ ID NO: 22198 - DNA, 84 bp, Homo sapiens; identical to SEQ ID NO: 12325
  chr15:93198720-93198804
  hyper

SEQ ID NO: 22199 - DNA, 95 bp, Homo sapiens; identical to SEQ ID NO: 12326
  chr15:93616156-93616251
  hyper

SEQ ID NO: 22200 - DNA, 108 bp, Homo sapiens; identical to SEQ ID NO: 12327
  chr15:93616545-93616653
  hyper

SEQ ID NO: 22201 - DNA, 107 bp, Homo sapiens
  chr15:93631632-93631739
  hyper
cgtacgccggcgcgccgaggcaaagggccgccgggacgcgagcccacgcggtgcactgcgccgacatccccgagggcaggagatggccaggcagctccgcagccggg

SEQ ID NO: 22202 - DNA, 369 bp, Homo sapiens
  chr15:93632291-93632660
  hyper
ggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagca

SEQ ID NO: 22203 - DNA, 33 bp, Homo sapiens
  chr15:93633233-93633266
  hyper
gcttgaacacggccacgtcgggagcagtaaatc

SEQ ID NO: 22204 - DNA, 14 bp, Homo sapiens
  chr15:95388665-95388679
  hyper
ggagaagaatatct

SEQ ID NO: 22205 - DNA, 30 bp, Homo sapiens; identical to SEQ ID NO: 12333
  chr15:96865078-96865108
  hyper

SEQ ID NO: 22206 - DNA, 57 bp, Homo sapiens
  chr15:96897877-96897934
  hyper
gttccgccacgggtccgacggggcaccctgggtccccgcagcccgtcacaggcgttt

SEQ ID NO: 22207 - DNA, 117 bp, Homo sapiens
  chr15:96911442-96911559
  hyper
gaacccgaagctgaacgtgaataagggacagggtaggacctgaaattgcagagacatagaaaatcaatacgtggtcgggagtcaactgcgcgcgaccaagggctctgccctccctct

SEQ ID NO: 22208 - DNA, 157 bp, Homo sapiens
  chr15:98836021-98836178
  hyper
taattaggtaaactacgccaagagaggctcagaaacctgcccaaaatgagctggagcatcagcaggggttccaaatggcaggcgtcctctcccctctgtcccacaaagaacagtccgtcccctgggctgggagctgggcccggagccccggggcagc

SEQ ID NO: 22209 - DNA, 30 bp, Homo sapiens; identical to SEQ ID NO: 12340
  chr15:98965287-98965317
  hyper

SEQ ID NO: 22210 - DNA, 30 bp, Homo sapiens; identical to SEQ ID NO: 12341
  chr15:98971901-98971931
  hyper

SEQ ID NO: 22211 - DNA, 437 bp, Homo sapiens; identical to SEQ ID NO: 12342
  chr15:100881407-100881844
  hyper

SEQ ID NO: 22212 - DNA, 70 bp, Homo sapiens; identical to SEQ ID NO: 12345
  chr16:215301-215371
  hyper

SEQ ID NO: 22213 - DNA, 93 bp, Homo sapiens
  chr16:216583-216676
  hyper
aatccagtgtttccacgtcgtgctggcctcccacctgcaggacgagttcaccgtgcaaatgcaagcggcgtgggacaagttcctgactggtgt

SEQ ID NO: 22214 - DNA, 38 bp, Homo sapiens; identical to SEQ ID NO: 12350
  chr16:223349-223387
  hyper

SEQ ID NO: 22215 - DNA, 30 bp, Homo sapiens; identical to SEQ ID NO: 12352
  chr16:230859-230889
  hyper

SEQ ID NO: 22216 - DNA, 270 bp, Homo sapiens; identical to SEQ ID NO: 12353
  chr16:610046-610316
  hyper

SEQ ID NO: 22217 - DNA, 151 bp, Homo sapiens; identical to SEQ ID NO: 12354
  chr16:610343-610494
  hyper

SEQ ID NO: 22218 - DNA, 30 bp, Homo sapiens; identical to SEQ ID NO: 12355
  chr16:681006-681036
  hyper

SEQ ID NO: 22219 - DNA, 253 bp, Homo sapiens; identical to SEQ ID NO: 12356
  chr16:725597-725850
  hyper

SEQ ID NO: 22220 - DNA, 343 bp, Homo sapiens; identical to SEQ ID NO: 12357
  chr16:750505-750848
  hyper

SEQ ID NO: 22221 - DNA, 43 bp, Homo sapiens
  chr16:1030655-1030698
  hyper
tccgagccaccctcggggacggccgggccgaggccacctcgcg

SEQ ID NO: 22222 - DNA, 284 bp, Homo sapiens; identical to SEQ ID NO: 12359
  chr16:1031782-1032066
  hyper

SEQ ID NO: 22223 - DNA, 276 bp, Homo sapiens; identical to SEQ ID NO: 12360
  chr16:1203265-1203541
  hyper

SEQ ID NO: 22224 - DNA, 50 bp, Homo sapiens; identical to SEQ ID NO: 12361
  chr16:1203913-1203963
  hyper

SEQ ID NO: 22225 - DNA, 77 bp, Homo sapiens
  chr16:1204034-1204111
  hyper
ccatatccttcccggccggcggggggcggggggcggggggcgtggggagggtgggggcccggggcgcgggactccct

SEQ ID NO: 22226 - DNA, 103 bp, Homo sapiens; identical to SEQ ID NO: 12363
  chr16:1204128-1204231
  hyper

SEQ ID NO: 22227 - DNA, 248 bp, Homo sapiens; identical to SEQ ID NO: 12364
  chr16:1382374-1382622
  hyper

SEQ ID NO: 22228 - DNA, 26 bp, Homo sapiens
  chr16:1382940-1382966
  hyper
ttcgggaccagcgggttggggacagg

SEQ ID NO: 22229 - DNA, 30 bp, Homo sapiens; identical to SEQ ID NO: 12366
  chr16:1384604-1384634
  hyper

SEQ ID NO: 22230 - DNA, 67 bp, Homo sapiens
  chr16:2040847-2040914
  hyper
aacctctgggccagccgcacctcggcgcctgtcttggaggagggcggtgcccacggtggggcagggg

SEQ ID NO: 22231 - DNA, 40 bp, Homo sapiens
  chr16:2042160-2042200
  hyper
agcagcgtccgcgaccgccggcgcgcggtgttgctggacc

SEQ ID NO: 22232 - DNA, 30 bp, Homo sapiens; identical to SEQ ID NO: 12371
  chr16:2070078-2070108
  hyper

SEQ ID NO: 22233 - DNA, 15 bp, Homo sapiens
  chr16:2892527-2892542
  hyper
gctccccactgttgt

SEQ ID NO: 22234 - DNA, 37 bp, Homo sapiens; identical to SEQ ID NO: 12374
  chr16:3016812-3016849
  hyper

SEQ ID NO: 22235 - DNA, 153 bp, Homo sapiens
  chr16:3068201-3068354
  hyper
ggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggca

SEQ ID NO: 22236 - DNA, 30 bp, Homo sapiens; identical to SEQ ID NO: 12377
  chr16:3096912-3096942
  hyper

SEQ ID NO: 22237 - DNA, 30 bp, Homo sapiens; identical to SEQ ID NO: 12382
  chr16:3224981-3225011
  hyper

SEQ ID NO: 22238 - DNA, 98 bp, Homo sapiens
  chr16:3232641-3232739
  hyper
tccgggatttgaacccgggacctctcgcaccctaagcgagaatcatacccctagaccaacgagccacacgccccgtagcctccggcttgtctttgtgg

SEQ ID NO: 22239 - DNA, 447 bp, Homo sapiens
  chr16:3238546-3238993
  hyper
agggaggggagtgagtgagaggagggaggcggggaagaccgggcatccgcgggcagcacttcagtcggccctggcggggtgggggtctcggcccttgtccccacccccagaccccggggccttcccactgagagcgagggaattcgcggctttgatctggaggggacagggagccccttttagcccagatctgctggattctcgggagtcaggtgaaatctggatacagggaagggcagagtgacagtaaagggtgccccggaaccgatgcccgacgcctgctgccccacggccttcattcttgctcctcctcacgtcctggggactggaggtcccgccagctccccccagtgaagggcaagggggcgcatcgcagaatcgcccctggtgcgcagcgtagttggtggcctaagccgtcttctccgagagctcagccatcctgggcac

SEQ ID NO: 22240 - DNA, 25 bp, Homo sapiens
  chr16:3355209-3355234
  hyper
acccggcgaggctcccgggaccaaa

SEQ ID NO: 22241 - DNA, 29 bp, Homo sapiens
  chr16:3355250-3355279
  hyper
cgcagaacagacgcggcagtgcgacgcct

SEQ ID NO: 22242 - DNA, 154 bp, Homo sapiens; identical to SEQ ID NO: 12394
  chr16:4363926-4364080
  hyper

SEQ ID NO: 22243 - DNA, 329 bp, Homo sapiens; identical to SEQ ID NO: 12395
  chr16:4377992-4378321
  hyper

SEQ ID NO: 22244 - DNA, 201 bp, Homo sapiens; identical to SEQ ID NO: 12396
  chr16:4588308-4588509
  hyper

SEQ ID NO: 22245 - DNA, 86 bp, Homo sapiens; identical to SEQ ID NO: 12397
  chr16:5037621-5037707
  hyper

SEQ ID NO: 22246 - DNA, 30 bp, Homo sapiens; identical to SEQ ID NO: 12399
  chr16:6070172-6070202
  hyper

SEQ ID NO: 22247 - DNA, 30 bp, Homo sapiens; identical to SEQ ID NO: 12400
  chr16:6533480-6533510
  hyper

SEQ ID NO: 22248 - DNA, 212 bp, Homo sapiens; identical to SEQ ID NO: 12402
  chr16:10274813-10275025
  hyper

SEQ ID NO: 22249 - DNA, 106 bp, Homo sapiens
  chr16:10275392-10275498
  hyper
tcctcaggtggtgcacacgcatgaactgcggcaggtgcacagccctgcgtacctgcaaataccagcacggtcgtgcacgcgtgccctgacgcgcgcctctcgggac

SEQ ID NO: 22250 - DNA, 94 bp, Homo sapiens; identical to SEQ ID NO: 12408
  chr16:10480064-10480158
  hyper

SEQ ID NO: 22251 - DNA, 9 bp, Homo sapiens
  chr16:12994737-12994746
  hyper
gctggggga

SEQ ID NO: 22252 - DNA, 110 bp, Homo sapiens
  chr16:12994952-12995062
  hyper
ctcagggctggagggcgcagccgggaagggcaaggaggccccgcacgcctgggaggggcgatcctgaccagactgcacccagtctgtcttggagtgaaagccatttagtc

SEQ ID NO: 22253 - DNA, 24 bp, Homo sapiens
  chr16:12995593-12995617
  hyper
ctccacccccgcctcacccagtgg

SEQ ID NO: 22254 - DNA, 289 bp, Homo sapiens
  chr16:12996328-12996617
  hyper
ccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtca

SEQ ID NO: 22255 - DNA, 113 bp, Homo sapiens
  chr16:12996720-12996833
  hyper
gtgtgactctgctccctcaccctctggccgcctcctcccgctggtgactgaggcggacttgagacacgtagcctgggagcccgtggccccgaaatcttcgggtttggggagag

SEQ ID NO: 22256 - DNA, 63 bp, Homo sapiens; identical to SEQ ID NO: 12414
  chr16:15950853-15950916
  hyper

SEQ ID NO: 22257 - DNA, 91 bp, Homo sapiens
  chr16:19567111-19567202
  hyper
tacttgtgatggggtcggcctgggtctgagagtgtgaattcctctctgtcgggttctggtggtcgaccggccacccccaagttgtcttgac

SEQ ID NO: 22258 - DNA, 30 bp, Homo sapiens; identical to SEQ ID NO: 12416
  chr16:20085391-20085421
  hyper

SEQ ID NO: 22259 - DNA, 299 bp, Homo sapiens; identical to SEQ ID NO: 12417
  chr16:21294997-21295296
  hyper

SEQ ID NO: 22260 - DNA, 22 bp, Homo sapiens
  chr16:21295340-21295362
  hyper
cgctggccgctgctccagacgc

SEQ ID NO: 22261 - DNA, 49 bp, Homo sapiens; identical to SEQ ID NO: 12419
  chr16:21675345-21675394
  hyper

SEQ ID NO: 22262 - DNA, 13 bp, Homo sapiens
  chr16:21831608-21831621
  hyper
atcttacccagtc

SEQ ID NO: 22263 - DNA, 83 bp, Homo sapiens; identical to SEQ ID NO: 12421
  chr16:22173801-22173884
  hyper

SEQ ID NO: 22264 - DNA, 377 bp, Homo sapiens; identical to SEQ ID NO: 12422
  chr16:22203596-22203973
  hyper

SEQ ID NO: 22265 - DNA, 100 bp, Homo sapiens
  chr16:22824601-22824701
  hyper
tcctcactcagccctcggcgaccctctggtaccctggacagctccccggggagcagtctaccgctaggcggcggctgctaagagaggaaccctcctgacg

SEQ ID NO: 22266 - DNA, 30 bp, Homo sapiens; identical to SEQ ID NO: 12426
  chr16:22826278-22826308
  hyper

SEQ ID NO: 22267 - DNA, 64 bp, Homo sapiens
  chr16:23313400-23313464
  hyper
gtatcgctggtgtcccgaggtggggagggagaatgcggagcgcgtgcgtgcggggggcgtccag

SEQ ID NO: 22268 - DNA, 31 bp, Homo sapiens
  chr16:23706520-23706551
  hyper
ctcctgcaaggaggcccggcagagctccagg

SEQ ID NO: 22269 - DNA, 30 bp, Homo sapiens; identical to SEQ ID NO: 12429
  chr16:23765970-23766000
  hyper

SEQ ID NO: 22270 - DNA, 216 bp, Homo sapiens; identical to SEQ ID NO: 1259
  chr16:23846838-23847054
  hyper

SEQ ID NO: 22271 - DNA, 47 bp, Homo sapiens
  chr16:23847956-23848003
  hyper
cacctgactaggagcgcgcggggtctgtgcctgccctggagggcagc

SEQ ID NO: 22272 - DNA, 68 bp, Homo sapiens; identical to SEQ ID NO: 1265
  chr16:23848004-23848072
  hyper

SEQ ID NO: 22273 - DNA, 181 bp, Homo sapiens; identical to SEQ ID NO: 12437
  chr16:23848310-23848491
  hyper

SEQ ID NO: 22274 - DNA, 90 bp, Homo sapiens
  chr16:24267025-24267115
  hyper
aggattgaagaatgccgcgttgggtgggtgctgagggagcgccagagtgcgctacgggcttcgctccccttcccctttccttaacccttc

SEQ ID NO: 22275 - DNA, 265 bp, Homo sapiens
  chr16:24267220-24267485
  hyper
cgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccag

SEQ ID NO: 22276 - DNA, 30 bp, Homo sapiens
  chr16:24267578-24267608
  hyper
ctattttttgccatccgccctcacccccag

SEQ ID NO: 22277 - DNA, 37 bp, Homo sapiens; identical to SEQ ID NO: 12440
  chr16:24621912-24621949
  hyper

SEQ ID NO: 22278 - DNA, 98 bp, Homo sapiens; identical to SEQ ID NO: 12441
  chr16:25702837-25702935
  hyper

SEQ ID NO: 22279 - DNA, 490 bp, Homo sapiens
  chr16:25703152-25703642
  hyper
cgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcgg

SEQ ID NO: 22280 - DNA, 16 bp, Homo sapiens
  chr16:25704628-25704644
  hyper
tcggctgagagggctg

SEQ ID NO: 22281 - DNA, 214 bp, Homo sapiens
  chr16:28074684-28074898
  hyper
gcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccc

SEQ ID NO: 22282 - DNA, 30 bp, Homo sapiens; identical to SEQ ID NO: 12447
  chr16:31498683-31498713
  hyper

SEQ ID NO: 22283 - DNA, 100 bp, Homo sapiens; identical to SEQ ID NO: 12448
  chr16:31540961-31541061
  hyper

SEQ ID NO: 22284 - DNA, 80 bp, Homo sapiens
  chr16:31580480-31580560
  hyper
tctttggtgtcatttcgatttataaatccatatccatttctgacgttgaaccatttgacagtgccaaggactttggtggc

SEQ ID NO: 22285 - DNA, 132 bp, Homo sapiens; identical to SEQ ID NO: 12450
  chr16:47177106-47177238
  hyper

SEQ ID NO: 22286 - DNA, 62 bp, Homo sapiens
  chr16:49309108-49309170
  hyper
tgttctcattaagagcggatgcgcccgggctctgagcattagcgctccagtgcagcttggaa

SEQ ID NO: 22287 - DNA, 186 bp, Homo sapiens
  chr16:49309262-49309448
  hyper
ctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgca

SEQ ID NO: 22288 - DNA, 56 bp, Homo sapiens
  chr16:49311467-49311523
  hyper
acagggctgcaagggcgcccgctagagctgctccacggcttaccggattgcatgcg

SEQ ID NO: 22289 - DNA, 86 bp, Homo sapiens
  chr16:49313936-49314022
  hyper
ccggaaaaacaaaaacgaacaaacaaaaagcccctgatccctcctggacccagctgccaggacacagtggagaagccactgtgatt

SEQ ID NO: 22290 - DNA, 301 bp, Homo sapiens
  chr16:49314118-49314419
  hyper
ggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaa

SEQ ID NO: 22291 - DNA, 155 bp, Homo sapiens
  chr16:49315764-49315919
  hyper
caaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcgg

SEQ ID NO: 22292 - DNA, 35 bp, Homo sapiens; identical to SEQ ID NO: 12458
  chr16:49317700-49317735
  hyper

SEQ ID NO: 22293 - DNA, 18 bp, Homo sapiens
  chr16:51184406-51184424
  hyper
tggcggccagcagcactc

SEQ ID NO: 22294 - DNA, 37 bp, Homo sapiens
  chr16:51184770-51184807
  hyper
ccggaaaagcagggacggagaagccaggccggcatgc

SEQ ID NO: 22295 - DNA, 302 bp, Homo sapiens
  chr16:51185542-51185844
  hyper
gggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatca

SEQ ID NO: 22296 - DNA, 175 bp, Homo sapiens
  chr16:51186939-51187114
  hyper
aactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccg

SEQ ID NO: 22297 - DNA, 30 bp, Homo sapiens; identical to SEQ ID NO: 12467
  chr16:51189298-51189328
  hyper

SEQ ID NO: 22298 - DNA, 60 bp, Homo sapiens; identical to SEQ ID NO: 12469
  chr16:54318670-54318730
  hyper

SEQ ID NO: 22299 - DNA, 43 bp, Homo sapiens
  chr16:54319377-54319420
  hyper
tgctctccctggtggcgttcttgggacgggacgggtccccgaa

SEQ ID NO: 22300 - DNA, 14 bp, Homo sapiens
  chr16:54319468-54319482
  hyper
ggcagccgcggccg

SEQ ID NO: 22301 - DNA, 30 bp, Homo sapiens; identical to SEQ ID NO: 12473
  chr16:54966792-54966822
  hyper

SEQ ID NO: 22302 - DNA, 20 bp, Homo sapiens
  chr16:54971546-54971566
  hyper
cttagctttgaactccggcc

SEQ ID NO: 22303 - DNA, 30 bp, Homo sapiens; identical to SEQ ID NO: 12476
  chr16:54972930-54972960
  hyper

SEQ ID NO: 22304 - DNA, 304 bp, Homo sapiens
  chr16:55357622-55357926
  hyper
ggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtc

SEQ ID NO: 22305 - DNA, 230 bp, Homo sapiens
  chr16:55358086-55358316
  hyper
tcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgc

SEQ ID NO: 22306 - DNA, 260 bp, Homo sapiens
  chr16:55364843-55365103
  hyper
ggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagt

SEQ ID NO: 22307 - DNA, 1 bp, Homo sapiens
  chr16:55404998-55404999
  hyper
t

SEQ ID NO: 22308 - DNA, 19 bp, Homo sapiens
  chr16:55512935-55512954
  hyper
cggccggggaaaagaggtg

SEQ ID NO: 22309 - DNA, 138 bp, Homo sapiens; identical to SEQ ID NO: 12486
  chr16:55513226-55513364
  hyper

SEQ ID NO: 22310 - DNA, 40 bp, Homo sapiens; identical to SEQ ID NO: 12487
  chr16:55513482-55513522
  hyper

SEQ ID NO: 22311 - DNA, 30 bp, Homo sapiens; identical to SEQ ID NO: 12488
  chr16:55514115-55514145
  hyper

SEQ ID NO: 22312 - DNA, 89 bp, Homo sapiens; identical to SEQ ID NO: 4359
  chr16:56224880-56224969
  hyper

SEQ ID NO: 22313 - DNA, 30 bp, Homo sapiens; identical to SEQ ID NO: 12495
  chr16:56225583-56225613
  hyper

SEQ ID NO: 22314 - DNA, 10 bp, Homo sapiens
  chr16:56228581-56228591
  hyper
gaggggagtg

SEQ ID NO: 22315 - DNA, 116 bp, Homo sapiens; identical to SEQ ID NO: 12497
  chr16:56623236-56623352
  hyper

SEQ ID NO: 22316 - DNA, 167 bp, Homo sapiens; identical to SEQ ID NO: 12498
  chr16:56623702-56623869
  hyper

SEQ ID NO: 22317 - DNA, 47 bp, Homo sapiens
  chr16:56651275-56651322
  hyper
gcccggccggcctgctgctcacagtccctccacgtacccacaggagg

SEQ ID NO: 22318 - DNA, 47 bp, Homo sapiens
  chr16:56659128-56659175
  hyper
ctatgtaaggaggtgcgggaccgaggaacctaggtgtggacagggac

SEQ ID NO: 22319 - DNA, 65 bp, Homo sapiens
  chr16:56659673-56659738
  hyper
cagccagttgcagggctccattctgctttccaactgcctgactgcttgttcgtctcactggtgtg

SEQ ID NO: 22320 - DNA, 44 bp, Homo sapiens; identical to SEQ ID NO: 12501
  chr16:56665985-56666029
  hyper

SEQ ID NO: 22321 - DNA, 34 bp, Homo sapiens; identical to SEQ ID NO: 12502
  chr16:56666408-56666442
  hyper

SEQ ID NO: 22322 - DNA, 308 bp, Homo sapiens; identical to SEQ ID NO: 12504
  chr16:56677180-56677488
  hyper

SEQ ID NO: 22323 - DNA, 19 bp, Homo sapiens
  chr16:56710030-56710049
  hyper
accacgcctcccacctgcc

SEQ ID NO: 22324 - DNA, 55 bp, Homo sapiens
  chr16:58018579-58018634
  hyper
acgagggaaagctggcgcccatcgcgccaggcatcaaccgagtggactggccctg

SEQ ID NO: 22325 - DNA, 51 bp, Homo sapiens
  chr16:58018845-58018896
  hyper
gtggcacttgcggtgggtggagccgagacgtgcgcgcggatctggaggcag

SEQ ID NO: 22326 - DNA, 61 bp, Homo sapiens
  chr16:58019164-58019225
  hyper
ctggcgggtagggagcgctgcgcgcagacccgtccctgagcggggagcgggggtcctggtg

SEQ ID NO: 22327 - DNA, 5 bp, Homo sapiens
  chr16:58019430-58019435
  hyper
cccct

SEQ ID NO: 22328 - DNA, 7 bp, Homo sapiens
  chr16:58497214-58497221
  hyper
tctaaac

SEQ ID NO: 22329 - DNA, 265 bp, Homo sapiens; identical to SEQ ID NO: 12510
  chr16:58497469-58497734
  hyper

SEQ ID NO: 22330 - DNA, 181 bp, Homo sapiens
  chr16:58497994-58498175
  hyper
tctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgt

SEQ ID NO: 22331 - DNA, 366 bp, Homo sapiens
  chr16:58498204-58498570
  hyper
gctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgc

SEQ ID NO: 22332 - DNA, 138 bp, Homo sapiens; identical to SEQ ID NO: 12513
  chr16:62069136-62069274
  hyper

SEQ ID NO: 22333 - DNA, 35 bp, Homo sapiens; identical to SEQ ID NO: 12514
  chr16:62069336-62069371
  hyper

SEQ ID NO: 22334 - DNA, 13 bp, Homo sapiens
  chr16:62070773-62070786
  hyper
taggaggaagagg

SEQ ID NO: 22335 - DNA, 172 bp, Homo sapiens; identical to SEQ ID NO: 12516
  chr16:65155754-65155926
  hyper

SEQ ID NO: 22336 - DNA, 26 bp, Homo sapiens
  chr16:65156359-65156385
  hyper
tccttcccccaaatccgctccagctg

SEQ ID NO: 22337 - DNA, 23 bp, Homo sapiens
  chr16:65156872-65156895
  hyper
aagggcctaatggggcgcagcgc

SEQ ID NO: 22338 - DNA, 132 bp, Homo sapiens; identical to SEQ ID NO: 12519
  chr16:65157154-65157286
  hyper

SEQ ID NO: 22339 - DNA, 15 bp, Homo sapiens
  chr16:65157823-65157838
  hyper
gtaaccccccaacct

SEQ ID NO: 22340 - DNA, 208 bp, Homo sapiens
  chr16:66461578-66461786
  hyper
gaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaa

SEQ ID NO: 22341 - DNA, 36 bp, Homo sapiens; identical to SEQ ID NO: 12523
  chr16:66638302-66638338
  hyper

SEQ ID NO: 22342 - DNA, 32 bp, Homo sapiens; identical to SEQ ID NO: 12524
  chr16:66878288-66878320
  hyper

SEQ ID NO: 22343 - DNA, 106 bp, Homo sapiens; identical to SEQ ID NO: 12525
  chr16:66878819-66878925
  hyper

SEQ ID NO: 22344 - DNA, 31 bp, Homo sapiens
  chr16:67197667-67197698
  hyper
ataccctcaagctcacgcgcgagccgcatcc

SEQ ID NO: 22345 - DNA, 240 bp, Homo sapiens
  chr16:67197769-67198009
  hyper
agggaacggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgca

SEQ ID NO: 22346 - DNA, 233 bp, Homo sapiens
  chr16:67198039-67198272
  hyper
cctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgc

SEQ ID NO: 22347 - DNA, 142 bp, Homo sapiens
  chr16:67198775-67198917
  hyper
tcggcaagctatgggcgctggtgggggacccaggcacagaccacctgatccgctggagcccggtgagggccggggcccctcgattccccctgtggtcccggggtccctccacgtcagtgaacacccatgcccgcccaacccc

SEQ ID NO: 22348 - DNA, 51 bp, Homo sapiens; identical to SEQ ID NO: 12528
  chr16:67199411-67199462
  hyper

SEQ ID NO: 22349 - DNA, 45 bp, Homo sapiens; identical to SEQ ID NO: 12529
  chr16:68118410-68118455
  hyper

SEQ ID NO: 22350 - DNA, 98 bp, Homo sapiens; identical to SEQ ID NO: 12530
  chr16:68118803-68118901
  hyper

SEQ ID NO: 22351 - DNA, 69 bp, Homo sapiens; identical to SEQ ID NO: 12531
  chr16:68504068-68504137
  hyper

SEQ ID NO: 22352 - DNA, 48 bp, Homo sapiens
  chr16:68676360-68676408
  hyper
aagtggttggcacatcgccggctgtcagcaaatgtttttgaaatgaat

SEQ ID NO: 22353 - DNA, 48 bp, Homo sapiens
  chr16:71459979-71460027
  hyper
ctccgccgcttgcaccggacccaggcgctcatcccccgcttcccccgc

SEQ ID NO: 22354 - DNA, 72 bp, Homo sapiens; identical to SEQ ID NO: 12537
  chr16:75528797-75528869
  hyper

SEQ ID NO: 22355 - DNA, 207 bp, Homo sapiens; identical to SEQ ID NO: 12538
  chr16:75528922-75529129
  hyper

SEQ ID NO: 22356 - DNA, 208 bp, Homo sapiens; identical to SEQ ID NO: 12539
  chr16:77246657-77246865
  hyper

SEQ ID NO: 22357 - DNA, 48 bp, Homo sapiens; identical to SEQ ID NO: 12540
  chr16:77469028-77469076
  hyper

SEQ ID NO: 22358 - DNA, 85 bp, Homo sapiens; identical to SEQ ID NO: 4369
  chr16:77822334-77822419
  hyper

SEQ ID NO: 22359 - DNA, 169 bp, Homo sapiens
  chr16:77822420-77822589
  hyper
gaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaagg

SEQ ID NO: 22360 - DNA, 234 bp, Homo sapiens
  chr16:77822874-77823108
  hyper
gggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtc

SEQ ID NO: 22361 - DNA, 57 bp, Homo sapiens; identical to SEQ ID NO: 12543
  chr16:78079844-78079901
  hyper

SEQ ID NO: 22362 - DNA, 83 bp, Homo sapiens; identical to SEQ ID NO: 12544
  chr16:79632686-79632769
  hyper

SEQ ID NO: 22363 - DNA, 38 bp, Homo sapiens; identical to SEQ ID NO: 12545
  chr16:79633490-79633528
  hyper

SEQ ID NO: 22364 - DNA, 153 bp, Homo sapiens; identical to SEQ ID NO: 12546
  chr16:80574886-80575039
  hyper

SEQ ID NO: 22365 - DNA, 136 bp, Homo sapiens; identical to SEQ ID NO: 12548
  chr16:82661468-82661604
  hyper

SEQ ID NO: 22366 - DNA, 49 bp, Homo sapiens; identical to SEQ ID NO: 12549
  chr16:84633325-84633374
  hyper

SEQ ID NO: 22367 - DNA, 30 bp, Homo sapiens; identical to SEQ ID NO: 12550
  chr16:85203552-85203582
  hyper

SEQ ID NO: 22368 - DNA, 228 bp, Homo sapiens; identical to SEQ ID NO: 12551
  chr16:85932377-85932605
  hyper

SEQ ID NO: 22369 - DNA, 97 bp, Homo sapiens
  chr16:85932858-85932955
  hyper
tgtcccgcgcggtccggtcccgcggggtccccgacgccaggcggggcgtgggggtggaactacctaccgtaatgtccccgggcgcagctcagtggcc

SEQ ID NO: 22370 - DNA, 30 bp, Homo sapiens; identical to SEQ ID NO: 12553
  chr16:86320396-86320426
  hyper

SEQ ID NO: 22371 - DNA, 119 bp, Homo sapiens
  chr16:86320901-86321020
  hyper
ccctctggtgccagccgccttcaggctgtgggtccgtccgctggtggaggggaaggtcggggctggccccgggccccgcgctgctgggccccatggtcagtggagacgcctcctggtct

SEQ ID NO: 22372 - DNA, 243 bp, Homo sapiens
  chr16:86531046-86531289
  hyper
cctcggtcttcccggctcccaggacgccccccccgcccccgcccctccattcagcctgtcatctcggccctccgccgcctccggagccccgacggaggtgctgagttgtcaacgcaaattcctagttaagccacttgttgataaaccctctaggcaaattggttccgtctttacctgcccgccccgcccccgcccccggccccagccggcgcgcccctaattgctggaggagctcgacgccgg

SEQ ID NO: 22373 - DNA, 47 bp, Homo sapiens
  chr16:86531573-86531620
  hyper
gtccctcccgccgcgcagggtctccgcgggcgcgccccgccccaaat

SEQ ID NO: 22374 - DNA, 42 bp, Homo sapiens; identical to SEQ ID NO: 12559
  chr16:86539385-86539427
  hyper

SEQ ID NO: 22375 - DNA, 15 bp, Homo sapiens
  chr16:86539463-86539478
  hyper
cgctctcggcccggg

SEQ ID NO: 22376 - DNA, 161 bp, Homo sapiens
  chr16:86600322-86600483
  hyper
cctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctc

SEQ ID NO: 22377 - DNA, 64 bp, Homo sapiens; identical to SEQ ID NO: 12566
  chr16:86600877-86600941
  hyper

SEQ ID NO: 22378 - DNA, 84 bp, Homo sapiens; identical to SEQ ID NO: 12569
  chr16:86775022-86775106
  hyper

SEQ ID NO: 22379 - DNA, 33 bp, Homo sapiens
  chr16:87635070-87635103
  hyper
cagtttctggctcaccgcgctgcggtcaccggc

SEQ ID NO: 22380 - DNA, 368 bp, Homo sapiens
  chr16:87636907-87637275
  hyper
ctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaa

SEQ ID NO: 22381 - DNA, 54 bp, Homo sapiens; identical to SEQ ID NO: 12573
  chr16:87637599-87637653
  hyper

SEQ ID NO: 22382 - DNA, 42 bp, Homo sapiens; identical to SEQ ID NO: 12574
  chr16:88449331-88449373
  hyper

SEQ ID NO: 22383 - DNA, 215 bp, Homo sapiens; identical to SEQ ID NO: 12575
  chr16:88449705-88449920
  hyper

SEQ ID NO: 22384 - DNA, 65 bp, Homo sapiens; identical to SEQ ID NO: 12576
  chr16:88450363-88450428
  hyper

SEQ ID NO: 22385 - DNA, 11 bp, Homo sapiens
  chr16:89007509-89007520
  hyper
tggtccccgcc

SEQ ID NO: 22386 - DNA, 173 bp, Homo sapiens
  chr16:89007558-89007731
  hyper
ccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaa

SEQ ID NO: 22387 - DNA, 145 bp, Homo sapiens
  chr16:89267663-89267808
  hyper
gcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcag

SEQ ID NO: 22388 - DNA, 30 bp, Homo sapiens; identical to SEQ ID NO: 12579
  chr16:89992943-89992973
  hyper

SEQ ID NO: 22389 - DNA, 57 bp, Homo sapiens; identical to SEQ ID NO: 12580
  chr17:1083604-1083661
  hyper

SEQ ID NO: 22390 - DNA, 45 bp, Homo sapiens; identical to SEQ ID NO: 12582
  chr17:1928077-1928122
  hyper

SEQ ID NO: 22391 - DNA, 32 bp, Homo sapiens
  chr17:1959436-1959468
  hyper
gggccccgaccgagggttgacagcccccggcc

SEQ ID NO: 22392 - DNA, 477 bp, Homo sapiens; identical to SEQ ID NO: 12584
  chr17:2627798-2628275
  hyper

SEQ ID NO: 22393 - DNA, 41 bp, Homo sapiens; identical to SEQ ID NO: 12585
  chr17:2652548-2652589
  hyper

SEQ ID NO: 22394 - DNA, 30 bp, Homo sapiens; identical to SEQ ID NO: 12586
  chr17:2659635-2659665
  hyper

SEQ ID NO: 22395 - DNA, 118 bp, Homo sapiens; identical to SEQ ID NO: 12587
  chr17:2756282-2756400
  hyper

SEQ ID NO: 22396 - DNA, 12 bp, Homo sapiens
  chr17:3438902-3438914
  hyper
agaaggccccct

SEQ ID NO: 22397 - DNA, 59 bp, Homo sapiens; identical to SEQ ID NO: 12589
  chr17:3867044-3867103
  hyper

SEQ ID NO: 22398 - DNA, 57 bp, Homo sapiens
  chr17:4544550-4544607
  hyper
ttgtgcaatgaggggcgcacaggagcatgccctcaattccaaggagatcgggtagcg

SEQ ID NO: 22399 - DNA, 70 bp, Homo sapiens
  chr17:4544710-4544780
  hyper
gagaatcggccagaggccaacgggggcgcatgtcctccccggtatttgactgactcggagccaggggcgc

SEQ ID NO: 22400 - DNA, 41 bp, Homo sapiens; identical to SEQ ID NO: 12591
  chr17:4981508-4981549
  hyper

SEQ ID NO: 22401 - DNA, 4 bp, Homo sapiens
  chr17:4981951-4981955
  hyper
cgtt

SEQ ID NO: 22402 - DNA, 27 bp, Homo sapiens
  chr17:5000401-5000428
  hyper
gagcagcctcagcagcgcaggtggaca

SEQ ID NO: 22403 - DNA, 46 bp, Homo sapiens; identical to SEQ ID NO: 12594
  chr17:5001155-5001201
  hyper

SEQ ID NO: 22404 - DNA, 62 bp, Homo sapiens; identical to SEQ ID NO: 12595
  chr17:6616271-6616333
  hyper

SEQ ID NO: 22405 - DNA, 197 bp, Homo sapiens
  chr17:6616686-6616883
  hyper
aggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaac

SEQ ID NO: 22406 - DNA, 27 bp, Homo sapiens
  chr17:6616884-6616911
  hyper
cttcgggccagccctctaggggcagcc

SEQ ID NO: 22407 - DNA, 32 bp, Homo sapiens; identical to SEQ ID NO: 12598
  chr17:6679763-6679795
  hyper

SEQ ID NO: 22408 - DNA, 36 bp, Homo sapiens; identical to SEQ ID NO: 12599
  chr17:6926208-6926244
  hyper

SEQ ID NO: 22409 - DNA, 41 bp, Homo sapiens; identical to SEQ ID NO: 12600
  chr17:7554709-7554750
  hyper

SEQ ID NO: 22410 - DNA, 30 bp, Homo sapiens; identical to SEQ ID NO: 12601
  chr17:8055644-8055674
  hyper

SEQ ID NO: 22411 - DNA, 88 bp, Homo sapiens
  chr17:8230694-8230782
  hyper
tagccactcctccttcccacccacccgcagcactctcgaggtcgcaacggcagtcaccaggtcccggggcctgcgttcagctgcttga

SEQ ID NO: 22412 - DNA, 155 bp, Homo sapiens
  chr17:8906518-8906673
  hyper
ccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcg

SEQ ID NO: 22413 - DNA, 86 bp, Homo sapiens
  chr17:8906907-8906993
  hyper
cggccctgccgcgcccgcgccccgggccaccccgcccggccccctcggcgctgcacccctcgctttccccatctccagccgctcgc

SEQ ID NO: 22414 - DNA, 153 bp, Homo sapiens
  chr17:8907575-8907728
  hyper
gctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgct

SEQ ID NO: 22415 - DNA, 22 bp, Homo sapiens
  chr17:8907776-8907798
  hyper
cgggtgacggaggctttatcct

SEQ ID NO: 22416 - DNA, 63 bp, Homo sapiens; identical to SEQ ID NO: 12610
  chr17:8925622-8925685
  hyper

SEQ ID NO: 22417 - DNA, 97 bp, Homo sapiens
  chr17:10102318-10102415
  hyper
cactcgcgcccccaccgccggggaccgcgggaatggaaacgcccctctgttctgtgcctgctttgtaggcctggcggcccgtggcgtgcgggcggct

SEQ ID NO: 22418 - DNA, 245 bp, Homo sapiens; identical to SEQ ID NO: 12614
  chr17:10633034-10633279
  hyper

SEQ ID NO: 22419 - DNA, 34 bp, Homo sapiens; identical to SEQ ID NO: 12615
  chr17:13503911-13503945
  hyper

SEQ ID NO: 22420 - DNA, 33 bp, Homo sapiens
  chr17:14201008-14201041
  hyper
ggggctctgggccaccggttcaggctgccccag

SEQ ID NO: 22421 - DNA, 149 bp, Homo sapiens; identical to SEQ ID NO: 12620
  chr17:14203122-14203271
  hyper

SEQ ID NO: 22422 - DNA, 115 bp, Homo sapiens; identical to SEQ ID NO: 12621
  chr17:14204011-14204126
  hyper

SEQ ID NO: 22423 - DNA, 447 bp, Homo sapiens; identical to SEQ ID NO: 12622
  chr17:14205251-14205698
  hyper

SEQ ID NO: 22424 - DNA, 30 bp, Homo sapiens; identical to SEQ ID NO: 12623
  chr17:14206313-14206343
  hyper

SEQ ID NO: 22425 - DNA, 30 bp, Homo sapiens; identical to SEQ ID NO: 12624
  chr17:15164652-15164682
  hyper

SEQ ID NO: 22426 - DNA, 66 bp, Homo sapiens; identical to SEQ ID NO: 12625
  chr17:15166283-15166349
  hyper

SEQ ID NO: 22427 - DNA, 92 bp, Homo sapiens; identical to SEQ ID NO: 12626
  chr17:15166709-15166801
  hyper

SEQ ID NO: 22428 - DNA, 63 bp, Homo sapiens
  chr17:15244987-15245050
  hyper
cggccgccccggccggctcgccggagctgactggccagttataggagaggcgggagctgtcag

SEQ ID NO: 22429 - DNA, 35 bp, Homo sapiens; identical to SEQ ID NO: 12628
  chr17:15820977-15821012
  hyper

SEQ ID NO: 22430 - DNA, 213 bp, Homo sapiens; identical to SEQ ID NO: 12629
  chr17:16472191-16472404
  hyper

SEQ ID NO: 22431 - DNA, 109 bp, Homo sapiens
  chr17:16570794-16570903
  hyper
ggggctgaaaggctgaagggcgggcagcgtgccgggtccctgcggctgggtccaccgcacgtcacgtggcagaatcccggggctgctttctctccggctgctcagccac

SEQ ID NO: 22432 - DNA, 74 bp, Homo sapiens; identical to SEQ ID NO: 12631
  chr17:17398902-17398976
  hyper

SEQ ID NO: 22433 - DNA, 40 bp, Homo sapiens; identical to SEQ ID NO: 12633
  chr17:19437028-19437068
  hyper

SEQ ID NO: 22434 - DNA, 51 bp, Homo sapiens; identical to SEQ ID NO: 12634
  chr17:19483136-19483187
  hyper

SEQ ID NO: 22435 - DNA, 30 bp, Homo sapiens; identical to SEQ ID NO: 12635
  chr17:20755963-20755993
  hyper

SEQ ID NO: 22436 - DNA, 34 bp, Homo sapiens; identical to SEQ ID NO: 12636
  chr17:26120627-26120661
  hyper

SEQ ID NO: 22437 - DNA, 78 bp, Homo sapiens
  chr17:26554556-26554634
  hyper
ggggctctccccctgcggccccgctccaccgggggcgtggctagatctgaccgcgcccttccaggccccgccctcagg

SEQ ID NO: 22438 - DNA, 48 bp, Homo sapiens
  chr17:26554705-26554753
  hyper
caggtggcggtaaaagcgcccccatcaagtcacataacatcctgcctc

SEQ ID NO: 22439 - DNA, 178 bp, Homo sapiens; identical to SEQ ID NO: 12638
  chr17:26554791-26554969
  hyper

SEQ ID NO: 22440 - DNA, 46 bp, Homo sapiens; identical to SEQ ID NO: 12639
  chr17:26578387-26578433
  hyper

SEQ ID NO: 22441 - DNA, 35 bp, Homo sapiens
  chr17:27332660-27332695
  hyper
cgcgaagcccgcgccccgcccggcttggccggcgc

SEQ ID NO: 22442 - DNA, 629 bp, Homo sapiens; identical to SEQ ID NO: 12642
  chr17:27949499-27950128
  hyper

SEQ ID NO: 22443 - DNA, 30 bp, Homo sapiens; identical to SEQ ID NO: 12643
  chr17:28562797-28562827
  hyper

SEQ ID NO: 22444 - DNA, 91 bp, Homo sapiens; identical to SEQ ID NO: 12644
  chr17:28705348-28705439
  hyper

SEQ ID NO: 22445 - DNA, 67 bp, Homo sapiens
  chr17:29249650-29249717
  hyper
ccccacctgcagctccgcgccgagccccgcggtgcgccccccgcgccctcctctcggttccttctga

SEQ ID NO: 22446 - DNA, 9 bp, Homo sapiens
  chr17:29249930-29249939
  hyper
gctcctctc

SEQ ID NO: 22447 - DNA, 73 bp, Homo sapiens
  chr17:29718142-29718215
  hyper
ctccagagatggcagcgaatcccggccctgcctcttgccagctgtgtggcctagagtgagtccgacctctctg

SEQ ID NO: 22448 - DNA, 102 bp, Homo sapiens
  chr17:29718269-29718371
  hyper
cccccaggacatcctgagcgctcgggagacgccaggcgcggcagcgggcacggatagcggaaaggggcgcgaccccgcggaatcctccggcagggcagggcc

SEQ ID NO: 22449 - DNA, 382 bp, Homo sapiens
  chr17:29718805-29719187
  hyper
gcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccggg

SEQ ID NO: 22450 - DNA, 64 bp, Homo sapiens; identical to SEQ ID NO: 12648
  chr17:30846542-30846606
  hyper

SEQ ID NO: 22451 - DNA, 118 bp, Homo sapiens; identical to SEQ ID NO: 1281
  chr17:31618291-31618409
  hyper

SEQ ID NO: 22452 - DNA, 15 bp, Homo sapiens
  chr17:31618410-31618425
  hyper
cggagggcaactcac

SEQ ID NO: 22453 - DNA, 18 bp, Homo sapiens
  chr17:31619319-31619337
  hyper
gggcgcccgcccggggct

SEQ ID NO: 22454 - DNA, 264 bp, Homo sapiens
  chr17:31619687-31619951
  hyper
gagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtcc

SEQ ID NO: 22455 - DNA, 125 bp, Homo sapiens
  chr17:31620026-31620151
  hyper
ccagccttgctgtctctcgcgtcttctctctgcccccgcggcgacaagagctggggactgcggggacccgccaacacctcccgggggtgacccggactcgctgctccgcgcgcccttctcctctc

SEQ ID NO: 22456 - DNA, 57 bp, Homo sapiens; identical to SEQ ID NO: 12653
  chr17:32906021-32906078
  hyper

SEQ ID NO: 22457 - DNA, 153 bp, Homo sapiens; identical to SEQ ID NO: 12654
  chr17:32907265-32907418
  hyper

SEQ ID NO: 22458 - DNA, 32 bp, Homo sapiens
  chr17:32907620-32907652
  hyper
cttggaggaagaaagcggcgctatccatgtgc

SEQ ID NO: 22459 - DNA, 52 bp, Homo sapiens
  chr17:32907753-32907805
  hyper
tgggctctaggtagcccccgggacgcccgcggccaccgggctccggactgca

SEQ ID NO: 22460 - DNA, 259 bp, Homo sapiens
  chr17:32907873-32908132
  hyper
cgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccc

SEQ ID NO: 22461 - DNA, 65 bp, Homo sapiens
  chr17:32908582-32908647
  hyper
gcgcgcaggccggtgcggggccgcgccgcccgtcgcctcgcttcctgcggcggtcctcgggaagg

SEQ ID NO: 22462 - DNA, 301 bp, Homo sapiens; identical to SEQ ID NO: 12660
  chr17:33700472-33700773
  hyper

SEQ ID NO: 22463 - DNA, 402 bp, Homo sapiens; identical to SEQ ID NO: 12661
  chr17:33700974-33701376
  hyper

SEQ ID NO: 22464 - DNA, 44 bp, Homo sapiens; identical to SEQ ID NO: 12662
  chr17:33775400-33775444
  hyper

SEQ ID NO: 22465 - DNA, 347 bp, Homo sapiens; identical to SEQ ID NO: 12663
  chr17:35014262-35014609
  hyper

SEQ ID NO: 22466 - DNA, 341 bp, Homo sapiens; identical to SEQ ID NO: 12664
  chr17:35078546-35078887
  hyper

SEQ ID NO: 22467 - DNA, 52 bp, Homo sapiens
  chr17:35165593-35165645
  hyper
cttcaattttatcagcggccggggagccgggcgggagataggaggccggccc

SEQ ID NO: 22468 - DNA, 30 bp, Homo sapiens; identical to SEQ ID NO: 12666
  chr17:35165897-35165927
  hyper

SEQ ID NO: 22469 - DNA, 105 bp, Homo sapiens
  chr17:35285437-35285542
  hyper
cctcccttcatccatcgcggaaggagcagcgggggggctggccctctcagccccgagagcagagagcggcagaagctgttaattcttgaggctaatgttcacatc

SEQ ID NO: 22470 - DNA, 129 bp, Homo sapiens
  chr17:35285666-35285795
  hyper
ggagagctggtgggggtagaaggcggtgaggggccgaaaggctcctcaaacccagtttctttccatgctaaggctggggaaataacctcatggcaactacactttccgataacccgcctcattaatatt

SEQ ID NO: 22471 - DNA, 21 bp, Homo sapiens
  chr17:35290655-35290676
  hyper
ctttcacggccttgtcactct

SEQ ID NO: 22472 - DNA, 307 bp, Homo sapiens
  chr17:35294154-35294461
  hyper
accagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagaca

SEQ ID NO: 22473 - DNA, 542 bp, Homo sapiens
  chr17:35294505-35295047
  hyper
gagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaag

SEQ ID NO: 22474 - DNA, 465 bp, Homo sapiens
  chr17:35295160-35295625
  hyper
tcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctc

SEQ ID NO: 22475 - DNA, 30 bp, Homo sapiens; identical to SEQ ID NO: 12676
  chr17:35296016-35296046
  hyper

SEQ ID NO: 22476 - DNA, 46 bp, Homo sapiens
  chr17:35296292-35296338
  hyper
cttccctggctgccgaagttgtctggtggttcggcttcagccccag

SEQ ID NO: 22477 - DNA, 12 bp, Homo sapiens
  chr17:35296716-35296728
  hyper
cgctgtccccag

SEQ ID NO: 22478 - DNA, 258 bp, Homo sapiens
  chr17:35296888-35297146
  hyper
ccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctcc

SEQ ID NO: 22479 - DNA, 90 bp, Homo sapiens; identical to SEQ ID NO: 4402
  chr17:35297147-35297237
  hyper

SEQ ID NO: 22480 - DNA, 11 bp, Homo sapiens
  chr17:35298153-35298164
  hyper
ggagaccggcc

SEQ ID NO: 22481 - DNA, 66 bp, Homo sapiens
  chr17:35299185-35299251
  hyper
acagccccagagaagcggtaactgtgatagtgtgactgttagaaaaactccagctataccacaact

SEQ ID NO: 22482 - DNA, 15 bp, Homo sapiens
  chr17:35303325-35303340
  hyper
acaacgtggttgtgg

SEQ ID NO: 22483 - DNA, 75 bp, Homo sapiens; identical to SEQ ID NO: 12687
  chr17:36102404-36102479
  hyper

SEQ ID NO: 22484 - DNA, 280 bp, Homo sapiens; identical to SEQ ID NO: 12688
  chr17:36102707-36102987
  hyper

SEQ ID NO: 22485 - DNA, 31 bp, Homo sapiens
  chr17:36103540-36103571
  hyper
gccaaggctcagccccgaaatcgcggcgctt

SEQ ID NO: 22486 - DNA, 2 bp, Homo sapiens
  chr17:36103601-36103603
  hyper
cc

SEQ ID NO: 22487 - DNA, 53 bp, Homo sapiens
  chr17:36104779-36104832
  hyper
ctcctccaaggcctgaaccagcacctccttggtgaccccggagctcagcaggg

SEQ ID NO: 22488 - DNA, 86 bp, Homo sapiens
  chr17:36105137-36105223
  hyper
ggggagggggaaacccggagagagggagagccggaggggcagacctggagagcagaagacctgggccgggagcggggctttgccag

SEQ ID NO: 22489 - DNA, 116 bp, Homo sapiens
  chr17:36105596-36105712
  hyper
gcatgccctggagggactccatttatttctacctcggttactacctccaggccccagaacctccctggcctggtctggcggtttgggtttgcagaactgcccgccagagagcgtag

SEQ ID NO: 22490 - DNA, 247 bp, Homo sapiens
  chr17:37366090-37366337
  hyper
cccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggctt

SEQ ID NO: 22491 - DNA, 4 bp, Homo sapiens
  chr17:37381007-37381011
  hyper
gcag

SEQ ID NO: 22492 - DNA, 267 bp, Homo sapiens
  chr17:37381850-37382117
  hyper
gttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccg

SEQ ID NO: 22493 - DNA, 59 bp, Homo sapiens; identical to SEQ ID NO: 12702
  chr17:37752878-37752937
  hyper

SEQ ID NO: 22494 - DNA, 144 bp, Homo sapiens; identical to SEQ ID NO: 12703
  chr17:37753194-37753338
  hyper

SEQ ID NO: 22495 - DNA, 42 bp, Homo sapiens
  chr17:37760446-37760488
  hyper
aggggacagaatggccgcggggaggaggagccggcgagctca

SEQ ID NO: 22496 - DNA, 30 bp, Homo sapiens; identical to SEQ ID NO: 12705
  chr17:37761235-37761265
  hyper

SEQ ID NO: 22497 - DNA, 511 bp, Homo sapiens
  chr17:37761486-37761997
  hyper
tggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgc

SEQ ID NO: 22498 - DNA, 446 bp, Homo sapiens
  chr17:37762334-37762780
  hyper
agcgcccagatatagttcttggctaggcgcagcgtctcgatcttggacagcttctgcgtcttggagtagcagggcaccaccttgcgcaggttgtccagggctgcgttcaggtcgtgcatgcggttgcgctcccgcgcgttcgccttctgccgccgaagcttggagcgctccaagcgcgccttggtcatcttgcgcttcttgggcccgcgcttcttgggccgctcgccctccgcctcgtccagtccttcttcctcctcctcttcctcctcctcctctccccccagctcgccttcctccttgacctcggccaacgtggcctccgtcccctcttctccacggagagggactggcttggccgcccgggctggccccggagcccctggcccgggcgcaggcggtggcggtggcggcgcgtcgcccttgtcgctcctcggctcgtcgtcttc

SEQ ID NO: 22499 - DNA, 51 bp, Homo sapiens; identical to SEQ ID NO: 12707
  chr17:37856662-37856713
  hyper

SEQ ID NO: 22500 - DNA, 42 bp, Homo sapiens; identical to SEQ ID NO: 12708
  chr17:38478791-38478833
  hyper

SEQ ID NO: 22501 - DNA, 52 bp, Homo sapiens; identical to SEQ ID NO: 12709
  chr17:40332871-40332923
  hyper

SEQ ID NO: 22502 - DNA, 88 bp, Homo sapiens
  chr17:40464190-40464278
  hyper
aaaaagcaggggactcgaggtttggggaaatgatggagatgggcgcgggtgggcagaactctgacccaggcttctccttagcagctgc

SEQ ID NO: 22503 - DNA, 61 bp, Homo sapiens
  chr17:40464317-40464378
  hyper
cgccaagatgcttctcaaccctcggggccaggggcagtcccagagccgcaacaaccgtccc

SEQ ID NO: 22504 - DNA, 49 bp, Homo sapiens; identical to SEQ ID NO: 12711
  chr17:40912947-40912996
  hyper

SEQ ID NO: 22505 - DNA, 49 bp, Homo sapiens; identical to SEQ ID NO: 12712
  chr17:40932774-40932823
  hyper

SEQ ID NO: 22506 - DNA, 59 bp, Homo sapiens; identical to SEQ ID NO: 12713
  chr17:40932843-40932902
  hyper

SEQ ID NO: 22507 - DNA, 30 bp, Homo sapiens; identical to SEQ ID NO: 12714
  chr17:41984002-41984032
  hyper

SEQ ID NO: 22508 - DNA, 70 bp, Homo sapiens; identical to SEQ ID NO: 12715
  chr17:41984440-41984510
  hyper

SEQ ID NO: 22509 - DNA, 65 bp, Homo sapiens; identical to SEQ ID NO: 12718
  chr17:42061257-42061322
  hyper

SEQ ID NO: 22510 - DNA, 130 bp, Homo sapiens; identical to SEQ ID NO: 12720
  chr17:42083143-42083273
  hyper

SEQ ID NO: 22511 - DNA, 79 bp, Homo sapiens; identical to SEQ ID NO: 12721
  chr17:42083525-42083604
  hyper

SEQ ID NO: 22512 - DNA, 30 bp, Homo sapiens; identical to SEQ ID NO: 12722
  chr17:42393545-42393575
  hyper

SEQ ID NO: 22513 - DNA, 82 bp, Homo sapiens
  chr17:42394024-42394106
  hyper
ccagtctgagctcggactcccagcgcctgggagagggcacgcgggacgaggagccctggggtcccatcggtgagctccccca

SEQ ID NO: 22514 - DNA, 1 bp, Homo sapiens
  chr17:42635294-42635295
  hyper
t

SEQ ID NO: 22515 - DNA, 155 bp, Homo sapiens
  chr17:42733556-42733711
  hyper
cacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggagggg

SEQ ID NO: 22516 - DNA, 15 bp, Homo sapiens
  chr17:42733884-42733899
  hyper
cggggtgcgggctga

SEQ ID NO: 22517 - DNA, 30 bp, Homo sapiens; identical to SEQ ID NO: 12726
  chr17:42906618-42906648
  hyper

SEQ ID NO: 22518 - DNA, 123 bp, Homo sapiens; identical to SEQ ID NO: 12727
  chr17:42907014-42907137
  hyper

SEQ ID NO: 22519 - DNA, 200 bp, Homo sapiens
  chr17:42907951-42908151
  hyper
agccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 22520 - DNA, 80 bp, Homo sapiens; identical to SEQ ID NO: 12729
  chr17:42988684-42988764
  hyper

SEQ ID NO: 22521 - DNA, 150 bp, Homo sapiens
  chr17:43045116-43045266
  hyper
acccttctcccccggcggccccacagggccgggaggacctgggtccccgggaggccccggagggccgggcttgccggtgcggcccggcttcccctgggggccctgcaccagcgtggaaggcgggggcgcgccgctctgctcgctcagggc

SEQ ID NO: 22522 - DNA, 133 bp, Homo sapiens; identical to SEQ ID NO: 12731
  chr17:43045371-43045504
  hyper

SEQ ID NO: 22523 - DNA, 96 bp, Homo sapiens; identical to SEQ ID NO: 1294
  chr17:43047752-43047848
  hyper

SEQ ID NO: 22524 - DNA, 25 bp, Homo sapiens
  chr17:43974231-43974256
  hyper
gtgatgaacctggtacgcacggttt

SEQ ID NO: 22525 - DNA, 56 bp, Homo sapiens; identical to SEQ ID NO: 12736
  chr17:44919159-44919215
  hyper

SEQ ID NO: 22526 - DNA, 35 bp, Homo sapiens; identical to SEQ ID NO: 12737
  chr17:44928630-44928665
  hyper

SEQ ID NO: 22527 - DNA, 30 bp, Homo sapiens; identical to SEQ ID NO: 12738
  chr17:44929262-44929292
  hyper

SEQ ID NO: 22528 - DNA, 100 bp, Homo sapiens; identical to SEQ ID NO: 12739
  chr17:44929573-44929673
  hyper

SEQ ID NO: 22529 - DNA, 34 bp, Homo sapiens; identical to SEQ ID NO: 12740
  chr17:45055871-45055905
  hyper

SEQ ID NO: 22530 - DNA, 49 bp, Homo sapiens; identical to SEQ ID NO: 12741
  chr17:45056144-45056193
  hyper

SEQ ID NO: 22531 - DNA, 78 bp, Homo sapiens
  chr17:45810772-45810850
  hyper
ggaggggcgggtcctcgacggctacgggaaggtgccagcccgccccggatgggcatcgtggagccgggttgcggagac

SEQ ID NO: 22532 - DNA, 114 bp, Homo sapiens; identical to SEQ ID NO: 12743
  chr17:45867029-45867143
  hyper

SEQ ID NO: 22533 - DNA, 24 bp, Homo sapiens
  chr17:45867460-45867484
  hyper
ctcaaagaccgccagctctggggg

SEQ ID NO: 22534 - DNA, 259 bp, Homo sapiens
  chr17:46621094-46621353
  hyper
gcagtcccaggccatctgcagggaaaacaggctcggcgtcatagcgggccgtgtactcagcccaacctcagttcggactaccccatcctccaaaaccagtatcacctctccccttcctcgccaccccacccccgcccccaccccaaagccgctcgctttactgcttttgggttttcttctctccctctctagtctacagccccggcccgggtcagggcaaagcattcagagccgcccacgggccacgcagggggcggag

SEQ ID NO: 22535 - DNA, 102 bp, Homo sapiens
  chr17:46621909-46622011
  hyper
gaacggcggaggcggccggagaaggagacgtggcggattggctgggtttcttggcggatttcttctctttcatccaagggaactcgggggccgggggggcag

SEQ ID NO: 22536 - DNA, 78 bp, Homo sapiens
  chr17:46655070-46655148
  hyper
ctgaaaacaggcgaccgtaaatctccggcaatggcgagtttatagcggggacaattggcttccccagctcaacccccc

SEQ ID NO: 22537 - DNA, 216 bp, Homo sapiens
  chr17:46655178-46655394
  hyper
gtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggc

SEQ ID NO: 22538 - DNA, 24 bp, Homo sapiens
  chr17:46655395-46655419
  hyper
gcgcaggagcccgaggggacagac

SEQ ID NO: 22539 - DNA, 50 bp, Homo sapiens
  chr17:46659859-46659909
  hyper
ctttggcagtctttgttaaacagctaggcgcgtcacgaggctctcaaaca

SEQ ID NO: 22540 - DNA, 75 bp, Homo sapiens; identical to SEQ ID NO: 12753
  chr17:46663552-46663627
  hyper

SEQ ID NO: 22541 - DNA, 198 bp, Homo sapiens; identical to SEQ ID NO: 12754
  chr17:46670978-46671176
  hyper

SEQ ID NO: 22542 - DNA, 45 bp, Homo sapiens; identical to SEQ ID NO: 12755
  chr17:46671384-46671429
  hyper

SEQ ID NO: 22543 - DNA, 297 bp, Homo sapiens; identical to SEQ ID NO: 12758
  chr17:46687941-46688238
  hyper

SEQ ID NO: 22544 - DNA, 40 bp, Homo sapiens; identical to SEQ ID NO: 12759
  chr17:46688577-46688617
  hyper

SEQ ID NO: 22545 - DNA, 225 bp, Homo sapiens; identical to SEQ ID NO: 12760
  chr17:46689986-46690211
  hyper

SEQ ID NO: 22546 - DNA, 41 bp, Homo sapiens
  chr17:46690664-46690705
  hyper
ggaacttgtctttgttgttctcttttttccacttcatcctc

SEQ ID NO: 22547 - DNA, 28 bp, Homo sapiens
  chr17:46690852-46690880
  hyper
cgcctgcgtccggcggctgctgggaatg

SEQ ID NO: 22548 - DNA, 255 bp, Homo sapiens
  chr17:46692110-46692365
  hyper
ggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccacc

SEQ ID NO: 22549 - DNA, 58 bp, Homo sapiens
  chr17:46714072-46714130
  hyper
gttcctgcaggcgctcggggctcggcctggagctggcggccggcacgtcgcctttggc

SEQ ID NO: 22550 - DNA, 154 bp, Homo sapiens; identical to SEQ ID NO: 12768
  chr17:46714131-46714285
  hyper

SEQ ID NO: 22551 - DNA, 205 bp, Homo sapiens
  chr17:46795436-46795641
  hyper
ctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagca

SEQ ID NO: 22552 - DNA, 147 bp, Homo sapiens
  chr17:46797582-46797729
  hyper
tgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 22553 - DNA, 32 bp, Homo sapiens; identical to SEQ ID NO: 12775
  chr17:46799421-46799453
  hyper

SEQ ID NO: 22554 - DNA, 83 bp, Homo sapiens
  chr17:46800518-46800601
  hyper
tttgggctagaggcccggggccgctcccgagctttctcccctcttccctggagagcgactgttcgggagggtgagaatggtat

SEQ ID NO: 22555 - DNA, 47 bp, Homo sapiens
  chr17:46800668-46800715
  hyper
gtttacggtaacgagttcatctatttaattcgcggttgcagctcggg

SEQ ID NO: 22556 - DNA, 153 bp, Homo sapiens
  chr17:46802306-46802459
  hyper
tccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcag

SEQ ID NO: 22557 - DNA, 315 bp, Homo sapiens; identical to SEQ ID NO: 12783
  chr17:46805609-46805924
  hyper

SEQ ID NO: 22558 - DNA, 48 bp, Homo sapiens
  chr17:46810368-46810416
  hyper
tcctggcagaccctccgggagcccggagcctcccccagctttctttac

SEQ ID NO: 22559 - DNA, 138 bp, Homo sapiens
  chr17:46810958-46811096
  hyper
ggcctaattgaggtgtgctcttttctttccttcctcttttcatcttttccttccgtctgcattttctctcctctgtcttaggcttggtatcttcttttctttttatatttgtgtttttctcaccgcctttgcttcctt

SEQ ID NO: 22560 - DNA, 53 bp, Homo sapiens; identical to SEQ ID NO: 12786
  chr17:46815930-46815983
  hyper

SEQ ID NO: 22561 - DNA, 230 bp, Homo sapiens
  chr17:46825054-46825284
  hyper
ggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcc

SEQ ID NO: 22562 - DNA, 26 bp, Homo sapiens
  chr17:46830110-46830136
  hyper
cccagggccccctccgggttctccca

SEQ ID NO: 22563 - DNA, 100 bp, Homo sapiens
  chr17:47072705-47072805
  hyper
ctgggtagaacaaaacgctcattggggagggtgggctctaaggtggtggaggatatagagaaaccgagttggaagccctcccccgcccctaagtcccagc

SEQ ID NO: 22564 - DNA, 71 bp, Homo sapiens
  chr17:47073465-47073536
  hyper
cgggtccttccctcgggctccgggagccggaggatccggaatgagttggtcaaagccgagggaagggaccc

SEQ ID NO: 22565 - DNA, 181 bp, Homo sapiens
  chr17:47074228-47074409
  hyper
gaccccccccatttaaacatctagggaaaaggttcctttctttttaaatcaccagctcgtgcgaccctctcctgaagaccccagagtcttcggcttctctttgtctgtctcggccgtcccccgcctgtcagtcgctagcagttaaccggggaggggtgagcaaccccgccccccaaaacga

SEQ ID NO: 22566 - DNA, 54 bp, Homo sapiens
  chr17:47074895-47074949
  hyper
tctcctgggctctccccgaactctcccgcgacctctgcgcgccctcaggccgcc

SEQ ID NO: 22567 - DNA, 38 bp, Homo sapiens
  chr17:47075364-47075402
  hyper
caactcctctcttcccgggcctgcggggtttggcctcc

SEQ ID NO: 22568 - DNA, 15 bp, Homo sapiens
  chr17:47075700-47075715
  hyper
ttaggcctttccagg

SEQ ID NO: 22569 - DNA, 68 bp, Homo sapiens; identical to SEQ ID NO: 12804
  chr17:47081200-47081268
  hyper

SEQ ID NO: 22570 - DNA, 184 bp, Homo sapiens; identical to SEQ ID NO: 12805
  chr17:47210040-47210224
  hyper

SEQ ID NO: 22571 - DNA, 292 bp, Homo sapiens; identical to SEQ ID NO: 12806
  chr17:47573694-47573986
  hyper

SEQ ID NO: 22572 - DNA, 985 bp, Homo sapiens; identical to SEQ ID NO: 12807
  chr17:47574269-47575254
  hyper

SEQ ID NO: 22573 - DNA, 116 bp, Homo sapiens; identical to SEQ ID NO: 12808
  chr17:47928213-47928329
  hyper

SEQ ID NO: 22574 - DNA, 311 bp, Homo sapiens
  chr17:47987619-47987930
  hyper
aggaggcagggccaggctgggcgctgaggaggccgccccggtggcgctcccacgacccgggcaaggcagtctgggcgccgtctccggtctcggggcctgcggtcggggcaccgcggtgccgcgtttgagccggtcagctccctgcggaaattacaggggcgctcggcgctgcggtcgcgccccccggggcagcgcccgctggttggaggcgtttaaattgaaagcagctttggggagagggggcggacgcgggccgccgagcaaggggagggggcggcccggcacagcgaccccattgtctgtgcccgccg

SEQ ID NO: 22575 - DNA, 72 bp, Homo sapiens
  chr17:48042069-48042141
  hyper
tgaggtgagcgcaaatggaagcacaaggccgggctggccgtgggctcagtaaccagtcggctgcccggcttg

SEQ ID NO: 22576 - DNA, 26 bp, Homo sapiens
  chr17:48042409-48042435
  hyper
aactgaaaatcactgcgaatgacaat

SEQ ID NO: 22577 - DNA, 188 bp, Homo sapiens
  chr17:48049059-48049247
  hyper
ctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgacc

SEQ ID NO: 22578 - DNA, 222 bp, Homo sapiens; identical to SEQ ID NO: 12817
  chr17:48070683-48070905
  hyper

SEQ ID NO: 22579 - DNA, 34 bp, Homo sapiens; identical to SEQ ID NO: 12819
  chr17:48619216-48619250
  hyper

SEQ ID NO: 22580 - DNA, 99 bp, Homo sapiens
  chr17:48637136-48637235
  hyper
ttccttcttaggggtcctcgctctgctccgcagcccctcctggggatccgggctctgcggtccagcgcgacctgcctggggccacgtgttcaagcacga

SEQ ID NO: 22581 - DNA, 97 bp, Homo sapiens
  chr17:50235952-50236049
  hyper
gactctccaggtcgcgcgcgcccttcctgctcctctgctattttcctgaactccccagaacccccagttgcctggcttccatcgcccgcaactagcg

SEQ ID NO: 22582 - DNA, 25 bp, Homo sapiens
  chr17:53341227-53341252
  hyper
cgtcccactgaaaaacggttttctt

SEQ ID NO: 22583 - DNA, 37 bp, Homo sapiens; identical to SEQ ID NO: 12824
  chr17:53343353-53343390
  hyper

SEQ ID NO: 22584 - DNA, 204 bp, Homo sapiens
  chr17:53922790-53922994
  hyper
cccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcgg

SEQ ID NO: 22585 - DNA, 30 bp, Homo sapiens; identical to SEQ ID NO: 12826
  chr17:54674012-54674042
  hyper

SEQ ID NO: 22586 - DNA, 6 bp, Homo sapiens
  chr17:56234399-56234405
  hyper
atgaga

SEQ ID NO: 22587 - DNA, 20 bp, Homo sapiens
  chr17:56326929-56326949
  hyper
gaagcctgcgctgggcgccg

SEQ ID NO: 22588 - DNA, 181 bp, Homo sapiens
  chr17:56832946-56833127
  hyper
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaa

SEQ ID NO: 22589 - DNA, 188 bp, Homo sapiens
  chr17:56833221-56833409
  hyper
ggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagcta

SEQ ID NO: 22590 - DNA, 425 bp, Homo sapiens; identical to SEQ ID NO: 12832
  chr17:58212827-58213252
  hyper

SEQ ID NO: 22591 - DNA, 23 bp, Homo sapiens
  chr17:58216590-58216613
  hyper
gcagaaccctggattcgagtccc

SEQ ID NO: 22592 - DNA, 54 bp, Homo sapiens
  chr17:58217551-58217605
  hyper
tgttcagtcccaggcagtgcgggacaggtgggcgaagctcgaaccccatgctct

SEQ ID NO: 22593 - DNA, 91 bp, Homo sapiens
  chr17:58218674-58218765
  hyper
cgcgctcgggctggacgtcgcgctcagcgcgcagggcccccatggacgtcgcgccgctgacctagctgtcagacatcgccacgaggagttg

SEQ ID NO: 22594 - DNA, 64 bp, Homo sapiens
  chr17:58218993-58219057
  hyper
actggccctgctctggggaacagcgccctgcttctttgtgcgacgatcacgcttgactcattgg

SEQ ID NO: 22595 - DNA, 270 bp, Homo sapiens
  chr17:58227104-58227374
  hyper
gctgagtggagaggacgcggagtgggtgagggggccttgcgcacagggcaagaggtggccaggcagggcgggggaccggggagagcggaggatttcagatgagggacaggggaaggtggagaggggagggcaggccccgccagggggaggagccgcctcccgcgtccagctgtcggggctccctcccgtcgcggctccgctataaaacccaggccggcaggatcgctgcacccgcggcggcctcctcggtgcgcgacccccggctcagag

SEQ ID NO: 22596 - DNA, 19 bp, Homo sapiens
  chr17:58499314-58499333
  hyper
agcccgtaggcactggcgg

SEQ ID NO: 22597 - DNA, 30 bp, Homo sapiens; identical to SEQ ID NO: 12840
  chr17:59467481-59467511
  hyper

SEQ ID NO: 22598 - DNA, 92 bp, Homo sapiens
  chr17:59474741-59474833
  hyper
cgccaggggagggggttcctgggaagggggagggggccggcctaggtgggggaggggcccagcggaggcctcacggcgccgctccagggcct

SEQ ID NO: 22599 - DNA, 44 bp, Homo sapiens
  chr17:59475100-59475144
  hyper
ggcctgagtgtttcaaactcttcaggcctcggacccctggacca

SEQ ID NO: 22600 - DNA, 156 bp, Homo sapiens
  chr17:59476254-59476410
  hyper
gcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccg

SEQ ID NO: 22601 - DNA, 30 bp, Homo sapiens
  chr17:59476635-59476665
  hyper
gccgcccgagcctcccgactcgcccgccca

SEQ ID NO: 22602 - DNA, 30 bp, Homo sapiens; identical to SEQ ID NO: 12845
  chr17:59476876-59476906
  hyper

SEQ ID NO: 22603 - DNA, 32 bp, Homo sapiens; identical to SEQ ID NO: 12846
  chr17:59477323-59477355
  hyper

SEQ ID NO: 22604 - DNA, 14 bp, Homo sapiens
  chr17:59478133-59478147
  hyper
aacgctaaaatcct

SEQ ID NO: 22605 - DNA, 195 bp, Homo sapiens
  chr17:59534556-59534751
  hyper
cgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaa

SEQ ID NO: 22606 - DNA, 48 bp, Homo sapiens
  chr17:59535219-59535267
  hyper
cgctatgcaaatgaatccaaacagggatcgcgacgctcaaaagtccca

SEQ ID NO: 22607 - DNA, 21 bp, Homo sapiens
  chr17:59539215-59539236
  hyper
gtccccagggacctccgagaa

SEQ ID NO: 22608 - DNA, 76 bp, Homo sapiens
  chr17:59539601-59539677
  hyper
cctgtttcatgatcagaggagaagccccgggctttcatctcctcccgggccggcgagcaggcggcttgtttattcc

SEQ ID NO: 22609 - DNA, 153 bp, Homo sapiens; identical to SEQ ID NO: 12859
  chr17:60705777-60705930
  hyper

SEQ ID NO: 22610 - DNA, 21 bp, Homo sapiens
  chr17:61778053-61778074
  hyper
cccgccgccaggggccgcccc

SEQ ID NO: 22611 - DNA, 129 bp, Homo sapiens; identical to SEQ ID NO: 12864
  chr17:62777021-62777150
  hyper

SEQ ID NO: 22612 - DNA, 45 bp, Homo sapiens; identical to SEQ ID NO: 12865
  chr17:64961987-64962032
  hyper

SEQ ID NO: 22613 - DNA, 169 bp, Homo sapiens
  chr17:66596302-66596471
  hyper
gctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctc

SEQ ID NO: 22614 - DNA, 165 bp, Homo sapiens; identical to SEQ ID NO: 12867
  chr17:66596728-66596893
  hyper

SEQ ID NO: 22615 - DNA, 30 bp, Homo sapiens; identical to SEQ ID NO: 12868
  chr17:66597456-66597486
  hyper

SEQ ID NO: 22616 - DNA, 74 bp, Homo sapiens
  chr17:70112842-70112916
  hyper
tgagttgagggaagccgcatgacgcgcggctccccggtgccacagctaaggacagatattttcgcaaaacccag

SEQ ID NO: 22617 - DNA, 16 bp, Homo sapiens
  chr17:70215667-70215683
  hyper
ccagggcagcagacac

SEQ ID NO: 22618 - DNA, 136 bp, Homo sapiens; identical to SEQ ID NO: 12875
  chr17:71161797-71161933
  hyper

SEQ ID NO: 22619 - DNA, 41 bp, Homo sapiens; identical to SEQ ID NO: 12876
  chr17:71641056-71641097
  hyper

SEQ ID NO: 22620 - DNA, 47 bp, Homo sapiens
  chr17:71641497-71641544
  hyper
agccaggcccgggagcgagccccgcagaaatacaatccgactgcgcg

SEQ ID NO: 22621 - DNA, 57 bp, Homo sapiens; identical to SEQ ID NO: 12878
  chr17:71897984-71898041
  hyper

SEQ ID NO: 22622 - DNA, 49 bp, Homo sapiens
  chr17:71948390-71948439
  hyper
actccattcatctcccggttcctcgcattcatcccccaccgaacccacc

SEQ ID NO: 22623 - DNA, 52 bp, Homo sapiens
  chr17:71948863-71948915
  hyper
ggcgctccccgcccgccaacctccaacctccaacctccgccctccaccctcc

SEQ ID NO: 22624 - DNA, 62 bp, Homo sapiens; identical to SEQ ID NO: 12880
  chr17:71949206-71949268
  hyper

SEQ ID NO: 22625 - DNA, 30 bp, Homo sapiens; identical to SEQ ID NO: 12881
  chr17:72208638-72208668
  hyper

SEQ ID NO: 22626 - DNA, 32 bp, Homo sapiens
  chr17:72270415-72270447
  hyper
agcaccggagccgcgaccgtggattgaacgct

SEQ ID NO: 22627 - DNA, 15 bp, Homo sapiens
  chr17:72322348-72322363
  hyper
gcgcgttgttggttt

SEQ ID NO: 22628 - DNA, 15 bp, Homo sapiens
  chr17:72322611-72322626
  hyper
cgccaccccactgag

SEQ ID NO: 22629 - DNA, 97 bp, Homo sapiens
  chr17:72856941-72857038
  hyper
tggaaggggaagaagcgggactcgcggcgggggaaggggtctgggcgccgaggcgagtgcgcagcaggtgcccagcagacctagggaaactggggca

SEQ ID NO: 22630 - DNA, 127 bp, Homo sapiens; identical to SEQ ID NO: 12886
  chr17:72889569-72889696
  hyper

SEQ ID NO: 22631 - DNA, 19 bp, Homo sapiens
  chr17:72921032-72921051
  hyper
gctccgaggtgccagggga

SEQ ID NO: 22632 - DNA, 59 bp, Homo sapiens; identical to SEQ ID NO: 12888
  chr17:72932027-72932086
  hyper

SEQ ID NO: 22633 - DNA, 173 bp, Homo sapiens; identical to SEQ ID NO: 12889
  chr17:72932356-72932529
  hyper

SEQ ID NO: 22634 - DNA, 87 bp, Homo sapiens; identical to SEQ ID NO: 12890
  chr17:73073597-73073684
  hyper

SEQ ID NO: 22635 - DNA, 66 bp, Homo sapiens; identical to SEQ ID NO: 12892
  chr17:74072483-74072549
  hyper

SEQ ID NO: 22636 - DNA, 23 bp, Homo sapiens
  chr17:74073246-74073269
  hyper
gcaaaggcttccgcacgatctgc

SEQ ID NO: 22637 - DNA, 63 bp, Homo sapiens; identical to SEQ ID NO: 12895
  chr17:74136379-74136442
  hyper

SEQ ID NO: 22638 - DNA, 130 bp, Homo sapiens; identical to SEQ ID NO: 12896
  chr17:74136570-74136700
  hyper

SEQ ID NO: 22639 - DNA, 53 bp, Homo sapiens
  chr17:74534310-74534363
  hyper
gctcccctcgcccgggcctctccccgcgcccccgagccagccgctgggggccg

SEQ ID NO: 22640 - DNA, 15 bp, Homo sapiens
  chr17:74534387-74534402
  hyper
cgcccaggctctggg

SEQ ID NO: 22641 - DNA, 80 bp, Homo sapiens
  chr17:74581221-74581301
  hyper
tatccagacacggcgagcggaagccggggagaagggagcgggcgcggggcggacagagaccgcagcgggcgggaaaggcg

SEQ ID NO: 22642 - DNA, 293 bp, Homo sapiens; identical to SEQ ID NO: 12900
  chr17:74864739-74865032
  hyper

SEQ ID NO: 22643 - DNA, 107 bp, Homo sapiens
  chr17:74865591-74865698
  hyper
ccctcccgtcccgcccgtctgcccctaggtcggctaccccccaacccctccgcctgtgccaccctctccccagcctttggtggcactgctctcctccccgcggggct

SEQ ID NO: 22644 - DNA, 76 bp, Homo sapiens
  chr17:76227773-76227849
  hyper
agggaaattaaggaacgtgcccagggacccggggccagcccgtggggacgctgggattggagcccaagccccaggt

SEQ ID NO: 22645 - DNA, 18 bp, Homo sapiens
  chr17:76254836-76254854
  hyper
cgccggggaggctgctgc

SEQ ID NO: 22646 - DNA, 102 bp, Homo sapiens; identical to SEQ ID NO: 4505
  chr17:77178962-77179064
  hyper

SEQ ID NO: 22647 - DNA, 32 bp, Homo sapiens
  chr17:77179081-77179113
  hyper
cgcgccttcggaaaagttgcgagcgacgcccc

SEQ ID NO: 22648 - DNA, 52 bp, Homo sapiens
  chr17:77179278-77179330
  hyper
cgtgggcggcagcgcggggcgcacgtgcgccgggccgggggccggggccggg

SEQ ID NO: 22649 - DNA, 75 bp, Homo sapiens; identical to SEQ ID NO: 4507
  chr17:77179380-77179455
  hyper

SEQ ID NO: 22650 - DNA, 27 bp, Homo sapiens
  chr17:77179456-77179483
  hyper
gcaggggggcgcccggcggcggctctg

SEQ ID NO: 22651 - DNA, 13 bp, Homo sapiens
  chr17:77179617-77179630
  hyper
cgcgcctctgccc

SEQ ID NO: 22652 - DNA, 265 bp, Homo sapiens; identical to SEQ ID NO: 12919
  chr17:77179951-77180216
  hyper

SEQ ID NO: 22653 - DNA, 36 bp, Homo sapiens; identical to SEQ ID NO: 12920
  chr17:77772754-77772790
  hyper

SEQ ID NO: 22654 - DNA, 148 bp, Homo sapiens
  chr17:77776679-77776827
  hyper
gccgcgggccggccccatttccgccccccccccacgcgcccccccatcacacgcacacccaatccccggactgctcgctggtgctgcttgtgagacccattcctaggagccccaggcgcccttggggagcagaaagaggcggtccaga

SEQ ID NO: 22655 - DNA, 42 bp, Homo sapiens; identical to SEQ ID NO: 12922
  chr17:77777233-77777275
  hyper

SEQ ID NO: 22656 - DNA, 804 bp, Homo sapiens; identical to SEQ ID NO: 12927
  chr17:78450039-78450843
  hyper

SEQ ID NO: 22657 - DNA, 95 bp, Homo sapiens; identical to SEQ ID NO: 12928
  chr17:78451477-78451572
  hyper

SEQ ID NO: 22658 - DNA, 59 bp, Homo sapiens; identical to SEQ ID NO: 12929
  chr17:78451801-78451860
  hyper

SEQ ID NO: 22659 - DNA, 188 bp, Homo sapiens
  chr17:78452108-78452296
  hyper
cggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggcccca

SEQ ID NO: 22660 - DNA, 92 bp, Homo sapiens
  chr17:78452833-78452925
  hyper
ctcggcctccccagtgttctgaaagtatctgagagggagggagcaggaaaacgaagggccgccctgcccaaactcatcggggtgtctggtta

SEQ ID NO: 22661 - DNA, 39 bp, Homo sapiens; identical to SEQ ID NO: 12932
  chr17:79316974-79317013
  hyper

SEQ ID NO: 22662 - DNA, 121 bp, Homo sapiens; identical to SEQ ID NO: 12933
  chr17:79761692-79761813
  hyper

SEQ ID NO: 22663 - DNA, 329 bp, Homo sapiens; identical to SEQ ID NO: 12934
  chr17:79761833-79762162
  hyper

SEQ ID NO: 22664 - DNA, 75 bp, Homo sapiens; identical to SEQ ID NO: 12935
  chr17:79860521-79860596
  hyper

SEQ ID NO: 22665 - DNA, 30 bp, Homo sapiens; identical to SEQ ID NO: 12936
  chr17:80329291-80329321
  hyper

SEQ ID NO: 22666 - DNA, 78 bp, Homo sapiens; identical to SEQ ID NO: 12938
  chr17:80333151-80333229
  hyper

SEQ ID NO: 22667 - DNA, 525 bp, Homo sapiens
  chr18:500738-501263
  hyper
agcgcccctccccctggcccgacccggccgagcgagcggccgcgcccacgcccctctcgcgccctcccgcgcccgccccgccctcggcccgcgcctgccctcgccgggcactttctcgcccgccctctcctgcgcgccctggccccactcgcgcgggctctctctttttcccgttgcaccagcgtcgggatgaagtcgggagcaaagcccttcccggggcggtccagcgttcaccttcggcgagcacctaaggtgccgctgctgctggggtcgcttctacaccccaaactacctagcaagtgttgggcgagaggatggggagctgctgtgccccgggggtggcggggggtaaggtgggcccttccccaaacggctctggggcatggagaggtacagaacgtcctccgggttcagagtttccaagtgcgtgcgctggttgacgcctgaaggagaccaagcagcagggaacactctctctgtcacccagggagagcccgagtggccagaatccgaagtcaccattag

SEQ ID NO: 22668 - DNA, 30 bp, Homo sapiens; identical to SEQ ID NO: 12941
  chr18:903814-903844
  hyper

SEQ ID NO: 22669 - DNA, 28 bp, Homo sapiens
  chr18:904648-904676
  hyper
cgggctagccgcccgccctctcccttgc

SEQ ID NO: 22670 - DNA, 55 bp, Homo sapiens; identical to SEQ ID NO: 12943
  chr18:905713-905768
  hyper

SEQ ID NO: 22671 - DNA, 232 bp, Homo sapiens; identical to SEQ ID NO: 12944
  chr18:906208-906440
  hyper

SEQ ID NO: 22672 - DNA, 135 bp, Homo sapiens
  chr18:906736-906871
  hyper
tccaggggtccaaagcgagagggatttgttttaacccatctctacccgtcctgtgtcaagaacggaggctgtagagggcgactgcgaagtcgccaggcactcgctggatctcggtccccctcctcgtgctctggg

SEQ ID NO: 22673 - DNA, 158 bp, Homo sapiens
  chr18:907314-907472
  hyper
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggta

SEQ ID NO: 22674 - DNA, 25 bp, Homo sapiens
  chr18:907594-907619
  hyper
ggatcctcgccgagctggggaggaa

SEQ ID NO: 22675 - DNA, 22 bp, Homo sapiens
  chr18:908432-908454
  hyper
gcggcggtgggtgcccgtgggg

SEQ ID NO: 22676 - DNA, 106 bp, Homo sapiens; identical to SEQ ID NO: 12949
  chr18:909183-909289
  hyper

SEQ ID NO: 22677 - DNA, 169 bp, Homo sapiens
  chr18:909318-909487
  hyper
cggtgggcagtgcgagccccgggccctccccgaaggctcccgcgtggggtggggcccgcctgctccccgcggcgattgaacctgtgtctcccgccccgccaccctcttcccgacccctttgcttgcagtgggagcctcggcggcggcgcgggggacgacgcggagccgc

SEQ ID NO: 22678 - DNA, 145 bp, Homo sapiens
  chr18:909587-909732
  hyper
gtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatcca

SEQ ID NO: 22679 - DNA, 30 bp, Homo sapiens; identical to SEQ ID NO: 12951
  chr18:961954-961984
  hyper

SEQ ID NO: 22680 - DNA, 134 bp, Homo sapiens; identical to SEQ ID NO: 12952
  chr18:2847537-2847671
  hyper

SEQ ID NO: 22681 - DNA, 60 bp, Homo sapiens; identical to SEQ ID NO: 12953
  chr18:2848078-2848138
  hyper

SEQ ID NO: 22682 - DNA, 15 bp, Homo sapiens
  chr18:5196244-5196259
  hyper
gtcggacgttcacaa

SEQ ID NO: 22683 - DNA, 412 bp, Homo sapiens
  chr18:5197347-5197759
  hyper
agggagcaaagcacttccaccgctttcacgcgacgaaggtcggaagagcaagagagagaaaggtaaacttcccggcaggggacagtgaattgcttttaattacctgctgtggctcgtcgccgtggatattggactgacatttaagatagatttgtcaaaaaaaaaaaactctaagagctttctttactctcgaggatgactctgagttctccgagttgggctggctcgaatagaggggcgggtctgtcaagttaataggtcctggaggtccgtgagtcctctctcgcgagtcccagtcctctgctaacgtcaggaagagagcaagaggaaggacacagtgactatggagcgctcgaggagggcgctactatcaggttccgctcccaggtggcaaatccggctctgaaagctc

SEQ ID NO: 22684 - DNA, 173 bp, Homo sapiens; identical to SEQ ID NO: 12960
  chr18:5542985-5543158
  hyper

SEQ ID NO: 22685 - DNA, 30 bp, Homo sapiens; identical to SEQ ID NO: 12961
  chr18:5544135-5544165
  hyper

SEQ ID NO: 22686 - DNA, 33 bp, Homo sapiens
  chr18:5628134-5628167
  hyper
gaggggcaagtcttgcggggcccgtcggtaact

SEQ ID NO: 22687 - DNA, 522 bp, Homo sapiens; identical to SEQ ID NO: 12963
  chr18:5628849-5629371
  hyper

SEQ ID NO: 22688 - DNA, 40 bp, Homo sapiens; identical to SEQ ID NO: 12964
  chr18:5629372-5629412
  hyper

SEQ ID NO: 22689 - DNA, 50 bp, Homo sapiens
  chr18:5630262-5630312
  hyper
ctcccccatcgacctcgagccaagggcaggcggcccgcacccgcgcccct

SEQ ID NO: 22690 - DNA, 271 bp, Homo sapiens
  chr18:5630362-5630633
  hyper
gaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagtt

SEQ ID NO: 22691 - DNA, 6 bp, Homo sapiens
  chr18:5895017-5895023
  hyper
cgctca

SEQ ID NO: 22692 - DNA, 298 bp, Homo sapiens
  chr18:5895205-5895503
  hyper
gtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacaca

SEQ ID NO: 22693 - DNA, 41 bp, Homo sapiens; identical to SEQ ID NO: 12969
  chr18:6730009-6730050
  hyper

SEQ ID NO: 22694 - DNA, 115 bp, Homo sapiens; identical to SEQ ID NO: 12970
  chr18:7117059-7117174
  hyper

SEQ ID NO: 22695 - DNA, 7 bp, Homo sapiens
  chr18:7117615-7117622
  hyper
cgcctgc

SEQ ID NO: 22696 - DNA, 149 bp, Homo sapiens; identical to SEQ ID NO: 12972
  chr18:7117942-7118091
  hyper

SEQ ID NO: 22697 - DNA, 46 bp, Homo sapiens; identical to SEQ ID NO: 12973
  chr18:7118131-7118177
  hyper

SEQ ID NO: 22698 - DNA, 46 bp, Homo sapiens; identical to SEQ ID NO: 12974
  chr18:7566590-7566636
  hyper

SEQ ID NO: 22699 - DNA, 29 bp, Homo sapiens
  chr18:7567754-7567783
  hyper
ccctccgccctcgcgcgcccacccaccgc

SEQ ID NO: 22700 - DNA, 110 bp, Homo sapiens; identical to SEQ ID NO: 12976
  chr18:7568429-7568539
  hyper

SEQ ID NO: 22701 - DNA, 75 bp, Homo sapiens; identical to SEQ ID NO: 12977
  chr18:7568540-7568615
  hyper

SEQ ID NO: 22702 - DNA, 14 bp, Homo sapiens
  chr18:8608968-8608982
  hyper
gaaaacatgtgcat

SEQ ID NO: 22703 - DNA, 255 bp, Homo sapiens; identical to SEQ ID NO: 12979
  chr18:9709069-9709324
  hyper

SEQ ID NO: 22704 - DNA, 16 bp, Homo sapiens
  chr18:9771753-9771769
  hyper
tcgatggtggtgttct

SEQ ID NO: 22705 - DNA, 114 bp, Homo sapiens; identical to SEQ ID NO: 12981
  chr18:10455030-10455144
  hyper

SEQ ID NO: 22706 - DNA, 209 bp, Homo sapiens
  chr18:11148760-11148969
  hyper
ctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaa

SEQ ID NO: 22707 - DNA, 49 bp, Homo sapiens
  chr18:11149045-11149094
  hyper
ttggaagcccctctgaagccaccgcgtctcctttgcccggcctcgtctc

SEQ ID NO: 22708 - DNA, 128 bp, Homo sapiens; identical to SEQ ID NO: 12983
  chr18:11149115-11149243
  hyper

SEQ ID NO: 22709 - DNA, 63 bp, Homo sapiens; identical to SEQ ID NO: 12986
  chr18:11751569-11751632
  hyper

SEQ ID NO: 22710 - DNA, 6 bp, Homo sapiens
  chr18:11752599-11752605
  hyper
ggctcc

SEQ ID NO: 22711 - DNA, 60 bp, Homo sapiens
  chr18:11752640-11752700
  hyper
cgccaggctgggcgggcagggccgggcgagggtcgcgcgcacctctgggccgcggagccc

SEQ ID NO: 22712 - DNA, 123 bp, Homo sapiens; identical to SEQ ID NO: 12990
  chr18:11947268-11947391
  hyper

SEQ ID NO: 22713 - DNA, 35 bp, Homo sapiens; identical to SEQ ID NO: 12991
  chr18:12253812-12253847
  hyper

SEQ ID NO: 22714 - DNA, 43 bp, Homo sapiens; identical to SEQ ID NO: 12992
  chr18:12254104-12254147
  hyper

SEQ ID NO: 22715 - DNA, 2 bp, Homo sapiens
  chr18:12254578-12254580
  hyper
cc

SEQ ID NO: 22716 - DNA, 175 bp, Homo sapiens
  chr18:12307751-12307926
  hyper
gaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcgg

SEQ ID NO: 22717 - DNA, 143 bp, Homo sapiens
  chr18:13868570-13868713
  hyper
gtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggc

SEQ ID NO: 22718 - DNA, 76 bp, Homo sapiens; identical to SEQ ID NO: 12996
  chr18:13869161-13869237
  hyper

SEQ ID NO: 22719 - DNA, 25 bp, Homo sapiens
  chr18:15198059-15198084
  hyper
tagggggcgaaaagacgcaaaaagc

SEQ ID NO: 22720 - DNA, 57 bp, Homo sapiens; identical to SEQ ID NO: 12999
  chr18:18821835-18821892
  hyper

SEQ ID NO: 22721 - DNA, 285 bp, Homo sapiens
  chr18:18822107-18822392
  hyper
agcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggagg

SEQ ID NO: 22722 - DNA, 83 bp, Homo sapiens
  chr18:18823274-18823357
  hyper
gccgctgcctctaaccgaggctgcgggtcctggagaaactcctcagtcttgcccctttctccggtgaacgtgacggttccaag

SEQ ID NO: 22723 - DNA, 51 bp, Homo sapiens; identical to SEQ ID NO: 13003
  chr18:22928965-22929016
  hyper

SEQ ID NO: 22724 - DNA, 231 bp, Homo sapiens
  chr18:22930559-22930790
  hyper
tcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcg

SEQ ID NO: 22725 - DNA, 49 bp, Homo sapiens
  chr18:24128030-24128079
  hyper
gggtccagctcggagccgtccccgggcggcccaccgcgggcccggggcg

SEQ ID NO: 22726 - DNA, 30 bp, Homo sapiens; identical to SEQ ID NO: 13010
  chr18:24764644-24764674
  hyper

SEQ ID NO: 22727 - DNA, 53 bp, Homo sapiens; identical to SEQ ID NO: 13011
  chr18:25755399-25755452
  hyper

SEQ ID NO: 22728 - DNA, 257 bp, Homo sapiens
  chr18:25756729-25756986
  hyper
ccccggcaaccctgccccggcgcccggacggagcccgatgcctgcgcagctaccggccgcgcggcgcggcgcggcgcggcgtggcacctcccttcccgggtgcgcagcccggccccgcagcggcgcggggaacaaagggacccggcgccgcccgccccaccccgcccgtggcccggcccgcggggaccgccgcgtacctgaagcagggccgccagcagcggcagcagggtccgcagcgctcccgctatccggcacat

SEQ ID NO: 22729 - DNA, 335 bp, Homo sapiens
  chr18:25757452-25757787
  hyper
ccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgca

SEQ ID NO: 22730 - DNA, 148 bp, Homo sapiens
  chr18:25757824-25757972
  hyper
actcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgc

SEQ ID NO: 22731 - DNA, 110 bp, Homo sapiens; identical to SEQ ID NO: 13016
  chr18:25758377-25758487
  hyper

SEQ ID NO: 22732 - DNA, 68 bp, Homo sapiens
  chr18:28620831-28620899
  hyper
gttaatttacccatccggtccgaaattgcaagtgtttgtaaactgacaattgcagatgaaatagtcat

SEQ ID NO: 22733 - DNA, 71 bp, Homo sapiens
  chr18:28621097-28621168
  hyper
tcttccatggcctctgggagcctcgagcgaatgcgagaaattctgagagcagcacccgtagtttcgttccc

SEQ ID NO: 22734 - DNA, 56 bp, Homo sapiens
  chr18:28621932-28621988
  hyper
ttcgcgcccccggcacatcccgcccccagctgggtggctggcgggggtggaccgct

SEQ ID NO: 22735 - DNA, 229 bp, Homo sapiens
  chr18:28622488-28622717
  hyper
tccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttc

SEQ ID NO: 22736 - DNA, 155 bp, Homo sapiens; identical to SEQ ID NO: 13022
  chr18:30350080-30350235
  hyper

SEQ ID NO: 22737 - DNA, 47 bp, Homo sapiens
  chr18:31020448-31020495
  hyper
gggtgaagaactagtcgactctaactccctcagggtggccagggaat

SEQ ID NO: 22738 - DNA, 173 bp, Homo sapiens
  chr18:31739469-31739642
  hyper
tgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacc

SEQ ID NO: 22739 - DNA, 41 bp, Homo sapiens; identical to SEQ ID NO: 13025
  chr18:31802052-31802093
  hyper

SEQ ID NO: 22740 - DNA, 107 bp, Homo sapiens
  chr18:31802831-31802938
  hyper
aaggtagggggcacacgagccaacggcggctcacggctccccctctctcccgcctctctccttcctccctccccgccgggctgctccggcagacaaataacagagga

SEQ ID NO: 22741 - DNA, 120 bp, Homo sapiens
  chr18:31802968-31803088
  hyper
cacgtagagcacttgcttggcgccgccgcctcccccgcggacctcgtccggctggcccagctggaagcccttcgatttgacccagaatttaaatttggcgttgtccgtggagctcgactc

SEQ ID NO: 22742 - DNA, 69 bp, Homo sapiens
  chr18:31803369-31803438
  hyper
gaggggaggagggtccggttgggcaccagcaatcaatgccccgtgctaccaagtctggtccattcgtaa

SEQ ID NO: 22743 - DNA, 24 bp, Homo sapiens
  chr18:31803472-31803496
  hyper
cttagcggtcggtctctttaatat

SEQ ID NO: 22744 - DNA, 76 bp, Homo sapiens; identical to SEQ ID NO: 13028
  chr18:32073450-32073526
  hyper

SEQ ID NO: 22745 - DNA, 79 bp, Homo sapiens; identical to SEQ ID NO: 13029
  chr18:32073746-32073825
  hyper

SEQ ID NO: 22746 - DNA, 205 bp, Homo sapiens; identical to SEQ ID NO: 13030
  chr18:34834309-34834514
  hyper

SEQ ID NO: 22747 - DNA, 48 bp, Homo sapiens
  chr18:35065024-35065072
  hyper
gctataaaccagggccgaggcgcgatagtttatcaaagacgagggctg

SEQ ID NO: 22748 - DNA, 135 bp, Homo sapiens; identical to SEQ ID NO: 4536
  chr18:35065516-35065651
  hyper

SEQ ID NO: 22749 - DNA, 44 bp, Homo sapiens; identical to SEQ ID NO: 13033
  chr18:35104934-35104978
  hyper

SEQ ID NO: 22750 - DNA, 25 bp, Homo sapiens
  chr18:35144820-35144845
  hyper
tctctcccttttagacggctgcgct

SEQ ID NO: 22751 - DNA, 40 bp, Homo sapiens; identical to SEQ ID NO: 13036
  chr18:35145558-35145598
  hyper

SEQ ID NO: 22752 - DNA, 55 bp, Homo sapiens; identical to SEQ ID NO: 13038
  chr18:35146710-35146765
  hyper

SEQ ID NO: 22753 - DNA, 9 bp, Homo sapiens
  chr18:35146895-35146904
  hyper
cggaaggtg

SEQ ID NO: 22754 - DNA, 30 bp, Homo sapiens; identical to SEQ ID NO: 13040
  chr18:35147131-35147161
  hyper

SEQ ID NO: 22755 - DNA, 53 bp, Homo sapiens; identical to SEQ ID NO: 13041
  chr18:43913567-43913620
  hyper

SEQ ID NO: 22756 - DNA, 228 bp, Homo sapiens; identical to SEQ ID NO: 13042
  chr18:43914398-43914626
  hyper

SEQ ID NO: 22757 - DNA, 162 bp, Homo sapiens
  chr18:44337012-44337174
  hyper
cgatagggacggggggagggggcgtacaaaacacccgcgcagtctggctaatgataggcgggccgtggggagggggaggggcggagcgcaaaacgccgggtttgaatcttggaattaaaaagagggcaggggctgggcgcggtggctcactcctgtaatccc

SEQ ID NO: 22758 - DNA, 83 bp, Homo sapiens
  chr18:44772977-44773060
  hyper
gtgaactgggctgcccgggctgctgctgccgccgccactcgccttctggggggccaggggcggcggcgggggcgggggcaggt

SEQ ID NO: 22759 - DNA, 126 bp, Homo sapiens
  chr18:44773466-44773592
  hyper
cggcggggccgggtggtggcgctcggaacccggctcgtcgggctgcgggggcagcagcagaagcggcgacggcggctgcggggggtggtggtggtggtggtggtggtgagggtggtgatggtggtg

SEQ ID NO: 22760 - DNA, 21 bp, Homo sapiens
  chr18:44775554-44775575
  hyper
ctccgccgcagaaccccgggc

SEQ ID NO: 22761 - DNA, 51 bp, Homo sapiens; identical to SEQ ID NO: 13053
  chr18:44780673-44780724
  hyper

SEQ ID NO: 22762 - DNA, 179 bp, Homo sapiens; identical to SEQ ID NO: 13055
  chr18:44786934-44787113
  hyper

SEQ ID NO: 22763 - DNA, 35 bp, Homo sapiens
  chr18:44787746-44787781
  hyper
tagcttgctcagatccgcacccccccactccccac

SEQ ID NO: 22764 - DNA, 7 bp, Homo sapiens
  chr18:44789865-44789872
  hyper
gccgggc

SEQ ID NO: 22765 - DNA, 26 bp, Homo sapiens
  chr18:44789937-44789963
  hyper
ctaggacatgccgggggctgtttgct

SEQ ID NO: 22766 - DNA, 30 bp, Homo sapiens; identical to SEQ ID NO: 13059
  chr18:45663049-45663079
  hyper

SEQ ID NO: 22767 - DNA, 30 bp, Homo sapiens; identical to SEQ ID NO: 13060
  chr18:47088076-47088106
  hyper

SEQ ID NO: 22768 - DNA, 42 bp, Homo sapiens; identical to SEQ ID NO: 13061
  chr18:47339612-47339654
  hyper

SEQ ID NO: 22769 - DNA, 39 bp, Homo sapiens
  chr18:52989220-52989259
  hyper
tacgcgagatcgattcaacttttccgaggggtttttatt

SEQ ID NO: 22770 - DNA, 64 bp, Homo sapiens
  chr18:52989882-52989946
  hyper
catgggcccagagcctacggaggggctggggcgctgctcccctcgctggcgctgggcgccccaa

SEQ ID NO: 22771 - DNA, 30 bp, Homo sapiens; identical to SEQ ID NO: 13065
  chr18:53254709-53254739
  hyper

SEQ ID NO: 22772 - DNA, 874 bp, Homo sapiens; identical to SEQ ID NO: 13066
  chr18:53255143-53256017
  hyper

SEQ ID NO: 22773 - DNA, 195 bp, Homo sapiens
  chr18:53256942-53257137
  hyper
caccatggactcccccgtggagtcacattgataataataggtttccctgaaagatacattgtaatccattcacatccgggaactgcgggcttataaagagaaggagctgcggccgcggctgctcctccagacaatgactgggaaggggcggggcgggagcaggcgaccatagagtggtaaacagagcgcctagag

SEQ ID NO: 22774 - DNA, 99 bp, Homo sapiens
  chr18:53257204-53257303
  hyper
gggtaggcgtcgcgcgtggggcggcactgtgggagttcccgaggccgaggtcgttcgcaggccccatttccctgcgctcttattcgtgttgccgcttct

SEQ ID NO: 22775 - DNA, 104 bp, Homo sapiens
  chr18:53446866-53446970
  hyper
aaatgccaggagccccgggggtgtgatgtttccggtggataatgtctcccgttccctgccccggggcccagacagttggtgcttaagcgtctacaatgtagagt

SEQ ID NO: 22776 - DNA, 39 bp, Homo sapiens
  chr18:53447816-53447855
  hyper
ccccgcagcttccctgcggctcagcggcctcccacccag

SEQ ID NO: 22777 - DNA, 15 bp, Homo sapiens
  chr18:54789055-54789070
  hyper
agcgtggcctgagcc

SEQ ID NO: 22778 - DNA, 58 bp, Homo sapiens
  chr18:55020597-55020655
  hyper
gcagagatggacaggcgtgaggggagcgccctccccgcgccctgtccgcagactccgc

SEQ ID NO: 22779 - DNA, 141 bp, Homo sapiens; identical to SEQ ID NO: 4552
  chr18:55020804-55020945
  hyper

SEQ ID NO: 22780 - DNA, 113 bp, Homo sapiens
  chr18:55020965-55021078
  hyper
cgagagcccccgccccgctctgtgaccccgggaactctcccagcagggcctcctgacgggcaggtggcaactacaaagtgccacctgtggtccaagctgggaccgaggcgagg

SEQ ID NO: 22781 - DNA, 32 bp, Homo sapiens; identical to SEQ ID NO: 13074
  chr18:55105140-55105172
  hyper

SEQ ID NO: 22782 - DNA, 30 bp, Homo sapiens; identical to SEQ ID NO: 13076
  chr18:55106031-55106061
  hyper

SEQ ID NO: 22783 - DNA, 46 bp, Homo sapiens; identical to SEQ ID NO: 13078
  chr18:56887753-56887799
  hyper

SEQ ID NO: 22784 - DNA, 30 bp, Homo sapiens; identical to SEQ ID NO: 13079
  chr18:56888148-56888178
  hyper

SEQ ID NO: 22785 - DNA, 64 bp, Homo sapiens
  chr18:56888490-56888554
  hyper
cccctagaacccaggcggagaggacggccgcgctgcgggtgcggagggcgcctgcgggtggggt

SEQ ID NO: 22786 - DNA, 50 bp, Homo sapiens
  chr18:56931583-56931633
  hyper
ggtgccctcaccgtacgccgaccgtgtggggaacacgctctctggaagct

SEQ ID NO: 22787 - DNA, 30 bp, Homo sapiens; identical to SEQ ID NO: 13082
  chr18:56933063-56933093
  hyper

SEQ ID NO: 22788 - DNA, 54 bp, Homo sapiens
  chr18:56934956-56935010
  hyper
gctcaggcgggagtccgggactctccttcttcagagagtctcaggagattgtga

SEQ ID NO: 22789 - DNA, 317 bp, Homo sapiens; identical to SEQ ID NO: 13084
  chr18:56936333-56936650
  hyper

SEQ ID NO: 22790 - DNA, 233 bp, Homo sapiens
  chr18:56940722-56940955
  hyper
cccttctctcggcccctccctccacagaggggcgtgtcctcacccggcccagccacagggtcctctagtggccacccctgggccggcactaggaatattccccttccacctcttgatccgttttaagctttacaaacacactccggggatccgcggcgggatgcctgatgggctcgggaacctggtcgcggcgcacccctagtcctgcctcagtggggccgacgcccttgggc

SEQ ID NO: 22791 - DNA, 9 bp, Homo sapiens
  chr18:56941788-56941797
  hyper
acccctcaa

SEQ ID NO: 22792 - DNA, 210 bp, Homo sapiens
  chr18:57364448-57364658
  hyper
gccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccct

SEQ ID NO: 22793 - DNA, 236 bp, Homo sapiens
  chr18:57364691-57364927
  hyper
tttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctc

SEQ ID NO: 22794 - DNA, 159 bp, Homo sapiens
  chr18:59000829-59000988
  hyper
ccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggca

SEQ ID NO: 22795 - DNA, 279 bp, Homo sapiens
  chr18:59001022-59001301
  hyper
aggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaa

SEQ ID NO: 22796 - DNA, 58 bp, Homo sapiens
  chr18:67067500-67067558
  hyper
cctagttaacgaaaacgcatgcataaatcaaccactcgggtcggtcggtcttctccac

SEQ ID NO: 22797 - DNA, 30 bp, Homo sapiens; identical to SEQ ID NO: 13096
  chr18:67067914-67067944
  hyper

SEQ ID NO: 22798 - DNA, 181 bp, Homo sapiens
  chr18:70209205-70209386
  hyper
acttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccggg

SEQ ID NO: 22799 - DNA, 72 bp, Homo sapiens; identical to SEQ ID NO: 13099
  chr18:70209493-70209565
  hyper

SEQ ID NO: 22800 - DNA, 30 bp, Homo sapiens; identical to SEQ ID NO: 13100
  chr18:70209822-70209852
  hyper

SEQ ID NO: 22801 - DNA, 50 bp, Homo sapiens; identical to SEQ ID NO: 13101
  chr18:70211036-70211086
  hyper

SEQ ID NO: 22802 - DNA, 73 bp, Homo sapiens
  chr18:70535582-70535655
  hyper
agaggatgcagccgcaaatcccgagccggatcctcgtgccggacggaaggcgtggaagcgggaggggccttcg

SEQ ID NO: 22803 - DNA, 39 bp, Homo sapiens
  chr18:70535971-70536010
  hyper
accccaaggcacacacggacccccgttcccccgcgccac

SEQ ID NO: 22804 - DNA, 229 bp, Homo sapiens
  chr18:70536604-70536833
  hyper
cgttgggtgctcgtcgcagtcctgcccacgcctagcgcagcggctgtgagtgggtggaggtctcctgccagtaagttgggatgagggacgatgaggtgacccccaagtctggaagggattcagagtctcacacgcgcccccaagcctcctaccaccacaccaaagtgctggttcctcgatttccagggtggggtaaagtgaccgagcaaaggggatggtgtgtttgtgt

SEQ ID NO: 22805 - DNA, 154 bp, Homo sapiens
  chr18:70536871-70537025
  hyper
tgtaatgaaagttgggtcatgggtcaacccgggagtagagcgagatggagacctaaagagagaaagctgagagaagggggaagacatggacagggtaagagagagagaaaggagagagagaagaaagggaaaagaggagcggggagagaaaaga

SEQ ID NO: 22806 - DNA, 33 bp, Homo sapiens; identical to SEQ ID NO: 13107
  chr18:70537332-70537365
  hyper

SEQ ID NO: 22807 - DNA, 349 bp, Homo sapiens; identical to SEQ ID NO: 13108
  chr18:72123440-72123789
  hyper

SEQ ID NO: 22808 - DNA, 48 bp, Homo sapiens; identical to SEQ ID NO: 13109
  chr18:72124237-72124285
  hyper

SEQ ID NO: 22809 - DNA, 47 bp, Homo sapiens; identical to SEQ ID NO: 13112
  chr18:73628494-73628541
  hyper

SEQ ID NO: 22810 - DNA, 106 bp, Homo sapiens; identical to SEQ ID NO: 13115
  chr18:74962836-74962942
  hyper

SEQ ID NO: 22811 - DNA, 46 bp, Homo sapiens
  chr18:75362885-75362931
  hyper
tgccggccatgccctcggctcctctcccgacacgcgccagcactgc

SEQ ID NO: 22812 - DNA, 43 bp, Homo sapiens
  chr18:75362985-75363028
  hyper
gaagaagccgggaccgcgagcagctggacgctttctccctggg

SEQ ID NO: 22813 - DNA, 39 bp, Homo sapiens
  chr18:75612186-75612225
  hyper
ctgcaggagccccggcggcctgcaggggcggtggcgcgg

SEQ ID NO: 22814 - DNA, 145 bp, Homo sapiens
  chr18:75612286-75612431
  hyper
cgcgcgggggacgcggggcgcggcgcgctgagcgcgggtgccgaggctggagggcgcggccgggctcccgagtcctccctccgcggcatccttgtctccaccctcaaatgtcctgcaagccaggagcctccgtaggaaccgctgc

SEQ ID NO: 22815 - DNA, 235 bp, Homo sapiens; identical to SEQ ID NO: 13118
  chr18:77153209-77153444
  hyper

SEQ ID NO: 22816 - DNA, 119 bp, Homo sapiens; identical to SEQ ID NO: 13119
  chr18:77159847-77159966
  hyper

SEQ ID NO: 22817 - DNA, 78 bp, Homo sapiens; identical to SEQ ID NO: 1346
  chr18:77547970-77548048
  hyper

SEQ ID NO: 22818 - DNA, 100 bp, Homo sapiens
  chr18:77557982-77558082
  hyper
ggagcccggagctcgcggagtctggaccgcaggtaaagttgagcgcgccgtggggccgggggtggggggtccgcggcgaaggagccggggccgcagtggg

SEQ ID NO: 22819 - DNA, 39 bp, Homo sapiens
  chr18:77558358-77558397
  hyper
ccgtctattcgcgctggtcctgcgggagcccgggtgagc

SEQ ID NO: 22820 - DNA, 415 bp, Homo sapiens
  chr18:77558416-77558831
  hyper
cgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtg

SEQ ID NO: 22821 - DNA, 212 bp, Homo sapiens
  chr18:77558930-77559142
  hyper
ccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaa

SEQ ID NO: 22822 - DNA, 40 bp, Homo sapiens; identical to SEQ ID NO: 13124
  chr19:591461-591501
  hyper

SEQ ID NO: 22823 - DNA, 1 bp, Homo sapiens
  chr19:1401751-1401752
  hyper
g

SEQ ID NO: 22824 - DNA, 2 bp, Homo sapiens
  chr19:1401795-1401797
  hyper
tc

SEQ ID NO: 22825 - DNA, 132 bp, Homo sapiens
  chr19:1450187-1450319
  hyper
cccggagcccctgcccgcgccgcggagaccccggagcccgcgcgctccgaggccaccccgggccgggatttccggtggggcccgcggagccgcgcagagggaggaggccccagacccaggcgccccgccagc

SEQ ID NO: 22826 - DNA, 42 bp, Homo sapiens
  chr19:1450390-1450432
  hyper
tttccatccctggctctcagcattgcccgtcagcacagactc

SEQ ID NO: 22827 - DNA, 34 bp, Homo sapiens; identical to SEQ ID NO: 13127
  chr19:1523753-1523787
  hyper

SEQ ID NO: 22828 - DNA, 67 bp, Homo sapiens
  chr19:1524447-1524514
  hyper
ccgtgggttgcgtgtccggggtgtgggcgtgcggctcggcctcgggatgcgacgctgtgttgcccct

SEQ ID NO: 22829 - DNA, 30 bp, Homo sapiens; identical to SEQ ID NO: 13129
  chr19:1719137-1719167
  hyper

SEQ ID NO: 22830 - DNA, 39 bp, Homo sapiens; identical to SEQ ID NO: 13130
  chr19:1725654-1725693
  hyper

SEQ ID NO: 22831 - DNA, 30 bp, Homo sapiens; identical to SEQ ID NO: 13131
  chr19:1750146-1750176
  hyper

SEQ ID NO: 22832 - DNA, 113 bp, Homo sapiens; identical to SEQ ID NO: 13132
  chr19:1753693-1753806
  hyper

SEQ ID NO: 22833 - DNA, 426 bp, Homo sapiens
  chr19:1754313-1754739
  hyper
cgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgc

SEQ ID NO: 22834 - DNA, 71 bp, Homo sapiens
  chr19:1754804-1754875
  hyper
tggctgcaggagccagagttccagcgcatgtcggcgctgcgcttggcaggtaggagcgtggcgcgcagggc

SEQ ID NO: 22835 - DNA, 40 bp, Homo sapiens
  chr19:1757376-1757416
  hyper
gtctgggtttcctgtcgaggaagggagagttagaacagtc

SEQ ID NO: 22836 - DNA, 11 bp, Homo sapiens
  chr19:1757615-1757626
  hyper
cctgtcgcgtc

SEQ ID NO: 22837 - DNA, 74 bp, Homo sapiens; identical to SEQ ID NO: 13135
  chr19:1757980-1758054
  hyper

SEQ ID NO: 22838 - DNA, 66 bp, Homo sapiens; identical to SEQ ID NO: 13136
  chr19:1762172-1762238
  hyper

SEQ ID NO: 22839 - DNA, 169 bp, Homo sapiens; identical to SEQ ID NO: 13138
  chr19:1762627-1762796
  hyper

SEQ ID NO: 22840 - DNA, 30 bp, Homo sapiens; identical to SEQ ID NO: 13139
  chr19:1765699-1765729
  hyper

SEQ ID NO: 22841 - DNA, 39 bp, Homo sapiens; identical to SEQ ID NO: 13140
  chr19:1769737-1769776
  hyper

SEQ ID NO: 22842 - DNA, 117 bp, Homo sapiens
  chr19:1776259-1776376
  hyper
acctttaggcaccttcgtggagcgcaaggaaggacgcagctccggacacgggagaccacgcccaggctcccaggagaaggggacccggccggagaaggcgccgctggggccgcccgg

SEQ ID NO: 22843 - DNA, 345 bp, Homo sapiens; identical to SEQ ID NO: 13142
  chr19:1856999-1857344
  hyper

SEQ ID NO: 22844 - DNA, 326 bp, Homo sapiens
  chr19:2252658-2252984
  hyper
gcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctg

SEQ ID NO: 22845 - DNA, 247 bp, Homo sapiens
  chr19:2290006-2290253
  hyper
ttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgc

SEQ ID NO: 22846 - DNA, 21 bp, Homo sapiens
  chr19:2302772-2302793
  hyper
gcaggggggccgggccggcgg

SEQ ID NO: 22847 - DNA, 15 bp, Homo sapiens
  chr19:3585992-3586007
  hyper
ggggccccctttgca

SEQ ID NO: 22848 - DNA, 12 bp, Homo sapiens
  chr19:3785637-3785649
  hyper
gaaacacacagg

SEQ ID NO: 22849 - DNA, 16 bp, Homo sapiens
  chr19:3786583-3786599
  hyper
gcgcggcggggaccgg

SEQ ID NO: 22850 - DNA, 48 bp, Homo sapiens; identical to SEQ ID NO: 13153
  chr19:3822204-3822252
  hyper

SEQ ID NO: 22851 - DNA, 48 bp, Homo sapiens; identical to SEQ ID NO: 13154
  chr19:3868851-3868899
  hyper

SEQ ID NO: 22852 - DNA, 226 bp, Homo sapiens; identical to SEQ ID NO: 13155
  chr19:3880562-3880788
  hyper

SEQ ID NO: 22853 - DNA, 30 bp, Homo sapiens; identical to SEQ ID NO: 13156
  chr19:3881573-3881603
  hyper

SEQ ID NO: 22854 - DNA, 167 bp, Homo sapiens; identical to SEQ ID NO: 13157
  chr19:3933513-3933680
  hyper

SEQ ID NO: 22855 - DNA, 138 bp, Homo sapiens; identical to SEQ ID NO: 13158
  chr19:4198030-4198168
  hyper

SEQ ID NO: 22856 - DNA, 70 bp, Homo sapiens; identical to SEQ ID NO: 13159
  chr19:4304487-4304557
  hyper

SEQ ID NO: 22857 - DNA, 48 bp, Homo sapiens; identical to SEQ ID NO: 13160
  chr19:5292738-5292786
  hyper

SEQ ID NO: 22858 - DNA, 71 bp, Homo sapiens; identical to SEQ ID NO: 13161
  chr19:5293067-5293138
  hyper

SEQ ID NO: 22859 - DNA, 27 bp, Homo sapiens
  chr19:5293155-5293182
  hyper
cggctcggagatcgggcccaggccccg

SEQ ID NO: 22860 - DNA, 48 bp, Homo sapiens; identical to SEQ ID NO: 13163
  chr19:5294020-5294068
  hyper

SEQ ID NO: 22861 - DNA, 30 bp, Homo sapiens; identical to SEQ ID NO: 13164
  chr19:5338746-5338776
  hyper

SEQ ID NO: 22862 - DNA, 94 bp, Homo sapiens; identical to SEQ ID NO: 13166
  chr19:5340523-5340617
  hyper

SEQ ID NO: 22863 - DNA, 214 bp, Homo sapiens; identical to SEQ ID NO: 13167
  chr19:5437029-5437243
  hyper

SEQ ID NO: 22864 - DNA, 33 bp, Homo sapiens; identical to SEQ ID NO: 13168
  chr19:5567596-5567629
  hyper

SEQ ID NO: 22865 - DNA, 225 bp, Homo sapiens; identical to SEQ ID NO: 13169
  chr19:5828090-5828315
  hyper

SEQ ID NO: 22866 - DNA, 33 bp, Homo sapiens
  chr19:6590478-6590511
  hyper
cccctcccccacccggagcgagtggctggggcc

SEQ ID NO: 22867 - DNA, 38 bp, Homo sapiens; identical to SEQ ID NO: 13171
  chr19:6590785-6590823
  hyper

SEQ ID NO: 22868 - DNA, 103 bp, Homo sapiens
  chr19:7794909-7795012
  hyper
catccaggcccccaacgatcaccaggtgcgcgctggcatctgcgcagtgatcctgcgccgccgcccacgtcgtctttggcacagagaaaaagtagcaggagcc

SEQ ID NO: 22869 - DNA, 127 bp, Homo sapiens; identical to SEQ ID NO: 13173
  chr19:7795565-7795692
  hyper

SEQ ID NO: 22870 - DNA, 9 bp, Homo sapiens
  chr19:7795734-7795743
  hyper
cgtccccga

SEQ ID NO: 22871 - DNA, 31 bp, Homo sapiens
  chr19:7852997-7853028
  hyper
ggccgtttgcagtcacgcgtgtgcacatggc

SEQ ID NO: 22872 - DNA, 11 bp, Homo sapiens
  chr19:7853460-7853471
  hyper
gcagacggcgg

SEQ ID NO: 22873 - DNA, 60 bp, Homo sapiens; identical to SEQ ID NO: 13177
  chr19:7853543-7853603
  hyper

SEQ ID NO: 22874 - DNA, 42 bp, Homo sapiens; identical to SEQ ID NO: 13178
  chr19:7927482-7927524
  hyper

SEQ ID NO: 22875 - DNA, 218 bp, Homo sapiens
  chr19:8115276-8115494
  hyper
gaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctct

SEQ ID NO: 22876 - DNA, 20 bp, Homo sapiens
  chr19:9517771-9517791
  hyper
gtttccaggcatgagggcaa

SEQ ID NO: 22877 - DNA, 244 bp, Homo sapiens
  chr19:9903669-9903913
  hyper
gtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatgg

SEQ ID NO: 22878 - DNA, 52 bp, Homo sapiens
  chr19:10398157-10398209
  hyper
tcgctctatagggagcgcccgcggacctcactcagaggctcccccttgcctt

SEQ ID NO: 22879 - DNA, 167 bp, Homo sapiens
  chr19:10398285-10398452
  hyper
caggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgc

SEQ ID NO: 22880 - DNA, 30 bp, Homo sapiens; identical to SEQ ID NO: 13186
  chr19:10400448-10400478
  hyper

SEQ ID NO: 22881 - DNA, 62 bp, Homo sapiens
  chr19:10406349-10406411
  hyper
ggggcggccggccccgcctgcctccctctcggtcccggtagactagacggaagtgggacaga

SEQ ID NO: 22882 - DNA, 153 bp, Homo sapiens; identical to SEQ ID NO: 13191
  chr19:10531548-10531701
  hyper

SEQ ID NO: 22883 - DNA, 203 bp, Homo sapiens; identical to SEQ ID NO: 13192
  chr19:10616329-10616532
  hyper

SEQ ID NO: 22884 - DNA, 30 bp, Homo sapiens; identical to SEQ ID NO: 13195
  chr19:10629493-10629523
  hyper

SEQ ID NO: 22885 - DNA, 72 bp, Homo sapiens; identical to SEQ ID NO: 13196
  chr19:10691925-10691997
  hyper

SEQ ID NO: 22886 - DNA, 118 bp, Homo sapiens; identical to SEQ ID NO: 13197
  chr19:11529773-11529891
  hyper

SEQ ID NO: 22887 - DNA, 100 bp, Homo sapiens; identical to SEQ ID NO: 13198
  chr19:11531503-11531603
  hyper

SEQ ID NO: 22888 - DNA, 17 bp, Homo sapiens
  chr19:11532425-11532442
  hyper
cacgaggcccagcaggt

SEQ ID NO: 22889 - DNA, 272 bp, Homo sapiens
  chr19:11592750-11593022
  hyper
actggggcggggtcgccagggcgtgaggcttcagcaccacagacagcaatccgacagtccggtcgagggcgctgccggcgaggtagcccagaccccctaactggagagcggcagtccccacccaatcctcgttcctgcacgccctttaggctccagactgtcagagagcgccaccagcgaggagagcctaatttgcccaatcaggggcggcccttgagataaccagttactggaagatgccctagagatcgagccaatgggagtgcgcgcac

SEQ ID NO: 22890 - DNA, 136 bp, Homo sapiens
  chr19:11593159-11593295
  hyper
gcgatggtctgttccccaccccgtgttcctcccggtttccgtcatcggaaactgagctaggaggggggctgctcctgggcgcgcggaccccgctgcggttcccatggaaacctgccggctccggcagtgcggggag

SEQ ID NO: 22891 - DNA, 58 bp, Homo sapiens
  chr19:11689402-11689460
  hyper
cctgcctgcctcctccgtgctgggcgccgccgcgacacgtcccgcggacattcaggag

SEQ ID NO: 22892 - DNA, 45 bp, Homo sapiens; identical to SEQ ID NO: 13203
  chr19:11909467-11909512
  hyper

SEQ ID NO: 22893 - DNA, 30 bp, Homo sapiens; identical to SEQ ID NO: 13204
  chr19:11909854-11909884
  hyper

SEQ ID NO: 22894 - DNA, 30 bp, Homo sapiens; identical to SEQ ID NO: 13205
  chr19:11959427-11959457
  hyper

SEQ ID NO: 22895 - DNA, 97 bp, Homo sapiens; identical to SEQ ID NO: 4587
  chr19:11959663-11959760
  hyper

SEQ ID NO: 22896 - DNA, 151 bp, Homo sapiens
  chr19:11959761-11959912
  hyper
ggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggact

SEQ ID NO: 22897 - DNA, 314 bp, Homo sapiens; identical to SEQ ID NO: 13208
  chr19:11998761-11999075
  hyper

SEQ ID NO: 22898 - DNA, 62 bp, Homo sapiens; identical to SEQ ID NO: 13209
  chr19:12075756-12075818
  hyper

SEQ ID NO: 22899 - DNA, 117 bp, Homo sapiens; identical to SEQ ID NO: 13210
  chr19:12076262-12076379
  hyper

SEQ ID NO: 22900 - DNA, 160 bp, Homo sapiens; identical to SEQ ID NO: 13211
  chr19:12146813-12146973
  hyper

SEQ ID NO: 22901 - DNA, 16 bp, Homo sapiens
  chr19:12163328-12163344
  hyper
cacaatctggggagac

SEQ ID NO: 22902 - DNA, 310 bp, Homo sapiens
  chr19:12175504-12175814
  hyper
cggccaactgtttatccgcgggtcacattgccgttcgcctcagtctttggcccctcccgccgggtgaggttggcaccccgtttttcctgctctgagagggaccggttgccaccgccatacttctgtcgccctgtcgtctgtgttgtgactgctttggacgtgggagtcacctgaaagccaggaaatggtgagtgtgagcccccgctgggagtcccgagacttgggggagggtaggcggaggctggttggaactggctggaaccggctgtgccgggacccggacctccccgcggcgactcgaggtctgggg

SEQ ID NO: 22903 - DNA, 15 bp, Homo sapiens
  chr19:12203013-12203028
  hyper
tcagggctctgaagg

SEQ ID NO: 22904 - DNA, 121 bp, Homo sapiens
  chr19:12750866-12750987
  hyper
tactccgctcacctgcgacggcagcagccagtccccacgggcggaggggacctcatgcgacattcagcccgcgagattctcagagactgctcgcccgcaacacgcagtaacgatctcagga

SEQ ID NO: 22905 - DNA, 54 bp, Homo sapiens
  chr19:12751056-12751110
  hyper
ctctcttgcggtttgcagccagatcacttcccatacacgcggcagccaagctca

SEQ ID NO: 22906 - DNA, 147 bp, Homo sapiens; identical to SEQ ID NO: 13220
  chr19:12936457-12936604
  hyper

SEQ ID NO: 22907 - DNA, 209 bp, Homo sapiens
  chr19:13617256-13617465
  hyper
atagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaa

SEQ ID NO: 22908 - DNA, 29 bp, Homo sapiens
  chr19:13617489-13617518
  hyper
cggtttgcaaaggacgccccccccgggac

SEQ ID NO: 22909 - DNA, 30 bp, Homo sapiens; identical to SEQ ID NO: 13226
  chr19:13617846-13617876
  hyper

SEQ ID NO: 22910 - DNA, 29 bp, Homo sapiens
  chr19:13618381-13618410
  hyper
agagaggggagcgtcgcatggttgggagg

SEQ ID NO: 22911 - DNA, 340 bp, Homo sapiens; identical to SEQ ID NO: 13228
  chr19:14320312-14320652
  hyper

SEQ ID NO: 22912 - DNA, 135 bp, Homo sapiens; identical to SEQ ID NO: 13229
  chr19:14583381-14583516
  hyper

SEQ ID NO: 22913 - DNA, 107 bp, Homo sapiens; identical to SEQ ID NO: 13230
  chr19:14583613-14583720
  hyper

SEQ ID NO: 22914 - DNA, 15 bp, Homo sapiens
  chr19:14886822-14886837
  hyper
cgggcgcccctccca

SEQ ID NO: 22915 - DNA, 97 bp, Homo sapiens
  chr19:15090075-15090172
  hyper
acgggcagggagacccggggataactaaggggataggaaactcaccagaacgaccaggagaaaagcggtggcaacggctctaaggggcaagcaggag

SEQ ID NO: 22916 - DNA, 53 bp, Homo sapiens
  chr19:15090499-15090552
  hyper
ctatgctgcgggagggatccgggccggccctgcgctcacgtgggtgtgggggc

SEQ ID NO: 22917 - DNA, 66 bp, Homo sapiens; identical to SEQ ID NO: 13235
  chr19:15090784-15090850
  hyper

SEQ ID NO: 22918 - DNA, 27 bp, Homo sapiens
  chr19:15288856-15288883
  hyper
ccggcaggagcgcgccacccgctcgca

SEQ ID NO: 22919 - DNA, 72 bp, Homo sapiens; identical to SEQ ID NO: 13238
  chr19:15333743-15333815
  hyper

SEQ ID NO: 22920 - DNA, 34 bp, Homo sapiens; identical to SEQ ID NO: 13239
  chr19:15334731-15334765
  hyper

SEQ ID NO: 22921 - DNA, 147 bp, Homo sapiens
  chr19:15342587-15342734
  hyper
agttctcagggaagccgtgcagaaacagcatgaggggtccgttacctcgtccagccgagacatagtgcagacgcaggcccgagctctagggggagggcacagcctgaagcctggggaaccctctctcccgaggcttgaaccgtctcg

SEQ ID NO: 22922 - DNA, 127 bp, Homo sapiens
  chr19:15343980-15344107
  hyper
caatgggcaatgagacggagggcggggccgggacctaatatggcgggtcaggagggtctggaagacgaagaagagggacaggcaatgccaggtctaggactaggagggaggcgcgggcggtattagc

SEQ ID NO: 22923 - DNA, 208 bp, Homo sapiens; identical to SEQ ID NO: 13242
  chr19:15619208-15619416
  hyper

SEQ ID NO: 22924 - DNA, 237 bp, Homo sapiens; identical to SEQ ID NO: 13243
  chr19:15695292-15695529
  hyper

SEQ ID NO: 22925 - DNA, 131 bp, Homo sapiens
  chr19:17007662-17007793
  hyper
aatacttacaaaaacagaaacagacttttaaaaagcggttgtaggagagaaaggagacagggcgtcctgtctgggccgccctgcaacaacagccccgtcccctgccgcgcctcctccgcactgaccacacc

SEQ ID NO: 22926 - DNA, 44 bp, Homo sapiens; identical to SEQ ID NO: 4602
  chr19:17008475-17008519
  hyper

SEQ ID NO: 22927 - DNA, 276 bp, Homo sapiens; identical to SEQ ID NO: 13248
  chr19:17137083-17137359
  hyper

SEQ ID NO: 22928 - DNA, 18 bp, Homo sapiens
  chr19:17137395-17137413
  hyper
cgccgacagcagcaggag

SEQ ID NO: 22929 - DNA, 169 bp, Homo sapiens; identical to SEQ ID NO: 13250
  chr19:17392904-17393073
  hyper

SEQ ID NO: 22930 - DNA, 398 bp, Homo sapiens; identical to SEQ ID NO: 4604
  chr19:17501241-17501639
  hyper

SEQ ID NO: 22931 - DNA, 131 bp, Homo sapiens; identical to SEQ ID NO: 13252
  chr19:17717050-17717181
  hyper

SEQ ID NO: 22932 - DNA, 104 bp, Homo sapiens; identical to SEQ ID NO: 13253
  chr19:17717404-17717508
  hyper

SEQ ID NO: 22933 - DNA, 149 bp, Homo sapiens; identical to SEQ ID NO: 13255
  chr19:17983002-17983151
  hyper

SEQ ID NO: 22934 - DNA, 63 bp, Homo sapiens
  chr19:17983474-17983537
  hyper
gcacctacgaggtaccggacagaggcccgggggtaggacctgccccactggcagtgctgggac

SEQ ID NO: 22935 - DNA, 41 bp, Homo sapiens; identical to SEQ ID NO: 13257
  chr19:18077737-18077778
  hyper

SEQ ID NO: 22936 - DNA, 39 bp, Homo sapiens; identical to SEQ ID NO: 13258
  chr19:18078233-18078272
  hyper

SEQ ID NO: 22937 - DNA, 241 bp, Homo sapiens
  chr19:18343569-18343810
  hyper
acaagccatgatgacaccagcaccctcagctccacccctacgtagaaatagctttttccttccaggcgccagcctcaaccaagcagcagagacccccgccccctggagaagcaaggaccctcccccactcccgccaggccccgcgcgcccctcccccgcgctgcaggaggcccctgccccggccacctaccgcctgcaggaggaaacgggccaggagagccgcgacttcctgagctccggc

SEQ ID NO: 22938 - DNA, 42 bp, Homo sapiens
  chr19:18343879-18343921
  hyper
cggatggggcgccggggttgccgccacaggtgcttcggggct

SEQ ID NO: 22939 - DNA, 11 bp, Homo sapiens
  chr19:18715071-18715082
  hyper
gcgggggacac

SEQ ID NO: 22940 - DNA, 2 bp, Homo sapiens
  chr19:18898231-18898233
  hyper
cc

SEQ ID NO: 22941 - DNA, 112 bp, Homo sapiens; identical to SEQ ID NO: 13264
  chr19:18899103-18899215
  hyper

SEQ ID NO: 22942 - DNA, 30 bp, Homo sapiens; identical to SEQ ID NO: 13265
  chr19:18900810-18900840
  hyper

SEQ ID NO: 22943 - DNA, 225 bp, Homo sapiens
  chr19:18901603-18901828
  hyper
actgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacct

SEQ ID NO: 22944 - DNA, 114 bp, Homo sapiens
  chr19:18902095-18902209
  hyper
gggtggctgctcgctttctaccgcccacgaggcccgcggggcctatttatccccaaggcacggccggccccagggacggcccaccacagccctgcccaacgtccagcctcaagg

SEQ ID NO: 22945 - DNA, 30 bp, Homo sapiens; identical to SEQ ID NO: 13267
  chr19:19006120-19006150
  hyper

SEQ ID NO: 22946 - DNA, 131 bp, Homo sapiens; identical to SEQ ID NO: 13268
  chr19:19006691-19006822
  hyper

SEQ ID NO: 22947 - DNA, 50 bp, Homo sapiens; identical to SEQ ID NO: 13269
  chr19:19322879-19322929
  hyper

SEQ ID NO: 22948 - DNA, 54 bp, Homo sapiens; identical to SEQ ID NO: 13270
  chr19:19649100-19649154
  hyper

SEQ ID NO: 22949 - DNA, 336 bp, Homo sapiens; identical to SEQ ID NO: 4606
  chr19:19651512-19651848
  hyper

SEQ ID NO: 22950 - DNA, 30 bp, Homo sapiens; identical to SEQ ID NO: 13273
  chr19:19932203-19932233
  hyper

SEQ ID NO: 22951 - DNA, 29 bp, Homo sapiens
  chr19:19932565-19932594
  hyper
gccaaagccggaagccggaaaccgtcctg

SEQ ID NO: 22952 - DNA, 7 bp, Homo sapiens
  chr19:20012149-20012156
  hyper
gcacccg

SEQ ID NO: 22953 - DNA, 408 bp, Homo sapiens; identical to SEQ ID NO: 13276
  chr19:20149780-20150188
  hyper

SEQ ID NO: 22954 - DNA, 148 bp, Homo sapiens; identical to SEQ ID NO: 13277
  chr19:20162757-20162905
  hyper

SEQ ID NO: 22955 - DNA, 388 bp, Homo sapiens; identical to SEQ ID NO: 13278
  chr19:20162906-20163294
  hyper

SEQ ID NO: 22956 - DNA, 30 bp, Homo sapiens; identical to SEQ ID NO: 13279
  chr19:20188913-20188943
  hyper

SEQ ID NO: 22957 - DNA, 103 bp, Homo sapiens
  chr19:22018420-22018523
  hyper
tgctgggattaaaggcgtgacccaccgcgcccggccgactctcctgtttctaatagaccaaaagagggactagaaatgccacggaccaaagctcttcctattc

SEQ ID NO: 22958 - DNA, 58 bp, Homo sapiens; identical to SEQ ID NO: 4609
  chr19:22018900-22018958
  hyper

SEQ ID NO: 22959 - DNA, 61 bp, Homo sapiens; identical to SEQ ID NO: 4610
  chr19:22018959-22019020
  hyper

SEQ ID NO: 22960 - DNA, 28 bp, Homo sapiens
  chr19:22019080-22019108
  hyper
aaggtcctgcccccgcaaaccctgaatg

SEQ ID NO: 22961 - DNA, 225 bp, Homo sapiens
  chr19:22034813-22035038
  hyper
tggagaacgcggaaaagcagaggcgggtcccaaggtctagcgggagctggagacaaaggccccgccaaaagccggaagccacggccccctctccaactgcgcgtctgattgggtggttcccacgccagcgccactgattggataaagctccaggacccaccctccctagcgtttgcgcattttatggacagggaaacaggctcaagtaggcggggcacatgccca

SEQ ID NO: 22962 - DNA, 167 bp, Homo sapiens
  chr19:22715443-22715610
  hyper
tgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagag

SEQ ID NO: 22963 - DNA, 6 bp, Homo sapiens
  chr19:22806297-22806303
  hyper
cgcggg

SEQ ID NO: 22964 - DNA, 31 bp, Homo sapiens
  chr19:23254158-23254189
  hyper
ttcagctgaaggctgcgggccttcccgagct

SEQ ID NO: 22965 - DNA, 6 bp, Homo sapiens
  chr19:23254219-23254225
  hyper
cctcgg

SEQ ID NO: 22966 - DNA, 37 bp, Homo sapiens
  chr19:23258694-23258731
  hyper
attaatttataagaaatgcattcgagttgggttttag

SEQ ID NO: 22967 - DNA, 36 bp, Homo sapiens
  chr19:23299712-23299748
  hyper
cagggcctgagggggcggggccttaaacgttatcca

SEQ ID NO: 22968 - DNA, 16 bp, Homo sapiens
  chr19:23300338-23300354
  hyper
gcgttcccaattcctc

SEQ ID NO: 22969 - DNA, 30 bp, Homo sapiens; identical to SEQ ID NO: 13295
  chr19:23386702-23386732
  hyper

SEQ ID NO: 22970 - DNA, 38 bp, Homo sapiens; identical to SEQ ID NO: 13296
  chr19:23598448-23598486
  hyper

SEQ ID NO: 22971 - DNA, 30 bp, Homo sapiens; identical to SEQ ID NO: 13297
  chr19:23598726-23598756
  hyper

SEQ ID NO: 22972 - DNA, 86 bp, Homo sapiens; identical to SEQ ID NO: 13298
  chr19:23654103-23654189
  hyper

SEQ ID NO: 22973 - DNA, 362 bp, Homo sapiens
  chr19:30015572-30015934
  hyper
ctcctgggccatagacgaggaaactgaaaggcaggcactggaggcaagaagggctggccccgggcacccgctggcgaggacagccttggagagggcctgcagctcctcccctctgagctgtgctgcgctggccgcctggaccagggtggctgctggagagtgttttccctctgggtttccttctccttggctcccagggaatcctctggcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagat

SEQ ID NO: 22974 - DNA, 36 bp, Homo sapiens
  chr19:30016712-30016748
  hyper
gctgtactccaaccagaaagacggtggtccctccga

SEQ ID NO: 22975 - DNA, 124 bp, Homo sapiens
  chr19:30018608-30018732
  hyper
tgctgggtagtgaaggaagcccccttggtcccatcaggctctccccgccctctgccactttgaggaccccagggctcccacggctgcgttccagaggccaccagaaaaccgagtaccggaaagc

SEQ ID NO: 22976 - DNA, 32 bp, Homo sapiens
  chr19:30019113-30019145
  hyper
accagggcagccacccgttggtcaggcaccat

SEQ ID NO: 22977 - DNA, 74 bp, Homo sapiens
  chr19:30019838-30019912
  hyper
ggtgttgcaggcttgcaggggacggggtagggggtggttgtgccaggctgcgaggggcccgggtcatggggttg

SEQ ID NO: 22978 - DNA, 103 bp, Homo sapiens; identical to SEQ ID NO: 13308
  chr19:30021252-30021355
  hyper

SEQ ID NO: 22979 - DNA, 339 bp, Homo sapiens; identical to SEQ ID NO: 13309
  chr19:30215072-30215411
  hyper

SEQ ID NO: 22980 - DNA, 22 bp, Homo sapiens
  chr19:30713458-30713480
  hyper
gaggcatgcagagggcgtcggc

SEQ ID NO: 22981 - DNA, 102 bp, Homo sapiens
  chr19:30713706-30713808
  hyper
cctccaggcctggaaggggctcccctggcctggaggccatgggcccggcccagaccggccagacaccgccagggacccccagaacgacgccaggacgcgcgc

SEQ ID NO: 22982 - DNA, 9 bp, Homo sapiens
  chr19:30715393-30715402
  hyper
agagaacct

SEQ ID NO: 22983 - DNA, 103 bp, Homo sapiens
  chr19:30715766-30715869
  hyper
ttttttttttttttcctcccagaaaagaaacagactttaaatagtttcaggagcaggtaagaattacgctttttcctcgccccttctccgtctctctctcctc

SEQ ID NO: 22984 - DNA, 194 bp, Homo sapiens
  chr19:30716576-30716770
  hyper
ggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttct

SEQ ID NO: 22985 - DNA, 626 bp, Homo sapiens
  chr19:30718149-30718775
  hyper
tggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcg

SEQ ID NO: 22986 - DNA, 166 bp, Homo sapiens
  chr19:30719283-30719449
  hyper
tagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatc

SEQ ID NO: 22987 - DNA, 18 bp, Homo sapiens
  chr19:30865695-30865713
  hyper
gaggccacccccagccgg

SEQ ID NO: 22988 - DNA, 55 bp, Homo sapiens
  chr19:31839873-31839928
  hyper
gtgcgagagggaagagggcagagcgcggcggggcgtccggggggcgcccggtacc

SEQ ID NO: 22989 - DNA, 102 bp, Homo sapiens; identical to SEQ ID NO: 13319
  chr19:31839941-31840043
  hyper

SEQ ID NO: 22990 - DNA, 30 bp, Homo sapiens; identical to SEQ ID NO: 13320
  chr19:31840866-31840896
  hyper

SEQ ID NO: 22991 - DNA, 37 bp, Homo sapiens; identical to SEQ ID NO: 13321
  chr19:31841109-31841146
  hyper

SEQ ID NO: 22992 - DNA, 30 bp, Homo sapiens; identical to SEQ ID NO: 13322
  chr19:31841471-31841501
  hyper

SEQ ID NO: 22993 - DNA, 92 bp, Homo sapiens
  chr19:31842389-31842481
  hyper
cggggctctcgggctggcggactcgggggctgaggcgccgtgcgcgttgggtgcccgcggccgcagaggccagaaccgctactcctccaggc

SEQ ID NO: 22994 - DNA, 78 bp, Homo sapiens
  chr19:32715595-32715673
  hyper
taaatatgttcattccgctcttgcgatcggtgataaaccggaggcggccgaggccgacagaggtcagcaggccgctcg

SEQ ID NO: 22995 - DNA, 128 bp, Homo sapiens
  chr19:33166988-33167116
  hyper
cgcacgtcgagggtcccgggcgggctccgtggacgttggcggtagcgccgagcgagtcacggaccatgaagagcgttcgtgccgcgcggcccaaggccgggatgggggttagccacatcctgccgcgc

SEQ ID NO: 22996 - DNA, 90 bp, Homo sapiens
  chr19:34112434-34112524
  hyper
gctgtggtcaaggcccgccccggtgacgcctggtccttttcccgggttggcgccgcgtgcgacccaccgaggcagtggcagcactggccg

SEQ ID NO: 22997 - DNA, 15 bp, Homo sapiens
  chr19:34113288-34113303
  hyper
ggccccggactgcac

SEQ ID NO: 22998 - DNA, 33 bp, Homo sapiens; identical to SEQ ID NO: 13328
  chr19:34113879-34113912
  hyper

SEQ ID NO: 22999 - DNA, 66 bp, Homo sapiens; identical to SEQ ID NO: 13329
  chr19:34288609-34288675
  hyper

SEQ ID NO: 23000 - DNA, 30 bp, Homo sapiens; identical to SEQ ID NO: 13331
  chr19:35068705-35068735
  hyper

SEQ ID NO: 23001 - DNA, 151 bp, Homo sapiens; identical to SEQ ID NO: 13332
  chr19:35263633-35263784
  hyper

SEQ ID NO: 23002 - DNA, 71 bp, Homo sapiens
  chr19:35396370-35396441
  hyper
cctagctagacaagtgcttctcacgatccagcgcgtttaccgctcggtttcgtcgccgctaaggggtggtg

SEQ ID NO: 23003 - DNA, 126 bp, Homo sapiens; identical to SEQ ID NO: 13334
  chr19:35531737-35531863
  hyper

SEQ ID NO: 23004 - DNA, 15 bp, Homo sapiens
  chr19:36048580-36048595
  hyper
ccaggctgaggtagg

SEQ ID NO: 23005 - DNA, 316 bp, Homo sapiens
  chr19:36048771-36049087
  hyper
aggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtg

SEQ ID NO: 23006 - DNA, 57 bp, Homo sapiens
  chr19:36335147-36335204
  hyper
ggggaaggccagaataagggacctggcaggacctcccatccccgggacccctcccca

SEQ ID NO: 23007 - DNA, 53 bp, Homo sapiens; identical to SEQ ID NO: 13337
  chr19:36337032-36337085
  hyper

SEQ ID NO: 23008 - DNA, 30 bp, Homo sapiens; identical to SEQ ID NO: 13338
  chr19:36347846-36347876
  hyper

SEQ ID NO: 23009 - DNA, 43 bp, Homo sapiens; identical to SEQ ID NO: 13339
  chr19:36351905-36351948
  hyper

SEQ ID NO: 23010 - DNA, 30 bp, Homo sapiens; identical to SEQ ID NO: 13340
  chr19:36361080-36361110
  hyper

SEQ ID NO: 23011 - DNA, 15 bp, Homo sapiens
  chr19:36450544-36450559
  hyper
cgccccagggtcgct

SEQ ID NO: 23012 - DNA, 93 bp, Homo sapiens; identical to SEQ ID NO: 13344
  chr19:36523623-36523716
  hyper

SEQ ID NO: 23013 - DNA, 82 bp, Homo sapiens
  chr19:36822242-36822324
  hyper
ataaacctcaacctgcgggtcactccctcccaggcgtgcaacaaaacacctgcctagaaatcaaaaggcgttttacccgagt

SEQ ID NO: 23014 - DNA, 15 bp, Homo sapiens
  chr19:36912335-36912350
  hyper
ggcaccaggggacgc

SEQ ID NO: 23015 - DNA, 15 bp, Homo sapiens
  chr19:36912480-36912495
  hyper
cgagacaagccggtg

SEQ ID NO: 23016 - DNA, 560 bp, Homo sapiens; identical to SEQ ID NO: 13353
  chr19:37157617-37158177
  hyper

SEQ ID NO: 23017 - DNA, 66 bp, Homo sapiens; identical to SEQ ID NO: 13354
  chr19:37263373-37263439
  hyper

SEQ ID NO: 23018 - DNA, 37 bp, Homo sapiens; identical to SEQ ID NO: 13355
  chr19:37263751-37263788
  hyper

SEQ ID NO: 23019 - DNA, 25 bp, Homo sapiens
  chr19:37287936-37287961
  hyper
tttgttttttgaaaccgagtttcgc

SEQ ID NO: 23020 - DNA, 112 bp, Homo sapiens; identical to SEQ ID NO: 13361
  chr19:37329256-37329368
  hyper

SEQ ID NO: 23021 - DNA, 32 bp, Homo sapiens; identical to SEQ ID NO: 13362
  chr19:37342101-37342133
  hyper

SEQ ID NO: 23022 - DNA, 108 bp, Homo sapiens; identical to SEQ ID NO: 4652
  chr19:37406765-37406873
  hyper

SEQ ID NO: 23023 - DNA, 46 bp, Homo sapiens
  chr19:37407081-37407127
  hyper
catccagccgagcctcggagttgcgggtcgccgtagcgctgcgcaa

SEQ ID NO: 23024 - DNA, 31 bp, Homo sapiens
  chr19:37464696-37464727
  hyper
gaggcctgggagggggcgggacaccctcgct

SEQ ID NO: 23025 - DNA, 809 bp, Homo sapiens; identical to SEQ ID NO: 13369
  chr19:37957671-37958480
  hyper

SEQ ID NO: 23026 - DNA, 542 bp, Homo sapiens
  chr19:37959963-37960505
  hyper
acttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccac

SEQ ID NO: 23027 - DNA, 35 bp, Homo sapiens; identical to SEQ ID NO: 13374
  chr19:38146647-38146682
  hyper

SEQ ID NO: 23028 - DNA, 209 bp, Homo sapiens; identical to SEQ ID NO: 13375
  chr19:38147011-38147220
  hyper

SEQ ID NO: 23029 - DNA, 53 bp, Homo sapiens
  chr19:38182831-38182884
  hyper
gcgggcactcactctcgctcacactacaatcagatcctccatgcggctttcat

SEQ ID NO: 23030 - DNA, 34 bp, Homo sapiens; identical to SEQ ID NO: 4659
  chr19:38183440-38183474
  hyper

SEQ ID NO: 23031 - DNA, 83 bp, Homo sapiens; identical to SEQ ID NO: 13379
  chr19:38210615-38210698
  hyper

SEQ ID NO: 23032 - DNA, 30 bp, Homo sapiens; identical to SEQ ID NO: 13381
  chr19:38701199-38701229
  hyper

SEQ ID NO: 23033 - DNA, 500 bp, Homo sapiens; identical to SEQ ID NO: 13382
  chr19:38701550-38702050
  hyper

SEQ ID NO: 23034 - DNA, 290 bp, Homo sapiens; identical to SEQ ID NO: 13383
  chr19:38746788-38747078
  hyper

SEQ ID NO: 23035 - DNA, 53 bp, Homo sapiens
  chr19:38747106-38747159
  hyper
cggccgcctcaggcctcagtttccccgtctgcagtgcgagagtaggccgctgc

SEQ ID NO: 23036 - DNA, 36 bp, Homo sapiens; identical to SEQ ID NO: 13386
  chr19:38877852-38877888
  hyper

SEQ ID NO: 23037 - DNA, 39 bp, Homo sapiens; identical to SEQ ID NO: 13387
  chr19:38924397-38924436
  hyper

SEQ ID NO: 23038 - DNA, 95 bp, Homo sapiens; identical to SEQ ID NO: 13388
  chr19:38924437-38924532
  hyper

SEQ ID NO: 23039 - DNA, 55 bp, Homo sapiens; identical to SEQ ID NO: 13389
  chr19:39282953-39283008
  hyper

SEQ ID NO: 23040 - DNA, 39 bp, Homo sapiens; identical to SEQ ID NO: 13390
  chr19:39466291-39466330
  hyper

SEQ ID NO: 23041 - DNA, 42 bp, Homo sapiens; identical to SEQ ID NO: 13391
  chr19:39589777-39589819
  hyper

SEQ ID NO: 23042 - DNA, 28 bp, Homo sapiens
  chr19:39687619-39687647
  hyper
gggatggaggaggtgcgtgagggacacg

SEQ ID NO: 23043 - DNA, 115 bp, Homo sapiens
  chr19:39687844-39687959
  hyper
gaggagtgggggccgctgagcgggggcctggagctgccccagcgcctcacctggaagctgctcctgttgcggcggccgctctaccgcaacctgctgcgctcgcccaaccccgaag

SEQ ID NO: 23044 - DNA, 62 bp, Homo sapiens
  chr19:39755358-39755420
  hyper
agtcacaaaaggagccctgcagggcggactcggctccaggtcgcgggcgcagggctatgccg

SEQ ID NO: 23045 - DNA, 366 bp, Homo sapiens; identical to SEQ ID NO: 13396
  chr19:39989752-39990118
  hyper

SEQ ID NO: 23046 - DNA, 43 bp, Homo sapiens
  chr19:39993434-39993477
  hyper
tcctttgcctgtcctcgcagggcccgcctggagcctgctggcg

SEQ ID NO: 23047 - DNA, 173 bp, Homo sapiens
  chr19:39997813-39997986
  hyper
gcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttccca

SEQ ID NO: 23048 - DNA, 54 bp, Homo sapiens; identical to SEQ ID NO: 13400
  chr19:40005850-40005904
  hyper

SEQ ID NO: 23049 - DNA, 16 bp, Homo sapiens
  chr19:40724263-40724279
  hyper
ccggggacagcgcgcc

SEQ ID NO: 23050 - DNA, 160 bp, Homo sapiens
  chr19:41025379-41025539
  hyper
cgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggca

SEQ ID NO: 23051 - DNA, 29 bp, Homo sapiens
  chr19:41025683-41025712
  hyper
ctacatgacctcgacgctttcctggactg

SEQ ID NO: 23052 - DNA, 18 bp, Homo sapiens
  chr19:41073569-41073587
  hyper
tcgagaaaatcaaagcgg

SEQ ID NO: 23053 - DNA, 3 bp, Homo sapiens
  chr19:41073677-41073680
  hyper
ggc

SEQ ID NO: 23054 - DNA, 59 bp, Homo sapiens; identical to SEQ ID NO: 13408
  chr19:41354396-41354455
  hyper

SEQ ID NO: 23055 - DNA, 91 bp, Homo sapiens
  chr19:41354575-41354666
  hyper
cgatgcctcgcttgcccaccccgaagtcccgcagggtggcgatggagaagcgccggagctgcttggcgcgctccccgttgctgaataccac

SEQ ID NO: 23056 - DNA, 15 bp, Homo sapiens
  chr19:41354722-41354737
  hyper
cggagcagctccaag

SEQ ID NO: 23057 - DNA, 53 bp, Homo sapiens; identical to SEQ ID NO: 13410
  chr19:41596078-41596131
  hyper

SEQ ID NO: 23058 - DNA, 105 bp, Homo sapiens
  chr19:41641726-41641831
  hyper
ggagcccagcaaaggcggggccaatgtgtggatagggcacttggaggtctggtaaggcagcaaaacgaacgaagccggccgcaggagtcggaggccccgaaaggg

SEQ ID NO: 23059 - DNA, 13 bp, Homo sapiens
  chr19:41641886-41641899
  hyper
cctcctttcccgt

SEQ ID NO: 23060 - DNA, 219 bp, Homo sapiens
  chr19:42028283-42028502
  hyper
tctaaaacaaaccaacgaggctgccaacctgtgagatagttggtccacttgtacaaaaccccctccatgcttcagagccccacaccgctcatcctcccggcccggcgccggccgcggtgatggggtaggcgcggggcctggggcagcctttcccggcccgcccgggccccctccgccggcacgaagccgctttctgcctgcgcgcgccgcagggacgtg

SEQ ID NO: 23061 - DNA, 193 bp, Homo sapiens
  chr19:42028549-42028742
  hyper
ccgcgaggcgcgggctcagacatccccgggtaagcctcggcggcggcggccgcgacaacggcaaaaatgcgactgcgaccgcgaccggtctcgtgctcgcgcttccgcggcccggctgctccctccggcgccccggcgctgcctcttcctcgcctgccttccttccccctgggctccccgtttgtttttcgac

SEQ ID NO: 23062 - DNA, 30 bp, Homo sapiens; identical to SEQ ID NO: 13413
  chr19:42574121-42574151
  hyper

SEQ ID NO: 23063 - DNA, 133 bp, Homo sapiens; identical to SEQ ID NO: 13414
  chr19:42636456-42636589
  hyper

SEQ ID NO: 23064 - DNA, 19 bp, Homo sapiens
  chr19:42828316-42828335
  hyper
cgtgcgtccacacctgggg

SEQ ID NO: 23065 - DNA, 68 bp, Homo sapiens; identical to SEQ ID NO: 13416
  chr19:42906129-42906197
  hyper

SEQ ID NO: 23066 - DNA, 64 bp, Homo sapiens; identical to SEQ ID NO: 13417
  chr19:42928276-42928340
  hyper

SEQ ID NO: 23067 - DNA, 30 bp, Homo sapiens; identical to SEQ ID NO: 13418
  chr19:44203678-44203708
  hyper

SEQ ID NO: 23068 - DNA, 41 bp, Homo sapiens; identical to SEQ ID NO: 13419
  chr19:44324840-44324881
  hyper

SEQ ID NO: 23069 - DNA, 414 bp, Homo sapiens; identical to SEQ ID NO: 13422
  chr19:44711532-44711946
  hyper

SEQ ID NO: 23070 - DNA, 31 bp, Homo sapiens
  chr19:45656363-45656394
  hyper
aggaagcacaggaagtcggtgagcagctcca

SEQ ID NO: 23071 - DNA, 43 bp, Homo sapiens
  chr19:45656913-45656956
  hyper
gcaggaacaccaggtaccacagtagctgcgggacgccccagcc

SEQ ID NO: 23072 - DNA, 35 bp, Homo sapiens
  chr19:45657177-45657212
  hyper
taaagagctggaagccggtgcagaagcgggggcgt

SEQ ID NO: 23073 - DNA, 30 bp, Homo sapiens; identical to SEQ ID NO: 13431
  chr19:45755404-45755434
  hyper

SEQ ID NO: 23074 - DNA, 82 bp, Homo sapiens
  chr19:45888864-45888946
  hyper
cgcacttctcgaaggcggtggcgccgtcgctgagcgtggtggcgaagattgcagcgccgtgctgcaccagcgccatgcagat

SEQ ID NO: 23075 - DNA, 178 bp, Homo sapiens; identical to SEQ ID NO: 13434
  chr19:46001719-46001897
  hyper

SEQ ID NO: 23076 - DNA, 33 bp, Homo sapiens
  chr19:46002320-46002353
  hyper
agaggaccaccggccccttcgaccccgggaacg

SEQ ID NO: 23077 - DNA, 54 bp, Homo sapiens; identical to SEQ ID NO: 13436
  chr19:46105244-46105298
  hyper

SEQ ID NO: 23078 - DNA, 11 bp, Homo sapiens
  chr19:46379903-46379914
  hyper
gctgcgtgtca

SEQ ID NO: 23079 - DNA, 93 bp, Homo sapiens; identical to SEQ ID NO: 13438
  chr19:46476967-46477060
  hyper

SEQ ID NO: 23080 - DNA, 110 bp, Homo sapiens; identical to SEQ ID NO: 13439
  chr19:46519300-46519410
  hyper

SEQ ID NO: 23081 - DNA, 61 bp, Homo sapiens; identical to SEQ ID NO: 13440
  chr19:46907548-46907609
  hyper

SEQ ID NO: 23082 - DNA, 65 bp, Homo sapiens
  chr19:46930064-46930129
  hyper
tggtctccatagcaacggtcggacgcgctgctaggttctggctctgactgcgcctgcgcggctgg

SEQ ID NO: 23083 - DNA, 84 bp, Homo sapiens; identical to SEQ ID NO: 13443
  chr19:46932252-46932336
  hyper

SEQ ID NO: 23084 - DNA, 145 bp, Homo sapiens; identical to SEQ ID NO: 13449
  chr19:47523113-47523258
  hyper

SEQ ID NO: 23085 - DNA, 37 bp, Homo sapiens; identical to SEQ ID NO: 13450
  chr19:47523631-47523668
  hyper

SEQ ID NO: 23086 - DNA, 30 bp, Homo sapiens; identical to SEQ ID NO: 13451
  chr19:47921726-47921756
  hyper

SEQ ID NO: 23087 - DNA, 111 bp, Homo sapiens
  chr19:47933200-47933311
  hyper
agccaggggagggggcggagaagggaggccgagtcccaggagaggaggccgagtctggggggaaaaggagaccagggtccaagagcaggtgcagccgagtccctagccccg

SEQ ID NO: 23088 - DNA, 28 bp, Homo sapiens
  chr19:47933732-47933760
  hyper
gagacatacaggtcggaggggctttgcg

SEQ ID NO: 23089 - DNA, 3 bp, Homo sapiens
  chr19:47960799-47960802
  hyper
cga

SEQ ID NO: 23090 - DNA, 118 bp, Homo sapiens; identical to SEQ ID NO: 13455
  chr19:48076481-48076599
  hyper

SEQ ID NO: 23091 - DNA, 185 bp, Homo sapiens; identical to SEQ ID NO: 13456
  chr19:48901882-48902067
  hyper

SEQ ID NO: 23092 - DNA, 30 bp, Homo sapiens; identical to SEQ ID NO: 13458
  chr19:48994837-48994867
  hyper

SEQ ID NO: 23093 - DNA, 39 bp, Homo sapiens
  chr19:49399310-49399349
  hyper
ccctagaccccgtctccgcaatcccgggtttggggtggg

SEQ ID NO: 23094 - DNA, 77 bp, Homo sapiens; identical to SEQ ID NO: 13461
  chr19:49924485-49924562
  hyper

SEQ ID NO: 23095 - DNA, 186 bp, Homo sapiens; identical to SEQ ID NO: 4674
  chr19:49925774-49925960
  hyper

SEQ ID NO: 23096 - DNA, 11 bp, Homo sapiens
  chr19:49936853-49936864
  hyper
tagcccctctc

SEQ ID NO: 23097 - DNA, 296 bp, Homo sapiens; identical to SEQ ID NO: 13465
  chr19:50194182-50194478
  hyper

SEQ ID NO: 23098 - DNA, 37 bp, Homo sapiens; identical to SEQ ID NO: 13466
  chr19:50194774-50194811
  hyper

SEQ ID NO: 23099 - DNA, 55 bp, Homo sapiens; identical to SEQ ID NO: 13469
  chr19:50815996-50816051
  hyper

SEQ ID NO: 23100 - DNA, 10 bp, Homo sapiens
  chr19:50816474-50816484
  hyper
gggaaggggg

SEQ ID NO: 23101 - DNA, 179 bp, Homo sapiens; identical to SEQ ID NO: 13471
  chr19:50818424-50818603
  hyper

SEQ ID NO: 23102 - DNA, 30 bp, Homo sapiens; identical to SEQ ID NO: 13472
  chr19:50819128-50819158
  hyper

SEQ ID NO: 23103 - DNA, 35 bp, Homo sapiens; identical to SEQ ID NO: 13473
  chr19:50836356-50836391
  hyper

SEQ ID NO: 23104 - DNA, 13 bp, Homo sapiens
  chr19:50836392-50836405
  hyper
ggctgtcttaccg

SEQ ID NO: 23105 - DNA, 51 bp, Homo sapiens; identical to SEQ ID NO: 13475
  chr19:51111640-51111691
  hyper

SEQ ID NO: 23106 - DNA, 48 bp, Homo sapiens; identical to SEQ ID NO: 13476
  chr19:51142710-51142758
  hyper

SEQ ID NO: 23107 - DNA, 15 bp, Homo sapiens
  chr19:51142834-51142849
  hyper
cgaggggtgggatac

SEQ ID NO: 23108 - DNA, 331 bp, Homo sapiens; identical to SEQ ID NO: 13479
  chr19:51161720-51162051
  hyper

SEQ ID NO: 23109 - DNA, 15 bp, Homo sapiens
  chr19:51170723-51170738
  hyper
cagttttcaaggaac

SEQ ID NO: 23110 - DNA, 74 bp, Homo sapiens
  chr19:51171145-51171219
  hyper
cagggccagccccagcggggaggcgggatccagggccttgccggtcagcgggtgcaccaggggtcgcgggggca

SEQ ID NO: 23111 - DNA, 258 bp, Homo sapiens; identical to SEQ ID NO: 13483
  chr19:51197503-51197761
  hyper

SEQ ID NO: 23112 - DNA, 60 bp, Homo sapiens; identical to SEQ ID NO: 13484
  chr19:51198175-51198235
  hyper

SEQ ID NO: 23113 - DNA, 355 bp, Homo sapiens; identical to SEQ ID NO: 13485
  chr19:51198793-51199148
  hyper

SEQ ID NO: 23114 - DNA, 117 bp, Homo sapiens
  chr19:51227602-51227719
  hyper
ggtcctcaggccccccgctgcatctccaggctccccctccagcatgatccctgtctgtccgcagtgggccgcctggccggcctggacgcaggcctgcaccagctgcacgtccgtctg

SEQ ID NO: 23115 - DNA, 23 bp, Homo sapiens
  chr19:51227785-51227808
  hyper
gacacccgcgatgccgtgcaagc

SEQ ID NO: 23116 - DNA, 21 bp, Homo sapiens
  chr19:51228248-51228269
  hyper
gcctccttctctacccggccc

SEQ ID NO: 23117 - DNA, 132 bp, Homo sapiens
  chr19:51228507-51228639
  hyper
cttcgaaaacggccagcgcgtgtccttcttcgcctggcatcgctcaccccgccccgagctcggcgcccagcccagcgcctcgccgcatccgctcagcccggaccagcccaacggtggcacgctcgagaactg

SEQ ID NO: 23118 - DNA, 91 bp, Homo sapiens; identical to SEQ ID NO: 4680
  chr19:51228702-51228793
  hyper

SEQ ID NO: 23119 - DNA, 49 bp, Homo sapiens; identical to SEQ ID NO: 13490
  chr19:51412508-51412557
  hyper

SEQ ID NO: 23120 - DNA, 44 bp, Homo sapiens; identical to SEQ ID NO: 13491
  chr19:51520138-51520182
  hyper

SEQ ID NO: 23121 - DNA, 232 bp, Homo sapiens
  chr19:51831128-51831360
  hyper
tgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaa

SEQ ID NO: 23122 - DNA, 30 bp, Homo sapiens; identical to SEQ ID NO: 13494
  chr19:52074302-52074332
  hyper

SEQ ID NO: 23123 - DNA, 89 bp, Homo sapiens; identical to SEQ ID NO: 13495
  chr19:52207371-52207460
  hyper

SEQ ID NO: 23124 - DNA, 75 bp, Homo sapiens
  chr19:52222448-52222523
  hyper
ctctactcacctgcacgtagtccaccgaatctccgagcgccttgaaggctgtgtacatgacctcgcgcttgccgc

SEQ ID NO: 23125 - DNA, 179 bp, Homo sapiens; identical to SEQ ID NO: 13497
  chr19:52531480-52531659
  hyper

SEQ ID NO: 23126 - DNA, 67 bp, Homo sapiens; identical to SEQ ID NO: 13498
  chr19:52839463-52839530
  hyper

SEQ ID NO: 23127 - DNA, 30 bp, Homo sapiens; identical to SEQ ID NO: 13499
  chr19:52839996-52840026
  hyper

SEQ ID NO: 23128 - DNA, 19 bp, Homo sapiens
  chr19:52872905-52872924
  hyper
cctcagcatccgggtagct

SEQ ID NO: 23129 - DNA, 34 bp, Homo sapiens; identical to SEQ ID NO: 13502
  chr19:52900940-52900974
  hyper

SEQ ID NO: 23130 - DNA, 27 bp, Homo sapiens
  chr19:52900975-52901002
  hyper
gaagcgcaggcccggcccaggctttgt

SEQ ID NO: 23131 - DNA, 199 bp, Homo sapiens
  chr19:52956606-52956805
  hyper
ttggctgctggtcaccgatagggtctttcctcaaaaacctggagaacagacgcgcccagagacaggccgaaggcagcgcagaccccgcccctcaccgccccaccctctcttctctcgggtctcgcccatccctggcctcagctgcgcgcggtttcctggaaacccggaagtgaatcatggggcgtgaactcgcaagcgc

SEQ ID NO: 23132 - DNA, 10 bp, Homo sapiens
  chr19:52956848-52956858
  hyper
ttggagcagc

SEQ ID NO: 23133 - DNA, 123 bp, Homo sapiens
  chr19:53073440-53073563
  hyper
ctccgcctggggccccgcctctacctcgatcaggccccgcccaccttctcgttggctccacccaggcctggctttagtcctgtgcgcacacatccgcgcagaccaggaagcggatcccgtgga

SEQ ID NO: 23134 - DNA, 51 bp, Homo sapiens
  chr19:53073987-53074038
  hyper
gtgctgggatcttgtggaccccaccgaaggcgtcgtcgcaccccacctccc

SEQ ID NO: 23135 - DNA, 201 bp, Homo sapiens; identical to SEQ ID NO: 13508
  chr19:53141418-53141619
  hyper

SEQ ID NO: 23136 - DNA, 59 bp, Homo sapiens; identical to SEQ ID NO: 13509
  chr19:53193364-53193423
  hyper

SEQ ID NO: 23137 - DNA, 264 bp, Homo sapiens; identical to SEQ ID NO: 13511
  chr19:53400445-53400709
  hyper

SEQ ID NO: 23138 - DNA, 20 bp, Homo sapiens
  chr19:53497275-53497295
  hyper
ggatgcgggatggagtgctc

SEQ ID NO: 23139 - DNA, 30 bp, Homo sapiens; identical to SEQ ID NO: 13513
  chr19:53561529-53561559
  hyper

SEQ ID NO: 23140 - DNA, 103 bp, Homo sapiens; identical to SEQ ID NO: 13514
  chr19:53635501-53635604
  hyper

SEQ ID NO: 23141 - DNA, 46 bp, Homo sapiens
  chr19:53635906-53635952
  hyper
gaagaagcaaaaggccggggacggggagcagcctcaaagcgacttc

SEQ ID NO: 23142 - DNA, 247 bp, Homo sapiens
  chr19:53696167-53696414
  hyper
aggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcg

SEQ ID NO: 23143 - DNA, 69 bp, Homo sapiens
  chr19:53696580-53696649
  hyper
ttcactccaagagatctgcttccgggtttgcaagaaactgcccgcgcagtaggcaaaggggcgggttgc

SEQ ID NO: 23144 - DNA, 13 bp, Homo sapiens
  chr19:53696650-53696663
  hyper
gtggggaaaggcc

SEQ ID NO: 23145 - DNA, 35 bp, Homo sapiens; identical to SEQ ID NO: 13519
  chr19:53700349-53700384
  hyper

SEQ ID NO: 23146 - DNA, 30 bp, Homo sapiens; identical to SEQ ID NO: 13521
  chr19:53757742-53757772
  hyper

SEQ ID NO: 23147 - DNA, 205 bp, Homo sapiens
  chr19:53970763-53970968
  hyper
aattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggc

SEQ ID NO: 23148 - DNA, 101 bp, Homo sapiens; identical to SEQ ID NO: 13525
  chr19:53971344-53971445
  hyper

SEQ ID NO: 23149 - DNA, 325 bp, Homo sapiens
  chr19:54024196-54024521
  hyper
catgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccct

SEQ ID NO: 23150 - DNA, 93 bp, Homo sapiens; identical to SEQ ID NO: 13528
  chr19:54409951-54410044
  hyper

SEQ ID NO: 23151 - DNA, 101 bp, Homo sapiens; identical to SEQ ID NO: 13529
  chr19:54410263-54410364
  hyper

SEQ ID NO: 23152 - DNA, 102 bp, Homo sapiens
  chr19:54411454-54411556
  hyper
gagtctggggagtgccggggaccgtgcagatggactacatttccccgcaggcctcgcggcagacccttcccccaagtgcggctccttgccgccagggctgat

SEQ ID NO: 23153 - DNA, 34 bp, Homo sapiens
  chr19:54412839-54412873
  hyper
gggcaacaagggacccgagtggctccaggggtgg

SEQ ID NO: 23154 - DNA, 7 bp, Homo sapiens
  chr19:54412985-54412992
  hyper
cactcct

SEQ ID NO: 23155 - DNA, 74 bp, Homo sapiens; identical to SEQ ID NO: 13532
  chr19:54413489-54413563
  hyper

SEQ ID NO: 23156 - DNA, 30 bp, Homo sapiens; identical to SEQ ID NO: 13533
  chr19:54463032-54463062
  hyper

SEQ ID NO: 23157 - DNA, 391 bp, Homo sapiens; identical to SEQ ID NO: 13534
  chr19:54466163-54466554
  hyper

SEQ ID NO: 23158 - DNA, 51 bp, Homo sapiens; identical to SEQ ID NO: 13535
  chr19:54481352-54481403
  hyper

SEQ ID NO: 23159 - DNA, 229 bp, Homo sapiens; identical to SEQ ID NO: 13537
  chr19:54482817-54483046
  hyper

SEQ ID NO: 23160 - DNA, 174 bp, Homo sapiens
  chr19:54485823-54485997
  hyper
gggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcc

SEQ ID NO: 23161 - DNA, 93 bp, Homo sapiens; identical to SEQ ID NO: 13541
  chr19:55684842-55684935
  hyper

SEQ ID NO: 23162 - DNA, 97 bp, Homo sapiens; identical to SEQ ID NO: 13542
  chr19:55690949-55691046
  hyper

SEQ ID NO: 23163 - DNA, 40 bp, Homo sapiens; identical to SEQ ID NO: 13543
  chr19:55953904-55953944
  hyper

SEQ ID NO: 23164 - DNA, 42 bp, Homo sapiens; identical to SEQ ID NO: 13544
  chr19:55954477-55954519
  hyper

SEQ ID NO: 23165 - DNA, 32 bp, Homo sapiens; identical to SEQ ID NO: 13545
  chr19:55963152-55963184
  hyper

SEQ ID NO: 23166 - DNA, 121 bp, Homo sapiens; identical to SEQ ID NO: 13546
  chr19:55963603-55963724
  hyper

SEQ ID NO: 23167 - DNA, 20 bp, Homo sapiens
  chr19:56728658-56728678
  hyper
cgatgatgactccagctttc

SEQ ID NO: 23168 - DNA, 193 bp, Homo sapiens; identical to SEQ ID NO: 1401
  chr19:56904511-56904704
  hyper

SEQ ID NO: 23169 - DNA, 17 bp, Homo sapiens
  chr19:56904723-56904740
  hyper
cgttcttctcaggcctg

SEQ ID NO: 23170 - DNA, 152 bp, Homo sapiens
  chr19:56915168-56915320
  hyper
gcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctcca

SEQ ID NO: 23171 - DNA, 222 bp, Homo sapiens
  chr19:56915428-56915650
  hyper
tggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgc

SEQ ID NO: 23172 - DNA, 242 bp, Homo sapiens; identical to SEQ ID NO: 13555
  chr19:56915651-56915893
  hyper

SEQ ID NO: 23173 - DNA, 47 bp, Homo sapiens; identical to SEQ ID NO: 13557
  chr19:57018744-57018791
  hyper

SEQ ID NO: 23174 - DNA, 282 bp, Homo sapiens; identical to SEQ ID NO: 13558
  chr19:57019202-57019484
  hyper

SEQ ID NO: 23175 - DNA, 58 bp, Homo sapiens; identical to SEQ ID NO: 13559
  chr19:57079102-57079160
  hyper

SEQ ID NO: 23176 - DNA, 30 bp, Homo sapiens; identical to SEQ ID NO: 13560
  chr19:57149347-57149377
  hyper

SEQ ID NO: 23177 - DNA, 460 bp, Homo sapiens; identical to SEQ ID NO: 13561
  chr19:57154254-57154714
  hyper

SEQ ID NO: 23178 - DNA, 50 bp, Homo sapiens
  chr19:57182944-57182994
  hyper
gttgctctcgcctcccggtatcaccttcgaacgcgctggccggccccctc

SEQ ID NO: 23179 - DNA, 87 bp, Homo sapiens; identical to SEQ ID NO: 13563
  chr19:57610741-57610828
  hyper

SEQ ID NO: 23180 - DNA, 33 bp, Homo sapiens
  chr19:57617489-57617522
  hyper
ccctgcatcccggagcgcactggggatgaggac

SEQ ID NO: 23181 - DNA, 46 bp, Homo sapiens
  chr19:57618121-57618167
  hyper
agccgctgggggttcggcccaccccgcgaaccgagctcccggccct

SEQ ID NO: 23182 - DNA, 32 bp, Homo sapiens
  chr19:57683295-57683327
  hyper
gggcgcgagcgggggtccggggccgcgagctg

SEQ ID NO: 23183 - DNA, 94 bp, Homo sapiens; identical to SEQ ID NO: 13567
  chr19:57683592-57683686
  hyper

SEQ ID NO: 23184 - DNA, 58 bp, Homo sapiens; identical to SEQ ID NO: 13568
  chr19:57683805-57683863
  hyper

SEQ ID NO: 23185 - DNA, 94 bp, Homo sapiens
  chr19:57862783-57862877
  hyper
ccatgacccctgtcgtgggacgggcggcctctcgcggaggtgtctgccggggctgggctcttaccgaggcctccacacacgtcctcttgtcctt

SEQ ID NO: 23186 - DNA, 15 bp, Homo sapiens
  chr19:57989033-57989048
  hyper
aacactagtaagcgg

SEQ ID NO: 23187 - DNA, 54 bp, Homo sapiens
  chr19:58011070-58011124
  hyper
atctccatcatctaccgtctccaatctccatctccgaagttatgcccacttcct

SEQ ID NO: 23188 - DNA, 64 bp, Homo sapiens
  chr19:58011281-58011345
  hyper
aactcagcttgccggaagctggttgttcgctgcggcgaccagctccggaaagcgcggtggggac

SEQ ID NO: 23189 - DNA, 160 bp, Homo sapiens; identical to SEQ ID NO: 13573
  chr19:58011346-58011506
  hyper

SEQ ID NO: 23190 - DNA, 154 bp, Homo sapiens
  chr19:58038969-58039123
  hyper
cgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaa

SEQ ID NO: 23191 - DNA, 18 bp, Homo sapiens
  chr19:58094988-58095006
  hyper
ccccacgtggcctcccgg

SEQ ID NO: 23192 - DNA, 68 bp, Homo sapiens
  chr19:58111564-58111632
  hyper
gggttttctgcagcccggaccgcactgtccggcacagtgaggcgctggtgctggatctcgtttctggt

SEQ ID NO: 23193 - DNA, 49 bp, Homo sapiens
  chr19:58111783-58111832
  hyper
actgagtttcaccagcacactgagggccacagcgcgtaggacagaagag

SEQ ID NO: 23194 - DNA, 122 bp, Homo sapiens
  chr19:58125422-58125544
  hyper
tttctcagcgcccctcgcagtaccatttggcctttgcccagcgtgcaggggagttagccgtcaccacggccaagtgcacatgagaactgcattgcccagaaacctgtgcgccgcccggcggc

SEQ ID NO: 23195 - DNA, 131 bp, Homo sapiens
  chr19:58125881-58126012
  hyper
cctttcccagactttcgcccgccccaaatcctgaagttccaaatgaggagcgcctgtctgagtccctgcagcgcaggccccagtgtccaaggcagcggggcgctggtgggtgggggcgagtgtgactggca

SEQ ID NO: 23196 - DNA, 140 bp, Homo sapiens; identical to SEQ ID NO: 13579
  chr19:58175834-58175974
  hyper

SEQ ID NO: 23197 - DNA, 113 bp, Homo sapiens
  chr19:58239088-58239201
  hyper
gtagagtgtggttcccactgagctatccttcaaggcaggggattctcggcctgggctcttgggaaaactcgaagtaggagggccaagttgtttgggaaaagtaacccgagttt

SEQ ID NO: 23198 - DNA, 239 bp, Homo sapiens; identical to SEQ ID NO: 13585
  chr19:58281000-58281239
  hyper

SEQ ID NO: 23199 - DNA, 27 bp, Homo sapiens
  chr19:58400052-58400079
  hyper
agagccgtgaacaggcgctgctacctc

SEQ ID NO: 23200 - DNA, 11 bp, Homo sapiens
  chr19:58400406-58400417
  hyper
gccgccaccag

SEQ ID NO: 23201 - DNA, 41 bp, Homo sapiens; identical to SEQ ID NO: 13588
  chr19:58446443-58446484
  hyper

SEQ ID NO: 23202 - DNA, 31 bp, Homo sapiens
  chr19:58459201-58459232
  hyper
cgcctccacctccttccggaagtaaaggcca

SEQ ID NO: 23203 - DNA, 78 bp, Homo sapiens; identical to SEQ ID NO: 13590
  chr19:58513793-58513871
  hyper

SEQ ID NO: 23204 - DNA, 128 bp, Homo sapiens; identical to SEQ ID NO: 13591
  chr19:58514138-58514266
  hyper

SEQ ID NO: 23205 - DNA, 15 bp, Homo sapiens
  chr19:58521301-58521316
  hyper
cggcagtaccttgcc

SEQ ID NO: 23206 - DNA, 206 bp, Homo sapiens
  chr19:58662094-58662300
  hyper
gctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactt

SEQ ID NO: 23207 - DNA, 182 bp, Homo sapiens
  chr19:58666313-58666495
  hyper
cgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgc

SEQ ID NO: 23208 - DNA, 183 bp, Homo sapiens; identical to SEQ ID NO: 13601
  chr19:58666550-58666733
  hyper

SEQ ID NO: 23209 - DNA, 30 bp, Homo sapiens; identical to SEQ ID NO: 13602
  chr19:58694552-58694582
  hyper

SEQ ID NO: 23210 - DNA, 30 bp, Homo sapiens; identical to SEQ ID NO: 13603
  chr19:58695225-58695255
  hyper

SEQ ID NO: 23211 - DNA, 30 bp, Homo sapiens; identical to SEQ ID NO: 13604
  chr19:58951079-58951109
  hyper

SEQ ID NO: 23212 - DNA, 142 bp, Homo sapiens
  chr19:58951916-58952058
  hyper
tccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccc

SEQ ID NO: 23213 - DNA, 13 bp, Homo sapiens
  chr20:291135-291148
  hyper
cgttgccatagaa

SEQ ID NO: 23214 - DNA, 86 bp, Homo sapiens
  chr20:590348-590434
  hyper
acactcacccccttgcgctggttgctgaggcagaaggtgcagatggagcgcggctggcggccgccgtcggcggcggcggggacggc

SEQ ID NO: 23215 - DNA, 39 bp, Homo sapiens
  chr20:644787-644826
  hyper
cgcccgcctgcgcccccgcgcgccccgcgcgccccccgg

SEQ ID NO: 23216 - DNA, 320 bp, Homo sapiens; identical to SEQ ID NO: 1419
  chr20:644985-645305
  hyper

SEQ ID NO: 23217 - DNA, 139 bp, Homo sapiens; identical to SEQ ID NO: 13613
  chr20:656937-657076
  hyper

SEQ ID NO: 23218 - DNA, 47 bp, Homo sapiens; identical to SEQ ID NO: 13614
  chr20:708643-708690
  hyper

SEQ ID NO: 23219 - DNA, 22 bp, Homo sapiens
  chr20:982727-982749
  hyper
ccttgcttcttccttcggttca

SEQ ID NO: 23220 - DNA, 155 bp, Homo sapiens
  chr20:982989-983144
  hyper
gcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgc

SEQ ID NO: 23221 - DNA, 38 bp, Homo sapiens; identical to SEQ ID NO: 13617
  chr20:1783339-1783377
  hyper

SEQ ID NO: 23222 - DNA, 153 bp, Homo sapiens
  chr20:1783608-1783761
  hyper
gccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaaggg

SEQ ID NO: 23223 - DNA, 6 bp, Homo sapiens
  chr20:2668922-2668928
  hyper
gttctg

SEQ ID NO: 23224 - DNA, 35 bp, Homo sapiens; identical to SEQ ID NO: 13622
  chr20:2731640-2731675
  hyper

SEQ ID NO: 23225 - DNA, 260 bp, Homo sapiens
  chr20:2781452-2781712
  hyper
tcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattg

SEQ ID NO: 23226 - DNA, 30 bp, Homo sapiens; identical to SEQ ID NO: 13625
  chr20:2781916-2781946
  hyper

SEQ ID NO: 23227 - DNA, 43 bp, Homo sapiens
  chr20:3052540-3052583
  hyper
gcccttgaccgcggtcgaggcccccacggcgccccagcgcgtc

SEQ ID NO: 23228 - DNA, 237 bp, Homo sapiens
  chr20:3052836-3053073
  hyper
aactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatg

SEQ ID NO: 23229 - DNA, 73 bp, Homo sapiens; identical to SEQ ID NO: 13629
  chr20:3063708-3063781
  hyper

SEQ ID NO: 23230 - DNA, 107 bp, Homo sapiens; identical to SEQ ID NO: 4731
  chr20:3073285-3073392
  hyper

SEQ ID NO: 23231 - DNA, 58 bp, Homo sapiens; identical to SEQ ID NO: 13632
  chr20:3218776-3218834
  hyper

SEQ ID NO: 23232 - DNA, 19 bp, Homo sapiens
  chr20:3220874-3220893
  hyper
ggaacggggacaggccggg

SEQ ID NO: 23233 - DNA, 49 bp, Homo sapiens; identical to SEQ ID NO: 13636
  chr20:3662664-3662713
  hyper

SEQ ID NO: 23234 - DNA, 130 bp, Homo sapiens; identical to SEQ ID NO: 13638
  chr20:3713321-3713451
  hyper

SEQ ID NO: 23235 - DNA, 30 bp, Homo sapiens; identical to SEQ ID NO: 13639
  chr20:3759057-3759087
  hyper

SEQ ID NO: 23236 - DNA, 93 bp, Homo sapiens; identical to SEQ ID NO: 13640
  chr20:4202639-4202732
  hyper

SEQ ID NO: 23237 - DNA, 10 bp, Homo sapiens
  chr20:4229392-4229402
  hyper
tcccccgcgg

SEQ ID NO: 23238 - DNA, 73 bp, Homo sapiens
  chr20:4229432-4229505
  hyper
ccaccacgccgccgccgccgcccgcgccccccggcacgccgcccaccgccgggccctccgagggggccgcgcc

SEQ ID NO: 23239 - DNA, 230 bp, Homo sapiens
  chr20:4803650-4803880
  hyper
tagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggc

SEQ ID NO: 23240 - DNA, 148 bp, Homo sapiens
  chr20:5296900-5297048
  hyper
cccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcc

SEQ ID NO: 23241 - DNA, 223 bp, Homo sapiens; identical to SEQ ID NO: 13648
  chr20:6032982-6033205
  hyper

SEQ ID NO: 23242 - DNA, 256 bp, Homo sapiens; identical to SEQ ID NO: 13649
  chr20:6033206-6033462
  hyper

SEQ ID NO: 23243 - DNA, 43 bp, Homo sapiens
  chr20:8112335-8112378
  hyper
atgggctttctgtctcgaaagcacaacgtaaccgtttgcccgg

SEQ ID NO: 23244 - DNA, 204 bp, Homo sapiens
  chr20:8112408-8112612
  hyper
ggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagccca

SEQ ID NO: 23245 - DNA, 96 bp, Homo sapiens
  chr20:8113461-8113557
  hyper
gggtggggcaaggggcgcgttatgcaatgggcgcactgggagcgggcaggggcagcctcgggcgcacaggttggcatctgccaaagcggatgtcca

SEQ ID NO: 23246 - DNA, 44 bp, Homo sapiens
  chr20:9488332-9488376
  hyper
cctggcgggctggaccgggacagggggcggtgcgcaccggggct

SEQ ID NO: 23247 - DNA, 30 bp, Homo sapiens; identical to SEQ ID NO: 13658
  chr20:9496079-9496109
  hyper

SEQ ID NO: 23248 - DNA, 164 bp, Homo sapiens; identical to SEQ ID NO: 13660
  chr20:9819538-9819702
  hyper

SEQ ID NO: 23249 - DNA, 131 bp, Homo sapiens
  chr20:10198600-10198731
  hyper
agacacccagcatgaaaccccagcaccgactgcaaattccaccgaaagcagagtcatccgtttttgccctcggcaaacaactcaacttcaagcctcgagtccttgcaaacccacgctggctgggctaactc

SEQ ID NO: 23250 - DNA, 295 bp, Homo sapiens; identical to SEQ ID NO: 13663
  chr20:10199333-10199628
  hyper

SEQ ID NO: 23251 - DNA, 37 bp, Homo sapiens; identical to SEQ ID NO: 13664
  chr20:10200078-10200115
  hyper

SEQ ID NO: 23252 - DNA, 75 bp, Homo sapiens
  chr20:17208510-17208585
  hyper
cccacccccatcccccggagaaagaatagtttcctacagacgaggctggacgtttggacactgcaattcacctcg

SEQ ID NO: 23253 - DNA, 37 bp, Homo sapiens
  chr20:17208620-17208657
  hyper
cccagggacttcggtccctgctcctctccgggaacaa

SEQ ID NO: 23254 - DNA, 64 bp, Homo sapiens; identical to SEQ ID NO: 13668
  chr20:17208739-17208803
  hyper

SEQ ID NO: 23255 - DNA, 57 bp, Homo sapiens; identical to SEQ ID NO: 13669
  chr20:19192824-19192881
  hyper

SEQ ID NO: 23256 - DNA, 39 bp, Homo sapiens; identical to SEQ ID NO: 13671
  chr20:20344449-20344488
  hyper

SEQ ID NO: 23257 - DNA, 377 bp, Homo sapiens; identical to SEQ ID NO: 13672
  chr20:20344800-20345177
  hyper

SEQ ID NO: 23258 - DNA, 10 bp, Homo sapiens
  chr20:20346166-20346176
  hyper
gggtggtgaa

SEQ ID NO: 23259 - DNA, 127 bp, Homo sapiens
  chr20:20347333-20347460
  hyper
gggtgggggtgggggcggggggaatcttcgctgttgtctcttcctggtggcacaggggaggcggcttgtcctctcggaggcctcagcctgcctcagagtacagattgccccccctccccccgtccag

SEQ ID NO: 23260 - DNA, 68 bp, Homo sapiens
  chr20:20348154-20348222
  hyper
ttcccaaacaccacgcggagccactgcgcctccgcaacgatctcccccgcaccgccccggcgcgcccc

SEQ ID NO: 23261 - DNA, 26 bp, Homo sapiens
  chr20:20348257-20348283
  hyper
cggctccggctcgcggattgaaccct

SEQ ID NO: 23262 - DNA, 304 bp, Homo sapiens
  chr20:20348849-20349153
  hyper
gccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgca

SEQ ID NO: 23263 - DNA, 158 bp, Homo sapiens
  chr20:20349255-20349413
  hyper
cttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctca

SEQ ID NO: 23264 - DNA, 446 bp, Homo sapiens; identical to SEQ ID NO: 13678
  chr20:20349851-20350297
  hyper

SEQ ID NO: 23265 - DNA, 38 bp, Homo sapiens
  chr20:21080676-21080714
  hyper
gcctatcaattaccccgcccgcagtgaaagcgaaagcg

SEQ ID NO: 23266 - DNA, 279 bp, Homo sapiens
  chr20:21082253-21082532
  hyper
cgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgc

SEQ ID NO: 23267 - DNA, 39 bp, Homo sapiens
  chr20:21082917-21082956
  hyper
aaaagatcctggagctaaagcctgcgcctacaccagaga

SEQ ID NO: 23268 - DNA, 44 bp, Homo sapiens
  chr20:21085787-21085831
  hyper
caccgggtcccctttcgaatgccatttcccagctgaaaatccag

SEQ ID NO: 23269 - DNA, 288 bp, Homo sapiens
  chr20:21085864-21086152
  hyper
cctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggc

SEQ ID NO: 23270 - DNA, 6 bp, Homo sapiens
  chr20:21372725-21372731
  hyper
ctattc

SEQ ID NO: 23271 - DNA, 43 bp, Homo sapiens
  chr20:21376207-21376250
  hyper
ttttatagttacaaacgccaacaaagtttccaactttgagagc

SEQ ID NO: 23272 - DNA, 23 bp, Homo sapiens
  chr20:21378551-21378574
  hyper
tataattgcggaatggggaacgt

SEQ ID NO: 23273 - DNA, 416 bp, Homo sapiens
  chr20:21485959-21486375
  hyper
gtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgcc

SEQ ID NO: 23274 - DNA, 36 bp, Homo sapiens
  chr20:21486881-21486917
  hyper
cgaacacaggtcgactcgcacctcccaggcacccgc

SEQ ID NO: 23275 - DNA, 199 bp, Homo sapiens
  chr20:21486954-21487153
  hyper
cgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcg

SEQ ID NO: 23276 - DNA, 32 bp, Homo sapiens; identical to SEQ ID NO: 13699
  chr20:21488385-21488417
  hyper

SEQ ID NO: 23277 - DNA, 30 bp, Homo sapiens; identical to SEQ ID NO: 13700
  chr20:21488767-21488797
  hyper

SEQ ID NO: 23278 - DNA, 78 bp, Homo sapiens
  chr20:21493230-21493308
  hyper
ctggcagcccagccccgctgcctttgccatgacccctgccttcctctacgcctgacgaagacgtcgggacctcccagg

SEQ ID NO: 23279 - DNA, 59 bp, Homo sapiens
  chr20:21494703-21494762
  hyper
ccattgcccgagcgatcagtccatataaggctgggctccactcacgaacctggggaggc

SEQ ID NO: 23280 - DNA, 211 bp, Homo sapiens
  chr20:21498638-21498849
  hyper
aattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgct

SEQ ID NO: 23281 - DNA, 101 bp, Homo sapiens; identical to SEQ ID NO: 13714
  chr20:21499374-21499475
  hyper

SEQ ID NO: 23282 - DNA, 29 bp, Homo sapiens
  chr20:21501724-21501753
  hyper
ctaagggctggttccgggaaggacaggga

SEQ ID NO: 23283 - DNA, 147 bp, Homo sapiens
  chr20:21502443-21502590
  hyper
cgctccgccttctactcccggagctgcggcgacagccccgccgcatttcaaggcgcgtctttatctagtactccacctacccggacccccctcgctctgcgcccttcccccaccgcgcgccctaccaggcggggctcaggggaccgc

SEQ ID NO: 23284 - DNA, 125 bp, Homo sapiens
  chr20:21503773-21503898
  hyper
caaggtcgccatctataaattgctcggtcgctaagacgccataaaaccaaagggccagatgtggcacgttatttatgtgtgaaaccgcgtttacactagatacgcggatccaaggccgatagcac

SEQ ID NO: 23285 - DNA, 21 bp, Homo sapiens
  chr20:21503899-21503920
  hyper
acttcgcgggaggtcacagac

SEQ ID NO: 23286 - DNA, 121 bp, Homo sapiens
  chr20:21683651-21683772
  hyper
gctaagctgcctccttgggaggtgggagagacgtttcttttccttctgcaatctcatcttagggccatctctcaccaagcctagcctgcagctcgggaacccgcgatacccggccggggga

SEQ ID NO: 23287 - DNA, 17 bp, Homo sapiens
  chr20:21683899-21683916
  hyper
cgcggactctgctaccg

SEQ ID NO: 23288 - DNA, 51 bp, Homo sapiens
  chr20:21686184-21686235
  hyper
ggtagagtttcagggcggggaggggggcgctggggcgcagtgacgggaacc

SEQ ID NO: 23289 - DNA, 11 bp, Homo sapiens
  chr20:21689945-21689956
  hyper
gggcggcggct

SEQ ID NO: 23290 - DNA, 31 bp, Homo sapiens
  chr20:21694529-21694560
  hyper
caactgcctcctacgtcggaggaatccaggc

SEQ ID NO: 23291 - DNA, 25 bp, Homo sapiens
  chr20:21748491-21748516
  hyper
ccctcaaatgcgtgtttgccctgct

SEQ ID NO: 23292 - DNA, 14 bp, Homo sapiens
  chr20:22558669-22558683
  hyper
gtcaccatgctccg

SEQ ID NO: 23293 - DNA, 149 bp, Homo sapiens; identical to SEQ ID NO: 13736
  chr20:22567416-22567565
  hyper

SEQ ID NO: 23294 - DNA, 30 bp, Homo sapiens; identical to SEQ ID NO: 13739
  chr20:23030745-23030775
  hyper

SEQ ID NO: 23295 - DNA, 30 bp, Homo sapiens; identical to SEQ ID NO: 13740
  chr20:23031047-23031077
  hyper

SEQ ID NO: 23296 - DNA, 163 bp, Homo sapiens; identical to SEQ ID NO: 13741
  chr20:23031307-23031470
  hyper

SEQ ID NO: 23297 - DNA, 331 bp, Homo sapiens
  chr20:24449900-24450231
  hyper
gttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagag

SEQ ID NO: 23298 - DNA, 191 bp, Homo sapiens
  chr20:24450513-24450704
  hyper
tggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggaga

SEQ ID NO: 23299 - DNA, 24 bp, Homo sapiens
  chr20:24451426-24451450
  hyper
acgcagaggcttgggcgcttggca

SEQ ID NO: 23300 - DNA, 61 bp, Homo sapiens
  chr20:25062880-25062941
  hyper
gaccccgcgagatggggacgccaccagttcccctcccctcggttaccgcccacccagctgc

SEQ ID NO: 23301 - DNA, 53 bp, Homo sapiens
  chr20:25063727-25063780
  hyper
tattgtccaatttcacgattattcaaagaaagcctgattctttgaataatcag

SEQ ID NO: 23302 - DNA, 53 bp, Homo sapiens
  chr20:25064458-25064511
  hyper
aggcagggtagtcgattctaaggtggcccgaccggggtcgcccgcgaatggaa

SEQ ID NO: 23303 - DNA, 30 bp, Homo sapiens; identical to SEQ ID NO: 13753
  chr20:25064790-25064820
  hyper

SEQ ID NO: 23304 - DNA, 29 bp, Homo sapiens
  chr20:25129464-25129493
  hyper
cgcccatccccgtgcgcacgtgttcgctg

SEQ ID NO: 23305 - DNA, 206 bp, Homo sapiens; identical to SEQ ID NO: 13757
  chr20:25565991-25566197
  hyper

SEQ ID NO: 23306 - DNA, 1 bp, Homo sapiens
  chr20:26188811-26188812
  hyper
a

SEQ ID NO: 23307 - DNA, 19 bp, Homo sapiens
  chr20:26189582-26189601
  hyper
ggcccgcagaggcgctcag

SEQ ID NO: 23308 - DNA, 30 bp, Homo sapiens; identical to SEQ ID NO: 13760
  chr20:26189977-26190007
  hyper

SEQ ID NO: 23309 - DNA, 136 bp, Homo sapiens; identical to SEQ ID NO: 13761
  chr20:30063113-30063249
  hyper

SEQ ID NO: 23310 - DNA, 262 bp, Homo sapiens; identical to SEQ ID NO: 13762
  chr20:30063250-30063512
  hyper

SEQ ID NO: 23311 - DNA, 189 bp, Homo sapiens
  chr20:30639847-30640036
  hyper
atggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctg

SEQ ID NO: 23312 - DNA, 90 bp, Homo sapiens
  chr20:30640270-30640360
  hyper
acgaggagcgggcgcccaggtgagtgccgcgcacaggggaccgggaatacccggcccgcgaggggtcccaggaggcggagggagcccagg

SEQ ID NO: 23313 - DNA, 68 bp, Homo sapiens
  chr20:30777956-30778024
  hyper
cgccccccagcttctcgggcccgggccgcggggaccgtgcgcgcgtccccctcccgggcaaggccggg

SEQ ID NO: 23314 - DNA, 38 bp, Homo sapiens; identical to SEQ ID NO: 13769
  chr20:32804098-32804136
  hyper

SEQ ID NO: 23315 - DNA, 254 bp, Homo sapiens; identical to SEQ ID NO: 13770
  chr20:33146323-33146577
  hyper

SEQ ID NO: 23316 - DNA, 9 bp, Homo sapiens
  chr20:34188608-34188617
  hyper
ttctttttc

SEQ ID NO: 23317 - DNA, 101 bp, Homo sapiens
  chr20:34189391-34189492
  hyper
cctatggagccctatggaccgaggcgagtgaggccagatttgccgcggccagaagcgctcacccgcgcggcccggatgggagatccgcctcaggtccggca

SEQ ID NO: 23318 - DNA, 144 bp, Homo sapiens
  chr20:34189910-34190054
  hyper
cctaggggagggggcaccgagcggggggggagaaactgggatctcggcccctccccttatccgcgccccacggccacccccggatccatgtcctcctccccacctcaccccggctcacttctcgatgtccgaacagtgccctgg

SEQ ID NO: 23319 - DNA, 74 bp, Homo sapiens; identical to SEQ ID NO: 13775
  chr20:35491337-35491411
  hyper

SEQ ID NO: 23320 - DNA, 40 bp, Homo sapiens; identical to SEQ ID NO: 13776
  chr20:36013211-36013251
  hyper

SEQ ID NO: 23321 - DNA, 76 bp, Homo sapiens
  chr20:36531910-36531986
  hyper
aaccccaacccgggccgcgccactccaacttggccgccccggggctcgaaccggcgccagtcgtggcgggcatccc

SEQ ID NO: 23322 - DNA, 69 bp, Homo sapiens; identical to SEQ ID NO: 13778
  chr20:36888892-36888961
  hyper

SEQ ID NO: 23323 - DNA, 117 bp, Homo sapiens
  chr20:37302580-37302697
  hyper
tggagcctgatcactcggggtcttactggccacggtgaggagtcagggtttcatgcgcccctgcagtcagaaagcatggcccaaccccagtgccctaagtccggaaacattcaaagc

SEQ ID NO: 23324 - DNA, 33 bp, Homo sapiens
  chr20:37303343-37303376
  hyper
cgtcgcgcgctcgccccacgctaggaatgcaaa

SEQ ID NO: 23325 - DNA, 92 bp, Homo sapiens
  chr20:37351701-37351793
  hyper
acttccagtcacagccgctacttctccattcaggctgggactgccaggtggagccctgcggtttactgctcaggaggagcccggccaggaca

SEQ ID NO: 23326 - DNA, 216 bp, Homo sapiens
  chr20:37352977-37353193
  hyper
cgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtcca

SEQ ID NO: 23327 - DNA, 20 bp, Homo sapiens
  chr20:37353435-37353455
  hyper
gatgagcggcatgttcgcca

SEQ ID NO: 23328 - DNA, 339 bp, Homo sapiens
  chr20:37353806-37354145
  hyper
cgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaa

SEQ ID NO: 23329 - DNA, 30 bp, Homo sapiens
  chr20:37355202-37355232
  hyper
ccctacagccctgtccgcctgaccctgaag

SEQ ID NO: 23330 - DNA, 345 bp, Homo sapiens
  chr20:37355502-37355847
  hyper
accctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacc

SEQ ID NO: 23331 - DNA, 196 bp, Homo sapiens
  chr20:37357353-37357549
  hyper
agtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctct

SEQ ID NO: 23332 - DNA, 224 bp, Homo sapiens; identical to SEQ ID NO: 1473
  chr20:37434129-37434353
  hyper

SEQ ID NO: 23333 - DNA, 64 bp, Homo sapiens
  chr20:37434488-37434552
  hyper
cgggggatgaggatggggcggggaggtggtcccagcctgctatcacctagctgggggccggggc

SEQ ID NO: 23334 - DNA, 150 bp, Homo sapiens
  chr20:37434744-37434894
  hyper
gggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcg

SEQ ID NO: 23335 - DNA, 174 bp, Homo sapiens
  chr20:37434930-37435104
  hyper
cgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggc

SEQ ID NO: 23336 - DNA, 152 bp, Homo sapiens
  chr20:37435218-37435370
  hyper
gagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcc

SEQ ID NO: 23337 - DNA, 96 bp, Homo sapiens
  chr20:39316107-39316203
  hyper
gcgcggactactctccgggcagcaaagcagctgtcccggcttaacgcgcaaagttcagaaagccaggagtctccagatggccttggtgacttctcg

SEQ ID NO: 23338 - DNA, 13 bp, Homo sapiens
  chr20:39316322-39316335
  hyper
ccttagccaaggt

SEQ ID NO: 23339 - DNA, 175 bp, Homo sapiens
  chr20:39317392-39317567
  hyper
ttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcggg

SEQ ID NO: 23340 - DNA, 68 bp, Homo sapiens
  chr20:39319058-39319126
  hyper
gccccgttgaaattccgtgccccagcgttcgggggtgcccgtcggctgctccctgggccggaaggtcc

SEQ ID NO: 23341 - DNA, 112 bp, Homo sapiens
  chr20:39995034-39995146
  hyper
gcgggcaggtgggagcggcgacgcgcgcgggcccatccctccctcttcccgcccgccgcccgcccgcgcttacttgtgcggccccgggcgcagccgcgggcgccatcccgtc

SEQ ID NO: 23342 - DNA, 1 bp, Homo sapiens
  chr20:41817785-41817786
  hyper
a

SEQ ID NO: 23343 - DNA, 54 bp, Homo sapiens
  chr20:41818513-41818567
  hyper
tcctgcgttccaagccgaggcgcggcgcgaactgaggcgggaggctgggcgggg

SEQ ID NO: 23344 - DNA, 101 bp, Homo sapiens
  chr20:41818914-41819015
  hyper
gaagctgcagcagccgtttgaactcggggtggggaacaggtgaatgggggttcggtggcgagaagagggagggagggagcagccctcgcaactcaagataa

SEQ ID NO: 23345 - DNA, 102 bp, Homo sapiens; identical to SEQ ID NO: 13807
  chr20:42136090-42136192
  hyper

SEQ ID NO: 23346 - DNA, 63 bp, Homo sapiens
  chr20:42136411-42136474
  hyper
gaccttgcgtcccctgggcgccgcgccaccccgctccgtccagggcggcgagggctcaggtct

SEQ ID NO: 23347 - DNA, 56 bp, Homo sapiens
  chr20:42543698-42543754
  hyper
gctcccggggtcacacggggccgcgcacatcagccccgccgacgggcacgggcggc

SEQ ID NO: 23348 - DNA, 238 bp, Homo sapiens
  chr20:42543853-42544091
  hyper
tcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgt

SEQ ID NO: 23349 - DNA, 170 bp, Homo sapiens; identical to SEQ ID NO: 13811
  chr20:42587835-42588005
  hyper

SEQ ID NO: 23350 - DNA, 516 bp, Homo sapiens
  chr20:43438466-43438982
  hyper
gcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggcc

SEQ ID NO: 23351 - DNA, 110 bp, Homo sapiens
  chr20:43439022-43439132
  hyper
cggcggcccggggccgggccgaggctccgctgcggggctggcgggcgcggcggggccggcgggcgggccaggagctggcggcgcgcggagcccgaggcgcgctgtgctgc

SEQ ID NO: 23352 - DNA, 27 bp, Homo sapiens
  chr20:43439192-43439219
  hyper
gcggcgccccccgccggcagcgcgagg

SEQ ID NO: 23353 - DNA, 44 bp, Homo sapiens
  chr20:43439247-43439291
  hyper
cgtgccgccgggggagggggcgccgctgcggggcgtgggagccc

SEQ ID NO: 23354 - DNA, 1 bp, Homo sapiens
  chr20:43726629-43726630
  hyper
g

SEQ ID NO: 23355 - DNA, 24 bp, Homo sapiens
  chr20:43726764-43726788
  hyper
cgagtagcccgggttctccatggt

SEQ ID NO: 23356 - DNA, 30 bp, Homo sapiens; identical to SEQ ID NO: 13818
  chr20:44540105-44540135
  hyper

SEQ ID NO: 23357 - DNA, 37 bp, Homo sapiens; identical to SEQ ID NO: 13819
  chr20:44540652-44540689
  hyper

SEQ ID NO: 23358 - DNA, 233 bp, Homo sapiens; identical to SEQ ID NO: 13821
  chr20:44650230-44650463
  hyper

SEQ ID NO: 23359 - DNA, 47 bp, Homo sapiens; identical to SEQ ID NO: 13822
  chr20:44659209-44659256
  hyper

SEQ ID NO: 23360 - DNA, 72 bp, Homo sapiens
  chr20:44660877-44660949
  hyper
gcagggtctcgggccaggaagcccctattcctgtcccctgagcgccacccgcccccgcgaaggaggaggcgc

SEQ ID NO: 23361 - DNA, 29 bp, Homo sapiens
  chr20:44686762-44686791
  hyper
tgtacaggagacatcgcgtgtatttttaa

SEQ ID NO: 23362 - DNA, 41 bp, Homo sapiens; identical to SEQ ID NO: 13826
  chr20:44687186-44687227
  hyper

SEQ ID NO: 23363 - DNA, 4 bp, Homo sapiens
  chr20:44803122-44803126
  hyper
gccc

SEQ ID NO: 23364 - DNA, 2 bp, Homo sapiens
  chr20:44803172-44803174
  hyper
cg

SEQ ID NO: 23365 - DNA, 59 bp, Homo sapiens
  chr20:44803675-44803734
  hyper
cttgtggtggcgcctgagggtgaggatcagcagcaccagcactgcgagggggacagagg

SEQ ID NO: 23366 - DNA, 91 bp, Homo sapiens
  chr20:44880076-44880167
  hyper
acgggcccgcggccctgaacgccgcccagccgcgggggtacccggctggagggggagggggcgcggccgcatccggggcatggacagcccc

SEQ ID NO: 23367 - DNA, 157 bp, Homo sapiens; identical to SEQ ID NO: 13830
  chr20:44936314-44936471
  hyper

SEQ ID NO: 23368 - DNA, 18 bp, Homo sapiens
  chr20:44941500-44941518
  hyper
gcccttggctgggggcgc

SEQ ID NO: 23369 - DNA, 71 bp, Homo sapiens; identical to SEQ ID NO: 13832
  chr20:45141858-45141929
  hyper

SEQ ID NO: 23370 - DNA, 410 bp, Homo sapiens; identical to SEQ ID NO: 13836
  chr20:45523248-45523658
  hyper

SEQ ID NO: 23371 - DNA, 140 bp, Homo sapiens; identical to SEQ ID NO: 13837
  chr20:45523893-45524033
  hyper

SEQ ID NO: 23372 - DNA, 25 bp, Homo sapiens
  chr20:45524553-45524578
  hyper
gagttgacagcgtgcaccctgccgc

SEQ ID NO: 23373 - DNA, 10 bp, Homo sapiens
  chr20:47443719-47443729
  hyper
atcctactcc

SEQ ID NO: 23374 - DNA, 146 bp, Homo sapiens
  chr20:47444282-47444428
  hyper
ccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttc

SEQ ID NO: 23375 - DNA, 129 bp, Homo sapiens; identical to SEQ ID NO: 4825
  chr20:47444452-47444581
  hyper

SEQ ID NO: 23376 - DNA, 184 bp, Homo sapiens; identical to SEQ ID NO: 4826
  chr20:47444609-47444793
  hyper

SEQ ID NO: 23377 - DNA, 295 bp, Homo sapiens; identical to SEQ ID NO: 4827
  chr20:47444920-47445215
  hyper

SEQ ID NO: 23378 - DNA, 227 bp, Homo sapiens
  chr20:47935268-47935495
  hyper
ggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctc

SEQ ID NO: 23379 - DNA, 27 bp, Homo sapiens
  chr20:47935567-47935594
  hyper
gagcacaagaggcgcaggcaggaagga

SEQ ID NO: 23380 - DNA, 30 bp, Homo sapiens; identical to SEQ ID NO: 13848
  chr20:48099143-48099173
  hyper

SEQ ID NO: 23381 - DNA, 30 bp, Homo sapiens; identical to SEQ ID NO: 13849
  chr20:48099543-48099573
  hyper

SEQ ID NO: 23382 - DNA, 171 bp, Homo sapiens
  chr20:48184435-48184606
  hyper
cccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagc

SEQ ID NO: 23383 - DNA, 54 bp, Homo sapiens; identical to SEQ ID NO: 13851
  chr20:48788965-48789019
  hyper

SEQ ID NO: 23384 - DNA, 255 bp, Homo sapiens; identical to SEQ ID NO: 13852
  chr20:49639257-49639512
  hyper

SEQ ID NO: 23385 - DNA, 3 bp, Homo sapiens
  chr20:49639774-49639777
  hyper
tcg

SEQ ID NO: 23386 - DNA, 48 bp, Homo sapiens; identical to SEQ ID NO: 13855
  chr20:49836918-49836966
  hyper

SEQ ID NO: 23387 - DNA, 30 bp, Homo sapiens; identical to SEQ ID NO: 13856
  chr20:50157990-50158020
  hyper

SEQ ID NO: 23388 - DNA, 30 bp, Homo sapiens; identical to SEQ ID NO: 13857
  chr20:50158389-50158419
  hyper

SEQ ID NO: 23389 - DNA, 45 bp, Homo sapiens
  chr20:50720392-50720437
  hyper
aacatataagctattcgtttagtggaggcttcattaaactactcc

SEQ ID NO: 23390 - DNA, 48 bp, Homo sapiens; identical to SEQ ID NO: 13863
  chr20:53091752-53091800
  hyper

SEQ ID NO: 23391 - DNA, 26 bp, Homo sapiens
  chr20:53092166-53092192
  hyper
gctggatccctcagccgccgccgctc

SEQ ID NO: 23392 - DNA, 32 bp, Homo sapiens; identical to SEQ ID NO: 13867
  chr20:53092763-53092795
  hyper

SEQ ID NO: 23393 - DNA, 30 bp, Homo sapiens; identical to SEQ ID NO: 13868
  chr20:53093219-53093249
  hyper

SEQ ID NO: 23394 - DNA, 199 bp, Homo sapiens
  chr20:54580323-54580522
  hyper
gctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcc

SEQ ID NO: 23395 - DNA, 65 bp, Homo sapiens; identical to SEQ ID NO: 13872
  chr20:54919287-54919352
  hyper

SEQ ID NO: 23396 - DNA, 137 bp, Homo sapiens
  chr20:55199898-55200035
  hyper
actgaagaagtcctacgtaccgcttgtcatatacatatgtaaagataatttaaaaccctagggtatacccttttcaaatgcagagtttatagtttccaaggggaggagggcaggggaggagtaaccaggacctttcc

SEQ ID NO: 23397 - DNA, 7 bp, Homo sapiens
  chr20:55200706-55200713
  hyper
ccccccg

SEQ ID NO: 23398 - DNA, 265 bp, Homo sapiens
  chr20:55201092-55201357
  hyper
atctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccc

SEQ ID NO: 23399 - DNA, 2 bp, Homo sapiens
  chr20:55201450-55201452
  hyper
gg

SEQ ID NO: 23400 - DNA, 187 bp, Homo sapiens
  chr20:55204135-55204322
  hyper
ggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatt

SEQ ID NO: 23401 - DNA, 28 bp, Homo sapiens
  chr20:55204938-55204966
  hyper
ctcggaaaagtgccccgtctgcaaccct

SEQ ID NO: 23402 - DNA, 73 bp, Homo sapiens; identical to SEQ ID NO: 13883
  chr20:55499791-55499864
  hyper

SEQ ID NO: 23403 - DNA, 39 bp, Homo sapiens; identical to SEQ ID NO: 13886
  chr20:55501052-55501091
  hyper

SEQ ID NO: 23404 - DNA, 27 bp, Homo sapiens
  chr20:56803371-56803398
  hyper
cggcagtttgccactcggaacatctcc

SEQ ID NO: 23405 - DNA, 401 bp, Homo sapiens
  chr20:56803441-56803842
  hyper
ccaagtcgggcaaggcactcgcggccttcgggtcacagacgagccgctggctccggccgcgggcacaggccaggggctgcgcggggagggcccgcgagtccgccgagcccaccctgggcccgccgcacccctgagccccggcccgcgcaccgctcctgcgtcccgcattggggtgcaggcgagaggcgcccccagttggccccgccgcccgcgctccgcccgcccccgccgccgcccgccgcatcccccaggcgcggccgcgcgtcatccgcggctcgagtgcggtggccacgcgtcatcgccgcccccgccctgacgccccaaggcgggcccatgcgccccccgccccactgtgacgcccaggccccgccaggaccgccccctccagacgcaaggcgagg

SEQ ID NO: 23406 - DNA, 205 bp, Homo sapiens
  chr20:56803920-56804125
  hyper
ctccgcgatgaacaaagccgcagtttcacgcggccgcgggagacggttcttaaataatggaacaggacataagtgcttcccagagcaaccgggagatttattgataaatacagagacatcgccgggcagccacgctccgacaacccgcactgggcccccgtcccgagctcaggccacgtccccacctcctcgaagcctccaagct

SEQ ID NO: 23407 - DNA, 26 bp, Homo sapiens
  chr20:57224816-57224842
  hyper
gcccagccctgctcgcggctctctcg

SEQ ID NO: 23408 - DNA, 88 bp, Homo sapiens
  chr20:57225307-57225395
  hyper
ccccgacccgctccggccgcgcgctgggccaggcccttggcctcaagcctcccgggcggctccgggccggacccgggtctccgtcgcg

SEQ ID NO: 23409 - DNA, 109 bp, Homo sapiens; identical to SEQ ID NO: 13890
  chr20:57875719-57875828
  hyper

SEQ ID NO: 23410 - DNA, 60 bp, Homo sapiens; identical to SEQ ID NO: 13891
  chr20:58179203-58179263
  hyper

SEQ ID NO: 23411 - DNA, 106 bp, Homo sapiens; identical to SEQ ID NO: 13893
  chr20:58180470-58180576
  hyper

SEQ ID NO: 23412 - DNA, 30 bp, Homo sapiens; identical to SEQ ID NO: 13894
  chr20:58508817-58508847
  hyper

SEQ ID NO: 23413 - DNA, 147 bp, Homo sapiens; identical to SEQ ID NO: 13897
  chr20:59829066-59829213
  hyper

SEQ ID NO: 23414 - DNA, 396 bp, Homo sapiens; identical to SEQ ID NO: 13898
  chr20:61339658-61340054
  hyper

SEQ ID NO: 23415 - DNA, 277 bp, Homo sapiens
  chr20:61340304-61340581
  hyper
cagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgc

SEQ ID NO: 23416 - DNA, 79 bp, Homo sapiens; identical to SEQ ID NO: 13900
  chr20:61447684-61447763
  hyper

SEQ ID NO: 23417 - DNA, 332 bp, Homo sapiens; identical to SEQ ID NO: 13903
  chr20:61585342-61585674
  hyper

SEQ ID NO: 23418 - DNA, 187 bp, Homo sapiens
  chr20:61637281-61637468
  hyper
cgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcag

SEQ ID NO: 23419 - DNA, 21 bp, Homo sapiens
  chr20:61638631-61638652
  hyper
ccctagcgcaagagtccctgg

SEQ ID NO: 23420 - DNA, 160 bp, Homo sapiens
  chr20:61703875-61704035
  hyper
tcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctca

SEQ ID NO: 23421 - DNA, 180 bp, Homo sapiens; identical to SEQ ID NO: 13910
  chr20:61733260-61733440
  hyper

SEQ ID NO: 23422 - DNA, 346 bp, Homo sapiens; identical to SEQ ID NO: 13911
  chr20:61733715-61734061
  hyper

SEQ ID NO: 23423 - DNA, 49 bp, Homo sapiens
  chr20:61747845-61747894
  hyper
agctgcagggagctgcgcggggggagccgcagagctgggcacttgcgaa

SEQ ID NO: 23424 - DNA, 357 bp, Homo sapiens; identical to SEQ ID NO: 13913
  chr20:61806443-61806800
  hyper

SEQ ID NO: 23425 - DNA, 133 bp, Homo sapiens; identical to SEQ ID NO: 13914
  chr20:61807785-61807918
  hyper

SEQ ID NO: 23426 - DNA, 111 bp, Homo sapiens
  chr20:61808270-61808381
  hyper
atcccggtctgaaactgtgagaaccgcaagctccgatgggggcggggaaggacgacctttaattcccaccccactgtacggagcccagcagggccatccgcaggaggccgg

SEQ ID NO: 23427 - DNA, 46 bp, Homo sapiens
  chr20:61810089-61810135
  hyper
gccggggatctggccgcgggacacaaaggggcccgcacgcctctgg

SEQ ID NO: 23428 - DNA, 7 bp, Homo sapiens
  chr20:61862452-61862459
  hyper
ggtgcct

SEQ ID NO: 23429 - DNA, 265 bp, Homo sapiens; identical to SEQ ID NO: 4857
  chr20:61884691-61884956
  hyper

SEQ ID NO: 23430 - DNA, 38 bp, Homo sapiens
  chr20:61886030-61886068
  hyper
ccgttcttaaaggggcgatggcgcggcctctcgggtag

SEQ ID NO: 23431 - DNA, 49 bp, Homo sapiens; identical to SEQ ID NO: 13924
  chr20:62103577-62103626
  hyper

SEQ ID NO: 23432 - DNA, 91 bp, Homo sapiens; identical to SEQ ID NO: 13925
  chr20:62103667-62103758
  hyper

SEQ ID NO: 23433 - DNA, 150 bp, Homo sapiens
  chr20:62461475-62461625
  hyper
tccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattcccc

SEQ ID NO: 23434 - DNA, 101 bp, Homo sapiens; identical to SEQ ID NO: 13928
  chr20:62947884-62947985
  hyper

SEQ ID NO: 23435 - DNA, 157 bp, Homo sapiens; identical to SEQ ID NO: 13929
  chr20:62948007-62948164
  hyper

SEQ ID NO: 23436 - DNA, 215 bp, Homo sapiens; identical to SEQ ID NO: 13930
  chr21:15588524-15588739
  hyper

SEQ ID NO: 23437 - DNA, 24 bp, Homo sapiens
  chr21:22370664-22370688
  hyper
ttctgccgccgctgccgccgccgc

SEQ ID NO: 23438 - DNA, 27 bp, Homo sapiens
  chr21:27012346-27012373
  hyper
gaaacccagggtgcccgcgagcggacg

SEQ ID NO: 23439 - DNA, 277 bp, Homo sapiens
  chr21:27012431-27012708
  hyper
gttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaa

SEQ ID NO: 23440 - DNA, 82 bp, Homo sapiens
  chr21:27944913-27944995
  hyper
caaatcccctaaacacgagactgctatttccaaggtggaaagggaaagaaaagaaatgcaaaaggtaaaagttaaaggaaaa

SEQ ID NO: 23441 - DNA, 67 bp, Homo sapiens
  chr21:27945081-27945148
  hyper
ttctgcaaaggtcccggtccgtccagctcaacccacgttagcccggaccgtgacccaagggcagccc

SEQ ID NO: 23442 - DNA, 81 bp, Homo sapiens; identical to SEQ ID NO: 13938
  chr21:28218267-28218348
  hyper

SEQ ID NO: 23443 - DNA, 30 bp, Homo sapiens; identical to SEQ ID NO: 13939
  chr21:28218688-28218718
  hyper

SEQ ID NO: 23444 - DNA, 30 bp, Homo sapiens
  chr21:28340318-28340348
  hyper
tcttagagggaattccgctcattttttttc

SEQ ID NO: 23445 - DNA, 81 bp, Homo sapiens
  chr21:31311553-31311634
  hyper
tgtgtagcctcccatgagcactgacctccaccttccccagctccggctcctgcgccgccgcgcgctgcctcgcccgggacc

SEQ ID NO: 23446 - DNA, 76 bp, Homo sapiens
  chr21:31312105-31312181
  hyper
ggagcccagagaccagctgaggaaagttgctgccccgatctgcaggaacgtctccctcattcgtcctttggtcaga

SEQ ID NO: 23447 - DNA, 207 bp, Homo sapiens; identical to SEQ ID NO: 13945
  chr21:32716260-32716467
  hyper

SEQ ID NO: 23448 - DNA, 508 bp, Homo sapiens
  chr21:34392566-34393074
  hyper
ggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctg

SEQ ID NO: 23449 - DNA, 472 bp, Homo sapiens
  chr21:34396269-34396741
  hyper
ccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaa

SEQ ID NO: 23450 - DNA, 33 bp, Homo sapiens; identical to SEQ ID NO: 13949
  chr21:34397670-34397703
  hyper

SEQ ID NO: 23451 - DNA, 80 bp, Homo sapiens
  chr21:34397990-34398070
  hyper
tccccaagaatctcccggccacgggcgcccattggttgtgcgcagggaggaggcgtgtgcccggcctggcgagtttcatt

SEQ ID NO: 23452 - DNA, 18 bp, Homo sapiens
  chr21:34401167-34401185
  hyper
taagctgtttgctcacgt

SEQ ID NO: 23453 - DNA, 58 bp, Homo sapiens; identical to SEQ ID NO: 13958
  chr21:34442191-34442249
  hyper

SEQ ID NO: 23454 - DNA, 438 bp, Homo sapiens
  chr21:34442665-34443103
  hyper
caggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgcc

SEQ ID NO: 23455 - DNA, 247 bp, Homo sapiens
  chr21:34443262-34443509
  hyper
cggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtc

SEQ ID NO: 23456 - DNA, 182 bp, Homo sapiens
  chr21:34443981-34444163
  hyper
cggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttaga

SEQ ID NO: 23457 - DNA, 52 bp, Homo sapiens
  chr21:36041933-36041985
  hyper
actgaggccgaggagggagccccggagggtgccgaggtgccccaaggagggg

SEQ ID NO: 23458 - DNA, 77 bp, Homo sapiens
  chr21:36042238-36042315
  hyper
ccgggtgggggacagcgtagacgcggaaggtccggcgggggacagcgtagacgcggagggcccgctgggggacaaca

SEQ ID NO: 23459 - DNA, 26 bp, Homo sapiens
  chr21:36042632-36042658
  hyper
ggggagagtgcggggcgcagccccgg

SEQ ID NO: 23460 - DNA, 293 bp, Homo sapiens
  chr21:36042861-36043154
  hyper
aatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaaccc

SEQ ID NO: 23461 - DNA, 156 bp, Homo sapiens
  chr21:38065799-38065955
  hyper
cggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgaccc

SEQ ID NO: 23462 - DNA, 30 bp, Homo sapiens; identical to SEQ ID NO: 13968
  chr21:38066830-38066860
  hyper

SEQ ID NO: 23463 - DNA, 256 bp, Homo sapiens
  chr21:38069203-38069459
  hyper
tatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccggg

SEQ ID NO: 23464 - DNA, 52 bp, Homo sapiens
  chr21:38069496-38069548
  hyper
cgcattaaatcctcccgaagcccaggaggtgccagagcgggctcagggggcc

SEQ ID NO: 23465 - DNA, 124 bp, Homo sapiens
  chr21:38070581-38070705
  hyper
cacctgcgccacctgcgcccaccctgtgaccctggctcagcgaccttggcccttaatcgcccaacgccgattcctcaaaattccggctgcgctgaatcgggctgcttttgccgccgccccggca

SEQ ID NO: 23466 - DNA, 71 bp, Homo sapiens; identical to SEQ ID NO: 13972
  chr21:38072282-38072353
  hyper

SEQ ID NO: 23467 - DNA, 80 bp, Homo sapiens
  chr21:38072927-38073007
  hyper
agtcagcggggatcacggtgaggcccaagcactgcaggctgaggccacagagcgaacacttgtgctgagccgggccctct

SEQ ID NO: 23468 - DNA, 100 bp, Homo sapiens
  chr21:38073070-38073170
  hyper
acccggctgaaagagaggggtccgattaattcgaaaatggcagacagagctgagcgctgccgttcttttcaggattgaaaatgtgccagtgggccagggg

SEQ ID NO: 23469 - DNA, 61 bp, Homo sapiens
  chr21:38073239-38073300
  hyper
cgcccacgccggttgccgctggtgacagtggctgcccggccaggcacctccgagcagcagg

SEQ ID NO: 23470 - DNA, 35 bp, Homo sapiens; identical to SEQ ID NO: 13975
  chr21:38076386-38076421
  hyper

SEQ ID NO: 23471 - DNA, 56 bp, Homo sapiens
  chr21:38079932-38079988
  hyper
aagggtttgcgaagccgctgccctgggccgaggtgcattttacgcttccagaggtc

SEQ ID NO: 23472 - DNA, 11 bp, Homo sapiens
  chr21:38081835-38081846
  hyper
gtcaagtgctt

SEQ ID NO: 23473 - DNA, 45 bp, Homo sapiens; identical to SEQ ID NO: 13980
  chr21:38082684-38082729
  hyper

SEQ ID NO: 23474 - DNA, 150 bp, Homo sapiens
  chr21:38119754-38119904
  hyper
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttg

SEQ ID NO: 23475 - DNA, 23 bp, Homo sapiens
  chr21:38120312-38120335
  hyper
agccccgccgccacctccccgcc

SEQ ID NO: 23476 - DNA, 30 bp, Homo sapiens; identical to SEQ ID NO: 13983
  chr21:38593435-38593465
  hyper

SEQ ID NO: 23477 - DNA, 160 bp, Homo sapiens; identical to SEQ ID NO: 4881
  chr21:39286695-39286855
  hyper

SEQ ID NO: 23478 - DNA, 37 bp, Homo sapiens; identical to SEQ ID NO: 13985
  chr21:39288011-39288048
  hyper

SEQ ID NO: 23479 - DNA, 30 bp, Homo sapiens; identical to SEQ ID NO: 13986
  chr21:39288362-39288392
  hyper

SEQ ID NO: 23480 - DNA, 32 bp, Homo sapiens; identical to SEQ ID NO: 13987
  chr21:40032174-40032206
  hyper

SEQ ID NO: 23481 - DNA, 73 bp, Homo sapiens; identical to SEQ ID NO: 13988
  chr21:40033138-40033211
  hyper

SEQ ID NO: 23482 - DNA, 241 bp, Homo sapiens; identical to SEQ ID NO: 13989
  chr21:42688845-42689086
  hyper

SEQ ID NO: 23483 - DNA, 56 bp, Homo sapiens; identical to SEQ ID NO: 13990
  chr21:42878736-42878792
  hyper

SEQ ID NO: 23484 - DNA, 38 bp, Homo sapiens; identical to SEQ ID NO: 1512
  chr21:44494740-44494778
  hyper

SEQ ID NO: 23485 - DNA, 282 bp, Homo sapiens; identical to SEQ ID NO: 13994
  chr21:44495327-44495609
  hyper

SEQ ID NO: 23486 - DNA, 218 bp, Homo sapiens; identical to SEQ ID NO: 13995
  chr21:44496505-44496723
  hyper

SEQ ID NO: 23487 - DNA, 48 bp, Homo sapiens
  chr21:44847543-44847591
  hyper
cgcgcgtggggctggcggcgcggatgccctggggcgctgcagaccccg

SEQ ID NO: 23488 - DNA, 152 bp, Homo sapiens
  chr21:44847622-44847774
  hyper
cttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgc

SEQ ID NO: 23489 - DNA, 225 bp, Homo sapiens
  chr21:45148390-45148615
  hyper
ttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggag

SEQ ID NO: 23490 - DNA, 64 bp, Homo sapiens; identical to SEQ ID NO: 13999
  chr21:45148943-45149007
  hyper

SEQ ID NO: 23491 - DNA, 51 bp, Homo sapiens; identical to SEQ ID NO: 14000
  chr21:45875681-45875732
  hyper

SEQ ID NO: 23492 - DNA, 211 bp, Homo sapiens; identical to SEQ ID NO: 14003
  chr21:46127234-46127445
  hyper

SEQ ID NO: 23493 - DNA, 30 bp, Homo sapiens; identical to SEQ ID NO: 14004
  chr21:46128279-46128309
  hyper

SEQ ID NO: 23494 - DNA, 107 bp, Homo sapiens; identical to SEQ ID NO: 4887
  chr21:46128961-46129068
  hyper

SEQ ID NO: 23495 - DNA, 37 bp, Homo sapiens; identical to SEQ ID NO: 14006
  chr21:46129376-46129413
  hyper

SEQ ID NO: 23496 - DNA, 40 bp, Homo sapiens; identical to SEQ ID NO: 14007
  chr21:46352791-46352831
  hyper

SEQ ID NO: 23497 - DNA, 85 bp, Homo sapiens; identical to SEQ ID NO: 14008
  chr21:46825637-46825722
  hyper

SEQ ID NO: 23498 - DNA, 30 bp, Homo sapiens
  chr21:47010451-47010481
  hyper
ggtcggcggcgtcagcggcagctcccagac

SEQ ID NO: 23499 - DNA, 288 bp, Homo sapiens
  chr21:47063962-47064250
  hyper
cggcccggggcagcgaggggactcgcgctccctcaaggtgcggtcgccaggcctggcccgcccgcctccgccccctccccaaattcggaagttgcggcgggaagccgagaacgtctcggatgtgggtcagaaaacgtctggactacttgaggcttcagtttcaaaacggcacaaatttcatctcttgattgagaagagatctggggaacaccccggagcggccgcggcggctggagggcggcggggcggggcgcggggcctcctccccctggacggccgccgggagag

SEQ ID NO: 23500 - DNA, 250 bp, Homo sapiens; identical to SEQ ID NO: 14012
  chr21:47518063-47518313
  hyper

SEQ ID NO: 23501 - DNA, 163 bp, Homo sapiens; identical to SEQ ID NO: 14014
  chr21:48087336-48087499
  hyper

SEQ ID NO: 23502 - DNA, 30 bp, Homo sapiens; identical to SEQ ID NO: 14017
  chr22:17084014-17084044
  hyper

SEQ ID NO: 23503 - DNA, 119 bp, Homo sapiens
  chr22:17600967-17601086
  hyper
cgtggtgccgaagggcgcgcgtagctcgatgaggtctaggatggacgtgcccaggatcagcaccaccttgggagtgaaggcgatggagtagataagccaggccaggtaggcgaaggcga

SEQ ID NO: 23504 - DNA, 34 bp, Homo sapiens
  chr22:17601368-17601402
  hyper
ggtccagcaggccgccctgcgccagcagcagcac

SEQ ID NO: 23505 - DNA, 206 bp, Homo sapiens; identical to SEQ ID NO: 14020
  chr22:17849555-17849761
  hyper

SEQ ID NO: 23506 - DNA, 136 bp, Homo sapiens
  chr22:17850318-17850454
  hyper
ggggagggctagccccgctctggcgggcgggcgcgtggcaggggctcccggaggccccgagctcccgggaggcgctccggccaacttcgggccggtggggaccgggcctgggcgcggggctctgaaggtgtggaag

SEQ ID NO: 23507 - DNA, 53 bp, Homo sapiens; identical to SEQ ID NO: 4894
  chr22:17850978-17851031
  hyper

SEQ ID NO: 23508 - DNA, 190 bp, Homo sapiens; identical to SEQ ID NO: 14023
  chr22:19016914-19017104
  hyper

SEQ ID NO: 23509 - DNA, 213 bp, Homo sapiens
  chr22:19017319-19017532
  hyper
cgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagcc

SEQ ID NO: 23510 - DNA, 12 bp, Homo sapiens
  chr22:19017567-19017579
  hyper
ccctgccgcgga

SEQ ID NO: 23511 - DNA, 282 bp, Homo sapiens
  chr22:19511567-19511849
  hyper
gcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgg

SEQ ID NO: 23512 - DNA, 67 bp, Homo sapiens; identical to SEQ ID NO: 1519
  chr22:19512252-19512319
  hyper

SEQ ID NO: 23513 - DNA, 15 bp, Homo sapiens
  chr22:19512376-19512391
  hyper
cgtagaggccctcgt

SEQ ID NO: 23514 - DNA, 145 bp, Homo sapiens; identical to SEQ ID NO: 14032
  chr22:19742613-19742758
  hyper

SEQ ID NO: 23515 - DNA, 46 bp, Homo sapiens
  chr22:19742788-19742834
  hyper
cgcggttcttctctcggcttggcggctggggtccgacgaaggggca

SEQ ID NO: 23516 - DNA, 109 bp, Homo sapiens; identical to SEQ ID NO: 14035
  chr22:20791235-20791344
  hyper

SEQ ID NO: 23517 - DNA, 30 bp, Homo sapiens; identical to SEQ ID NO: 14036
  chr22:20791681-20791711
  hyper

SEQ ID NO: 23518 - DNA, 30 bp, Homo sapiens; identical to SEQ ID NO: 14037
  chr22:21319768-21319798
  hyper

SEQ ID NO: 23519 - DNA, 90 bp, Homo sapiens
  chr22:22862697-22862787
  hyper
ggcccgggcccagcccgggggtgggggcgtctgcgtgagggagtggaggctgatgtaaaagtggcgcccgctgagattagggaagggggt

SEQ ID NO: 23520 - DNA, 88 bp, Homo sapiens; identical to SEQ ID NO: 4903
  chr22:22863219-22863307
  hyper

SEQ ID NO: 23521 - DNA, 30 bp, Homo sapiens; identical to SEQ ID NO: 14040
  chr22:23908209-23908239
  hyper

SEQ ID NO: 23522 - DNA, 30 bp, Homo sapiens; identical to SEQ ID NO: 14041
  chr22:23908658-23908688
  hyper

SEQ ID NO: 23523 - DNA, 147 bp, Homo sapiens
  chr22:24180540-24180687
  hyper
tcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccg

SEQ ID NO: 23524 - DNA, 228 bp, Homo sapiens
  chr22:24180766-24180994
  hyper
agaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 23525 - DNA, 390 bp, Homo sapiens; identical to SEQ ID NO: 14043
  chr22:24181054-24181444
  hyper

SEQ ID NO: 23526 - DNA, 258 bp, Homo sapiens; identical to SEQ ID NO: 4904
  chr22:25678357-25678615
  hyper

SEQ ID NO: 23527 - DNA, 132 bp, Homo sapiens
  chr22:25678616-25678748
  hyper
ctgggactgtgcgctgaggtgcaccgaccgtcgggccgcgagctccccgcagaccctcgcggaatgagctggggggcggcgcgcgaggcggcggagcggaaggcgcactgcgaccccggcgggctacagcct

SEQ ID NO: 23528 - DNA, 128 bp, Homo sapiens
  chr22:25679337-25679465
  hyper
gccctgtcctgtcctgtcccatccccgtggttcttcctgttgcattggtgtggtccctgtgggctcgttgcctgtcactcctttgcgctccttcttggtcgctgcttcttccccggctctgtggtccc

SEQ ID NO: 23529 - DNA, 194 bp, Homo sapiens
  chr22:25816913-25817107
  hyper
gccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggc

SEQ ID NO: 23530 - DNA, 278 bp, Homo sapiens
  chr22:25817180-25817458
  hyper
ccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtc

SEQ ID NO: 23531 - DNA, 39 bp, Homo sapiens
  chr22:25817612-25817651
  hyper
ccctgtcctctcctgtcccatccccgtggttctacctgt

SEQ ID NO: 23532 - DNA, 30 bp, Homo sapiens; identical to SEQ ID NO: 14049
  chr22:26564863-26564893
  hyper

SEQ ID NO: 23533 - DNA, 177 bp, Homo sapiens; identical to SEQ ID NO: 14050
  chr22:26565184-26565361
  hyper

SEQ ID NO: 23534 - DNA, 131 bp, Homo sapiens; identical to SEQ ID NO: 14051
  chr22:26565502-26565633
  hyper

SEQ ID NO: 23535 - DNA, 36 bp, Homo sapiens; identical to SEQ ID NO: 14052
  chr22:26565935-26565971
  hyper

SEQ ID NO: 23536 - DNA, 129 bp, Homo sapiens; identical to SEQ ID NO: 14053
  chr22:27053864-27053993
  hyper

SEQ ID NO: 23537 - DNA, 33 bp, Homo sapiens; identical to SEQ ID NO: 14054
  chr22:28197337-28197370
  hyper

SEQ ID NO: 23538 - DNA, 91 bp, Homo sapiens; identical to SEQ ID NO: 14055
  chr22:28198065-28198156
  hyper

SEQ ID NO: 23539 - DNA, 30 bp, Homo sapiens; identical to SEQ ID NO: 14056
  chr22:28198371-28198401
  hyper

SEQ ID NO: 23540 - DNA, 147 bp, Homo sapiens
  chr22:28838292-28838439
  hyper
cccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggct

SEQ ID NO: 23541 - DNA, 40 bp, Homo sapiens; identical to SEQ ID NO: 14058
  chr22:29075517-29075557
  hyper

SEQ ID NO: 23542 - DNA, 53 bp, Homo sapiens; identical to SEQ ID NO: 14059
  chr22:29076122-29076175
  hyper

SEQ ID NO: 23543 - DNA, 42 bp, Homo sapiens; identical to SEQ ID NO: 14060
  chr22:29426589-29426631
  hyper

SEQ ID NO: 23544 - DNA, 30 bp, Homo sapiens; identical to SEQ ID NO: 14061
  chr22:29876013-29876043
  hyper

SEQ ID NO: 23545 - DNA, 271 bp, Homo sapiens
  chr22:29876952-29877223
  hyper
ccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccgga

SEQ ID NO: 23546 - DNA, 114 bp, Homo sapiens; identical to SEQ ID NO: 14063
  chr22:30116044-30116158
  hyper

SEQ ID NO: 23547 - DNA, 36 bp, Homo sapiens; identical to SEQ ID NO: 14064
  chr22:30116411-30116447
  hyper

SEQ ID NO: 23548 - DNA, 78 bp, Homo sapiens; identical to SEQ ID NO: 14065
  chr22:30116757-30116835
  hyper

SEQ ID NO: 23549 - DNA, 174 bp, Homo sapiens; identical to SEQ ID NO: 14066
  chr22:30938095-30938269
  hyper

SEQ ID NO: 23550 - DNA, 39 bp, Homo sapiens; identical to SEQ ID NO: 14067
  chr22:30938602-30938641
  hyper

SEQ ID NO: 23551 - DNA, 114 bp, Homo sapiens
  chr22:31218396-31218510
  hyper
cgctcaggctgggctcggctcccgcggcgcggacggggttaacgcgctcatgtaccgggtggcgggcggcagtggtgcattgtggtaacgcggcgccgggacccacgagtgtcc

SEQ ID NO: 23552 - DNA, 229 bp, Homo sapiens
  chr22:31218540-31218769
  hyper
tgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttg

SEQ ID NO: 23553 - DNA, 349 bp, Homo sapiens
  chr22:31480781-31481130
  hyper
gggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgc

SEQ ID NO: 23554 - DNA, 73 bp, Homo sapiens
  chr22:31481332-31481405
  hyper
ccttcagcgccccctggcgaggcttccctccaccgccggcgggacccccatgggcaaccgggggagctgggac

SEQ ID NO: 23555 - DNA, 30 bp, Homo sapiens; identical to SEQ ID NO: 14070
  chr22:32572248-32572278
  hyper

SEQ ID NO: 23556 - DNA, 37 bp, Homo sapiens; identical to SEQ ID NO: 14071
  chr22:33197694-33197731
  hyper

SEQ ID NO: 23557 - DNA, 69 bp, Homo sapiens
  chr22:33454366-33454435
  hyper
tgcccctcaacgcgcgcgagcgcccccgcccggcggcccggcctccccgcgccgcggcgccccattggc

SEQ ID NO: 23558 - DNA, 30 bp, Homo sapiens; identical to SEQ ID NO: 14075
  chr22:35420285-35420315
  hyper

SEQ ID NO: 23559 - DNA, 30 bp, Homo sapiens; identical to SEQ ID NO: 14076
  chr22:36553195-36553225
  hyper

SEQ ID NO: 23560 - DNA, 52 bp, Homo sapiens; identical to SEQ ID NO: 14077
  chr22:37730735-37730787
  hyper

SEQ ID NO: 23561 - DNA, 69 bp, Homo sapiens; identical to SEQ ID NO: 14078
  chr22:37731155-37731224
  hyper

SEQ ID NO: 23562 - DNA, 5 bp, Homo sapiens
  chr22:38220648-38220653
  hyper
cgcag

SEQ ID NO: 23563 - DNA, 60 bp, Homo sapiens; identical to SEQ ID NO: 14080
  chr22:38221288-38221348
  hyper

SEQ ID NO: 23564 - DNA, 30 bp, Homo sapiens; identical to SEQ ID NO: 14083
  chr22:38478441-38478471
  hyper

SEQ ID NO: 23565 - DNA, 48 bp, Homo sapiens
  chr22:39853473-39853521
  hyper
acgccagcatctccccgccggggaccccgggggccgcggagccgccgc

SEQ ID NO: 23566 - DNA, 30 bp, Homo sapiens; identical to SEQ ID NO: 14085
  chr22:39854232-39854262
  hyper

SEQ ID NO: 23567 - DNA, 30 bp, Homo sapiens; identical to SEQ ID NO: 14086
  chr22:39942115-39942145
  hyper

SEQ ID NO: 23568 - DNA, 60 bp, Homo sapiens
  chr22:39954516-39954576
  hyper
gggggaatcccgggcagggtttaactttcccggaggcgggggtggcggagaccccccctt

SEQ ID NO: 23569 - DNA, 109 bp, Homo sapiens; identical to SEQ ID NO: 14088
  chr22:40081839-40081948
  hyper

SEQ ID NO: 23570 - DNA, 105 bp, Homo sapiens; identical to SEQ ID NO: 14089
  chr22:42307095-42307200
  hyper

SEQ ID NO: 23571 - DNA, 45 bp, Homo sapiens
  chr22:42310042-42310087
  hyper
tgctgggagaaccagcgcttcgagagcggcgggaaggatcagcgg

SEQ ID NO: 23572 - DNA, 231 bp, Homo sapiens
  chr22:42310220-42310451
  hyper
gcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttga

SEQ ID NO: 23573 - DNA, 123 bp, Homo sapiens; identical to SEQ ID NO: 14091
  chr22:42311386-42311509
  hyper

SEQ ID NO: 23574 - DNA, 88 bp, Homo sapiens
  chr22:42353892-42353980
  hyper
ctgagccgacttgcaaaggggataggcgggcggcaccgggcgccctcccccagcccgccccgcccgcccagcccggagacccccaagg

SEQ ID NO: 23575 - DNA, 75 bp, Homo sapiens; identical to SEQ ID NO: 14093
  chr22:42679405-42679480
  hyper

SEQ ID NO: 23576 - DNA, 215 bp, Homo sapiens; identical to SEQ ID NO: 14094
  chr22:42679916-42680131
  hyper

SEQ ID NO: 23577 - DNA, 68 bp, Homo sapiens; identical to SEQ ID NO: 14095
  chr22:42896621-42896689
  hyper

SEQ ID NO: 23578 - DNA, 37 bp, Homo sapiens; identical to SEQ ID NO: 14096
  chr22:43739465-43739502
  hyper

SEQ ID NO: 23579 - DNA, 6 bp, Homo sapiens
  chr22:43740128-43740134
  hyper
cccctg

SEQ ID NO: 23580 - DNA, 81 bp, Homo sapiens
  chr22:44258285-44258366
  hyper
cgccgcctcccggctcgcagcccgcacgcgcccgcgcccgcgcccgcgcccgcgccccgcacacgctcgcgccccaccggc

SEQ ID NO: 23581 - DNA, 13 bp, Homo sapiens
  chr22:44258506-44258519
  hyper
tcctccccgcccc

SEQ ID NO: 23582 - DNA, 30 bp, Homo sapiens; identical to SEQ ID NO: 14099
  chr22:44263900-44263930
  hyper

SEQ ID NO: 23583 - DNA, 139 bp, Homo sapiens; identical to SEQ ID NO: 14101
  chr22:44726839-44726978
  hyper

SEQ ID NO: 23584 - DNA, 93 bp, Homo sapiens; identical to SEQ ID NO: 14102
  chr22:44727446-44727539
  hyper

SEQ ID NO: 23585 - DNA, 137 bp, Homo sapiens; identical to SEQ ID NO: 14103
  chr22:44727790-44727927
  hyper

SEQ ID NO: 23586 - DNA, 46 bp, Homo sapiens; identical to SEQ ID NO: 14104
  chr22:45016369-45016415
  hyper

SEQ ID NO: 23587 - DNA, 13 bp, Homo sapiens
  chr22:45403133-45403146
  hyper
ccccctcccatca

SEQ ID NO: 23588 - DNA, 209 bp, Homo sapiens
  chr22:45404433-45404642
  hyper
cgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcg

SEQ ID NO: 23589 - DNA, 209 bp, Homo sapiens
  chr22:45405061-45405270
  hyper
gggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagc

SEQ ID NO: 23590 - DNA, 24 bp, Homo sapiens
  chr22:45405596-45405620
  hyper
gggaagacaggcttccgggcgccg

SEQ ID NO: 23591 - DNA, 232 bp, Homo sapiens
  chr22:45406039-45406271
  hyper
cggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatatt

SEQ ID NO: 23592 - DNA, 54 bp, Homo sapiens; identical to SEQ ID NO: 14113
  chr22:46658689-46658743
  hyper

SEQ ID NO: 23593 - DNA, 455 bp, Homo sapiens
  chr22:48886204-48886659
  hyper
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcc

SEQ ID NO: 23594 - DNA, 88 bp, Homo sapiens
  chr22:48886849-48886937
  hyper
ctagaaatgctgtggcaccgagcggggaggggtcgccaagcctgggggtctcaacccgagctgcccaggcagacgaggccaccgtggg

SEQ ID NO: 23595 - DNA, 201 bp, Homo sapiens; identical to SEQ ID NO: 1525
  chr22:48971758-48971959
  hyper

SEQ ID NO: 23596 - DNA, 176 bp, Homo sapiens; identical to SEQ ID NO: 1526
  chr22:48971960-48972136
  hyper

SEQ ID NO: 23597 - DNA, 37 bp, Homo sapiens; identical to SEQ ID NO: 14120
  chr22:50421971-50422008
  hyper

SEQ ID NO: 23598 - DNA, 48 bp, Homo sapiens; identical to SEQ ID NO: 14121
  chr22:50453483-50453531
  hyper

SEQ ID NO: 23599 - DNA, 176 bp, Homo sapiens
  chr22:50496971-50497147
  hyper
cgcccccctgtggaggtcacactccatcccccaccaggtcacaaagacccgcgggtcacatcctgcccctccccctcgggccccccaggcccgccaggccttctcgccctccccggggccctcatgccgccctctgtccctgggcccttccccgacgcgaggctggagcggcgggg

SEQ ID NO: 23600 - DNA, 16 bp, Homo sapiens
  chr22:50623656-50623672
  hyper
ctgagcgtccgggtcc

SEQ ID NO: 23601 - DNA, 46 bp, Homo sapiens
  chr22:50623815-50623861
  hyper
cccgggtcggggaccgctctgggccgacccccggaggacggactag

SEQ ID NO: 23602 - DNA, 70 bp, Homo sapiens
  chr22:51112080-51112150
  hyper
ccctaggcccttccccgtaggtcgcgcccccatcccgccgtcgctaaggtgacggggagggggcgacagg

SEQ ID NO: 23603 - DNA, 96 bp, Homo sapiens; identical to SEQ ID NO: 14129
  chrX:3264807-3264903
  hyper

SEQ ID NO: 23604 - DNA, 29 bp, Homo sapiens
  chrX:3265150-3265179
  hyper
cgggctggccccgccggcatcccactagc

SEQ ID NO: 23605 - DNA, 20 bp, Homo sapiens
  chrX:6143666-6143686
  hyper
gcttcgtcaggataacgagg

SEQ ID NO: 23606 - DNA, 199 bp, Homo sapiens; identical to SEQ ID NO: 14132
  chrX:6143746-6143945
  hyper

SEQ ID NO: 23607 - DNA, 30 bp, Homo sapiens; identical to SEQ ID NO: 14133
  chrX:6144913-6144943
  hyper

SEQ ID NO: 23608 - DNA, 88 bp, Homo sapiens
  chrX:6145243-6145331
  hyper
gggaagagggggtggcggttgcgttttccagggctgtagaggtggtgcgcctattggaaccgactcctcagcctcctcccccgtcccc

SEQ ID NO: 23609 - DNA, 30 bp, Homo sapiens; identical to SEQ ID NO: 14135
  chrX:8698521-8698551
  hyper

SEQ ID NO: 23610 - DNA, 21 bp, Homo sapiens
  chrX:8698842-8698863
  hyper
gaagagaaaaataagcggagg

SEQ ID NO: 23611 - DNA, 161 bp, Homo sapiens
  chrX:8698897-8699058
  hyper
aggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 23612 - DNA, 71 bp, Homo sapiens; identical to SEQ ID NO: 14137
  chrX:8699110-8699181
  hyper

SEQ ID NO: 23613 - DNA, 145 bp, Homo sapiens; identical to SEQ ID NO: 14139
  chrX:13956384-13956529
  hyper

SEQ ID NO: 23614 - DNA, 281 bp, Homo sapiens; identical to SEQ ID NO: 14140
  chrX:13956777-13957058
  hyper

SEQ ID NO: 23615 - DNA, 30 bp, Homo sapiens; identical to SEQ ID NO: 14141
  chrX:16730016-16730046
  hyper

SEQ ID NO: 23616 - DNA, 40 bp, Homo sapiens; identical to SEQ ID NO: 14142
  chrX:40017828-40017868
  hyper

SEQ ID NO: 23617 - DNA, 38 bp, Homo sapiens; identical to SEQ ID NO: 14143
  chrX:40034521-40034559
  hyper

SEQ ID NO: 23618 - DNA, 172 bp, Homo sapiens; identical to SEQ ID NO: 14144
  chrX:91035629-91035801
  hyper

SEQ ID NO: 23619 - DNA, 34 bp, Homo sapiens; identical to SEQ ID NO: 14145
  chrX:91037095-91037129
  hyper

SEQ ID NO: 23620 - DNA, 43 bp, Homo sapiens; identical to SEQ ID NO: 14147
  AC211950.2_11234-25326:13516-13559
  hyper

SEQ ID NO: 23621 - DNA, 131 bp, Homo sapiens
  AC241851.2_88-34049:15130-15261
  hyper
cttgcccccaccgcccgggctttttgcgccgcggctttttgctgctatttgtccctgccaccgcggcgttttgcccccgcagccgcggctccttgccccctacgcggcttcctgcctccgccaccgtggct

SEQ ID NO: 23622 - DNA, 200 bp, Homo sapiens
  AC241851.2_88-34049:15350-15550
  hyper
acagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggtttttcccgcc

SEQ ID NO: 23623 - DNA, 85 bp, Homo sapiens
  AEKP01168736.1_1-4752:1669-1754
  hyper
gtctaagctagggcccggggtccaaaggaaaggctttcagatctgagctccgcggctctggcggcggtggagctgggagcccgcg

SEQ ID NO: 23624 - DNA, 344 bp, Homo sapiens
  AEKP01168736.1_1-4752:2287-2631
  hyper
gggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtct

SEQ ID NO: 23625 - DNA, 82 bp, Homo sapiens; identical to SEQ ID NO: 14151
  JH159140.1:144237-144319
  hyper

SEQ ID NO: 23626 - DNA, 36 bp, Homo sapiens; identical to SEQ ID NO: 4929
  JH636052.4:1362180-1362216
  hyper

SEQ ID NO: 23627 - DNA, 34 bp, Homo sapiens
  JH636052.4:5118735-5118769
  hyper
gggcgaaggccattccgctgcccttccagcttcg

SEQ ID NO: 23628 - DNA, 26 bp, Homo sapiens
  JH636052.4:5118903-5118929
  hyper
tgataccagaacgagagttgactgtg

SEQ ID NO: 23629 - DNA, 172 bp, Homo sapiens; identical to SEQ ID NO: 14154
  JH636058.1:413215-413387
  hyper

SEQ ID NO: 23630 - DNA, 149 bp, Homo sapiens
  chr1:913955-914104
  hypo
cctgaaggtagccaggcctgggcgggaaccctgccagaggctgggggagggacgccgccgtcacatgggcccgaacacagggcaacggcggcgcagagccaaccccctgaacaacccgggtgcttggactgggccgccccatctggact

SEQ ID NO: 23631 - DNA, 33 bp, Homo sapiens; identical to SEQ ID NO: 14156
  chr1:942352-942385
  hypo

SEQ ID NO: 23632 - DNA, 34 bp, Homo sapiens; identical to SEQ ID NO: 14157
  chr1:1050115-1050149
  hypo

SEQ ID NO: 23633 - DNA, 14 bp, Homo sapiens
  chr1:1080824-1080838
  hypo
gcacggctgaccca

SEQ ID NO: 23634 - DNA, 155 bp, Homo sapiens; identical to SEQ ID NO: 14159
  chr1:1145553-1145708
  hypo

SEQ ID NO: 23635 - DNA, 41 bp, Homo sapiens
  chr1:1146693-1146734
  hypo
tgcagcccacagtgccggtcggagactcccgtctgccaagg

SEQ ID NO: 23636 - DNA, 12 bp, Homo sapiens
  chr1:1146818-1146830
  hypo
tgcagagttggc

SEQ ID NO: 23637 - DNA, 129 bp, Homo sapiens; identical to SEQ ID NO: 14162
  chr1:1238321-1238450
  hypo

SEQ ID NO: 23638 - DNA, 30 bp, Homo sapiens; identical to SEQ ID NO: 14163
  chr1:1245257-1245287
  hypo

SEQ ID NO: 23639 - DNA, 72 bp, Homo sapiens; identical to SEQ ID NO: 14164
  chr1:1267177-1267249
  hypo

SEQ ID NO: 23640 - DNA, 207 bp, Homo sapiens
  chr1:1267699-1267906
  hypo
gaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgca

SEQ ID NO: 23641 - DNA, 129 bp, Homo sapiens; identical to SEQ ID NO: 14167
  chr1:1856222-1856351
  hypo

SEQ ID NO: 23642 - DNA, 30 bp, Homo sapiens; identical to SEQ ID NO: 14169
  chr1:1915087-1915117
  hypo

SEQ ID NO: 23643 - DNA, 38 bp, Homo sapiens; identical to SEQ ID NO: 14170
  chr1:2013465-2013503
  hypo

SEQ ID NO: 23644 - DNA, 30 bp, Homo sapiens; identical to SEQ ID NO: 14172
  chr1:2141654-2141684
  hypo

SEQ ID NO: 23645 - DNA, 38 bp, Homo sapiens
  chr1:2263131-2263169
  hypo
gggaacagtcaaagacgactttgcaggatcctgcctga

SEQ ID NO: 23646 - DNA, 81 bp, Homo sapiens
  chr1:2263263-2263344
  hypo
tgcgcctctccctcgtgcggctctcccgcccctgcgcctctccctcgtgcgcctctcccgcccctgcgcctctccctcgtg

SEQ ID NO: 23647 - DNA, 86 bp, Homo sapiens
  chr1:2267466-2267552
  hypo
gtgtccccgcctgcacgtgccgcggtgtgcacctggtcccactcctgtcctccagctcacagagtcccctcaagccactgccctga

SEQ ID NO: 23648 - DNA, 102 bp, Homo sapiens; identical to SEQ ID NO: 14175
  chr1:2275689-2275791
  hypo

SEQ ID NO: 23649 - DNA, 49 bp, Homo sapiens; identical to SEQ ID NO: 14177
  chr1:2307845-2307894
  hypo

SEQ ID NO: 23650 - DNA, 131 bp, Homo sapiens
  chr1:2308245-2308376
  hypo
actgatccaatagcccggtcttgtctaattcacgttatcaatcacacctttgacaattcggctgtttctgtttcatgtaccccaagcaggaacgagcaagagcttattaaatagggtgcaggggaggctcc

SEQ ID NO: 23651 - DNA, 22 bp, Homo sapiens
  chr1:2308636-2308658
  hypo
ggtcacacgacctttggggaag

SEQ ID NO: 23652 - DNA, 49 bp, Homo sapiens; identical to SEQ ID NO: 14180
  chr1:2338188-2338237
  hypo

SEQ ID NO: 23653 - DNA, 348 bp, Homo sapiens; identical to SEQ ID NO: 14181
  chr1:2359972-2360320
  hypo

SEQ ID NO: 23654 - DNA, 3 bp, Homo sapiens
  chr1:2396998-2397001
  hypo
tcc

SEQ ID NO: 23655 - DNA, 147 bp, Homo sapiens
  chr1:2397031-2397178
  hypo
acctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtga

SEQ ID NO: 23656 - DNA, 59 bp, Homo sapiens
  chr1:2428272-2428331
  hypo
ccagctggcaggtgtcgtccttcagcgagaccaaggcccaccagattctgcagcagaag

SEQ ID NO: 23657 - DNA, 30 bp, Homo sapiens; identical to SEQ ID NO: 14184
  chr1:2468639-2468669
  hypo

SEQ ID NO: 23658 - DNA, 18 bp, Homo sapiens
  chr1:2507045-2507063
  hypo
ctcacaggctcacagcgg

SEQ ID NO: 23659 - DNA, 66 bp, Homo sapiens; identical to SEQ ID NO: 14186
  chr1:2537084-2537150
  hypo

SEQ ID NO: 23660 - DNA, 79 bp, Homo sapiens; identical to SEQ ID NO: 14187
  chr1:2537758-2537837
  hypo

SEQ ID NO: 23661 - DNA, 113 bp, Homo sapiens; identical to SEQ ID NO: 14188
  chr1:2708372-2708485
  hypo

SEQ ID NO: 23662 - DNA, 136 bp, Homo sapiens; identical to SEQ ID NO: 14189
  chr1:2725529-2725665
  hypo

SEQ ID NO: 23663 - DNA, 54 bp, Homo sapiens; identical to SEQ ID NO: 14190
  chr1:3078787-3078841
  hypo

SEQ ID NO: 23664 - DNA, 56 bp, Homo sapiens; identical to SEQ ID NO: 14192
  chr1:3111327-3111383
  hypo

SEQ ID NO: 23665 - DNA, 39 bp, Homo sapiens; identical to SEQ ID NO: 14193
  chr1:3411209-3411248
  hypo

SEQ ID NO: 23666 - DNA, 30 bp, Homo sapiens; identical to SEQ ID NO: 14195
  chr1:3680070-3680100
  hypo

SEQ ID NO: 23667 - DNA, 26 bp, Homo sapiens
  chr1:3683818-3683844
  hypo
agctcaccaagcgggactgtgtcatc

SEQ ID NO: 23668 - DNA, 180 bp, Homo sapiens; identical to SEQ ID NO: 14197
  chr1:4082823-4083003
  hypo

SEQ ID NO: 23669 - DNA, 3 bp, Homo sapiens
  chr1:4111231-4111234
  hypo
ctg

SEQ ID NO: 23670 - DNA, 141 bp, Homo sapiens; identical to SEQ ID NO: 14199
  chr1:4402113-4402254
  hypo

SEQ ID NO: 23671 - DNA, 30 bp, Homo sapiens; identical to SEQ ID NO: 14200
  chr1:4486536-4486566
  hypo

SEQ ID NO: 23672 - DNA, 53 bp, Homo sapiens; identical to SEQ ID NO: 14201
  chr1:4772565-4772618
  hypo

SEQ ID NO: 23673 - DNA, 32 bp, Homo sapiens
  chr1:6166321-6166353
  hypo
gggaagtctcgaggacggctagatatctgtca

SEQ ID NO: 23674 - DNA, 30 bp, Homo sapiens; identical to SEQ ID NO: 14204
  chr1:6360980-6361010
  hypo

SEQ ID NO: 23675 - DNA, 56 bp, Homo sapiens; identical to SEQ ID NO: 14205
  chr1:6391449-6391505
  hypo

SEQ ID NO: 23676 - DNA, 98 bp, Homo sapiens; identical to SEQ ID NO: 14207
  chr1:11036301-11036399
  hypo

SEQ ID NO: 23677 - DNA, 30 bp, Homo sapiens; identical to SEQ ID NO: 14208
  chr1:11131698-11131728
  hypo

SEQ ID NO: 23678 - DNA, 54 bp, Homo sapiens
  chr1:11936694-11936748
  hypo
gatgtgaagtagcttcgggcagaactccaaaccttagagagatcatttgaaaat

SEQ ID NO: 23679 - DNA, 13 bp, Homo sapiens
  chr1:14730412-14730425
  hypo
aagaagaggtctc

SEQ ID NO: 23680 - DNA, 41 bp, Homo sapiens; identical to SEQ ID NO: 14212
  chr1:16534552-16534593
  hypo

SEQ ID NO: 23681 - DNA, 30 bp, Homo sapiens; identical to SEQ ID NO: 14213
  chr1:19213653-19213683
  hypo

SEQ ID NO: 23682 - DNA, 64 bp, Homo sapiens; identical to SEQ ID NO: 14214
  chr1:21042770-21042834
  hypo

SEQ ID NO: 23683 - DNA, 30 bp, Homo sapiens; identical to SEQ ID NO: 14215
  chr1:22777528-22777558
  hypo

SEQ ID NO: 23684 - DNA, 8 bp, Homo sapiens
  chr1:22927402-22927410
  hypo
gtggagga

SEQ ID NO: 23685 - DNA, 42 bp, Homo sapiens; identical to SEQ ID NO: 14217
  chr1:24119192-24119234
  hypo

SEQ ID NO: 23686 - DNA, 19 bp, Homo sapiens
  chr1:27844548-27844567
  hypo
agcacgctcctcaccagcc

SEQ ID NO: 23687 - DNA, 30 bp, Homo sapiens; identical to SEQ ID NO: 14220
  chr1:29074253-29074283
  hypo

SEQ ID NO: 23688 - DNA, 16 bp, Homo sapiens
  chr1:29516596-29516612
  hypo
atagtcaaggccgggc

SEQ ID NO: 23689 - DNA, 143 bp, Homo sapiens; identical to SEQ ID NO: 14223
  chr1:33473115-33473258
  hypo

SEQ ID NO: 23690 - DNA, 20 bp, Homo sapiens
  chr1:35660562-35660582
  hypo
aggcgggaccgggtgcggtg

SEQ ID NO: 23691 - DNA, 23 bp, Homo sapiens
  chr1:36563456-36563479
  hypo
tggctgggttgtagccgctgtgg

SEQ ID NO: 23692 - DNA, 49 bp, Homo sapiens
  chr1:36563522-36563571
  hypo
cggggaagggcgaggtgagcaccgcagtgaaggccggtgtggcatgggc

SEQ ID NO: 23693 - DNA, 61 bp, Homo sapiens
  chr1:38398348-38398409
  hypo
attttatatacaaggcaaccaagttcagagaggttaagtctgaggtcgcagagtgactagc

SEQ ID NO: 23694 - DNA, 156 bp, Homo sapiens; identical to SEQ ID NO: 1533
  chr1:39416821-39416977
  hypo

SEQ ID NO: 23695 - DNA, 30 bp, Homo sapiens; identical to SEQ ID NO: 14229
  chr1:40905137-40905167
  hypo

SEQ ID NO: 23696 - DNA, 83 bp, Homo sapiens
  chr1:41991702-41991785
  hypo
tgcctggttccagcacagaggggcaggaggtggctgggaggaggtgagcaagggacagcgtgtcggggcgggggggctccacc

SEQ ID NO: 23697 - DNA, 30 bp, Homo sapiens; identical to SEQ ID NO: 14231
  chr1:43826882-43826912
  hypo

SEQ ID NO: 23698 - DNA, 30 bp, Homo sapiens; identical to SEQ ID NO: 14233
  chr1:44068855-44068885
  hypo

SEQ ID NO: 23699 - DNA, 43 bp, Homo sapiens; identical to SEQ ID NO: 14234
  chr1:44351190-44351233
  hypo

SEQ ID NO: 23700 - DNA, 144 bp, Homo sapiens; identical to SEQ ID NO: 14235
  chr1:44497527-44497671
  hypo

SEQ ID NO: 23701 - DNA, 77 bp, Homo sapiens; identical to SEQ ID NO: 14237
  chr1:45280503-45280580
  hypo

SEQ ID NO: 23702 - DNA, 37 bp, Homo sapiens; identical to SEQ ID NO: 1534
  chr1:45645619-45645656
  hypo

SEQ ID NO: 23703 - DNA, 38 bp, Homo sapiens; identical to SEQ ID NO: 14239
  chr1:46079131-46079169
  hypo

SEQ ID NO: 23704 - DNA, 10 bp, Homo sapiens
  chr1:53129144-53129154
  hypo
acatgtggcc

SEQ ID NO: 23705 - DNA, 30 bp, Homo sapiens; identical to SEQ ID NO: 14241
  chr1:53990562-53990592
  hypo

SEQ ID NO: 23706 - DNA, 36 bp, Homo sapiens
  chr1:54586590-54586626
  hypo
gtggtggcagtggggcgagagagaaaggagtggact

SEQ ID NO: 23707 - DNA, 261 bp, Homo sapiens
  chr1:54586736-54586997
  hypo
caggagaggctcagggagcgccaatgattccgtgtgaggcacagggcgtggctgcgggtgggtgggagggcgactgcagcatgggaaatttcggtggagaaccagatcaggagtcaccaaataccatggagatggtaacaaagcctacagggaggcagggattgtgcggggagtctgcagcagcaaaacccctgctgggatgaggggccgggccctctctgaccccagaccaggcaaggctcccgtcgtccccactttgcc

SEQ ID NO: 23708 - DNA, 49 bp, Homo sapiens
  chr1:70672878-70672927
  hypo
ttttaaaggaaaacgaccgtagcagcttttgcaacgttattaatgaggt

SEQ ID NO: 23709 - DNA, 30 bp, Homo sapiens; identical to SEQ ID NO: 14245
  chr1:78244815-78244845
  hypo

SEQ ID NO: 23710 - DNA, 30 bp, Homo sapiens; identical to SEQ ID NO: 14247
  chr1:92494939-92494969
  hypo

SEQ ID NO: 23711 - DNA, 98 bp, Homo sapiens; identical to SEQ ID NO: 14249
  chr1:99611990-99612088
  hypo

SEQ ID NO: 23712 - DNA, 38 bp, Homo sapiens; identical to SEQ ID NO: 14250
  chr1:99612148-99612186
  hypo

SEQ ID NO: 23713 - DNA, 86 bp, Homo sapiens; identical to SEQ ID NO: 4943
  chr1:100437183-100437269
  hypo

SEQ ID NO: 23714 - DNA, 26 bp, Homo sapiens
  chr1:100814757-100814783
  hypo
aaaaaaaaaggcgttgttttcaaact

SEQ ID NO: 23715 - DNA, 20 bp, Homo sapiens
  chr1:109076917-109076937
  hypo
ttcaccgtgttagccaggat

SEQ ID NO: 23716 - DNA, 22 bp, Homo sapiens
  chr1:109593505-109593527
  hypo
tcaagggccaggcaccgcggct

SEQ ID NO: 23717 - DNA, 79 bp, Homo sapiens; identical to SEQ ID NO: 14256
  chr1:110726679-110726758
  hypo

SEQ ID NO: 23718 - DNA, 30 bp, Homo sapiens; identical to SEQ ID NO: 14258
  chr1:110884166-110884196
  hypo

SEQ ID NO: 23719 - DNA, 64 bp, Homo sapiens
  chr1:112084890-112084954
  hypo
caggatcagacctgccggttcgaacacacgcgacaagagcaaagaagttaaaagagaagtgtct

SEQ ID NO: 23720 - DNA, 86 bp, Homo sapiens
  chr1:112084984-112085070
  hypo
gtgccagctgagaggtggtagagcaggaagctgcctgaggacctccatttatttggtgaaaaactgggctccgcccttaagagagc

SEQ ID NO: 23721 - DNA, 30 bp, Homo sapiens; identical to SEQ ID NO: 14260
  chr1:113751257-113751287
  hypo

SEQ ID NO: 23722 - DNA, 30 bp, Homo sapiens; identical to SEQ ID NO: 14262
  chr1:116574202-116574232
  hypo

SEQ ID NO: 23723 - DNA, 30 bp, Homo sapiens; identical to SEQ ID NO: 14263
  chr1:150602992-150603022
  hypo

SEQ ID NO: 23724 - DNA, 30 bp, Homo sapiens; identical to SEQ ID NO: 14264
  chr1:150850705-150850735
  hypo

SEQ ID NO: 23725 - DNA, 102 bp, Homo sapiens; identical to SEQ ID NO: 1538
  chr1:151252684-151252786
  hypo

SEQ ID NO: 23726 - DNA, 49 bp, Homo sapiens
  chr1:153540047-153540096
  hypo
ctcggcctgctgctgcgtgtcccttaaacacaccggcacatgcaactag

SEQ ID NO: 23727 - DNA, 88 bp, Homo sapiens
  chr1:153540154-153540242
  hypo
ccatgccctctatcctgctgaaatccaacccccccttcaaaggccactgcagggagccttcccagggcccaaccggattcagtgtcta

SEQ ID NO: 23728 - DNA, 98 bp, Homo sapiens; identical to SEQ ID NO: 14271
  chr1:155160925-155161023
  hypo

SEQ ID NO: 23729 - DNA, 6 bp, Homo sapiens
  chr1:155578921-155578927
  hypo
ccttgt

SEQ ID NO: 23730 - DNA, 40 bp, Homo sapiens; identical to SEQ ID NO: 1540
  chr1:156030121-156030161
  hypo

SEQ ID NO: 23731 - DNA, 23 bp, Homo sapiens
  chr1:156031582-156031605
  hypo
tttttttttctgagacggagtct

SEQ ID NO: 23732 - DNA, 47 bp, Homo sapiens; identical to SEQ ID NO: 14276
  chr1:156433495-156433542
  hypo

SEQ ID NO: 23733 - DNA, 89 bp, Homo sapiens; identical to SEQ ID NO: 14277
  chr1:156843312-156843401
  hypo

SEQ ID NO: 23734 - DNA, 75 bp, Homo sapiens
  chr1:157247388-157247463
  hypo
ggtggattattaggaggcttccatgtagagccgcggcccagtggcctgcagggcctctgacggcagaggcaagca

SEQ ID NO: 23735 - DNA, 136 bp, Homo sapiens
  chr1:157458773-157458909
  hypo
gacttggcaaccagccggacactgattccattcctgcttctaccgctaagctctgtcatccagcagatcctcaatggcctcatctggaaaatgggataatacttcctctgcagggttgctgggaggactaaataga

SEQ ID NO: 23736 - DNA, 28 bp, Homo sapiens
  chr1:157791984-157792012
  hypo
aacttgaacataaggcgggcggatcacg

SEQ ID NO: 23737 - DNA, 48 bp, Homo sapiens
  chr1:157895443-157895491
  hypo
gaaagagtccagggccggcggggtgctatgaggcgaggacttcctgag

SEQ ID NO: 23738 - DNA, 141 bp, Homo sapiens; identical to SEQ ID NO: 14282
  chr1:158169208-158169349
  hypo

SEQ ID NO: 23739 - DNA, 30 bp, Homo sapiens; identical to SEQ ID NO: 14283
  chr1:158237112-158237142
  hypo

SEQ ID NO: 23740 - DNA, 20 bp, Homo sapiens
  chr1:158366698-158366718
  hypo
tattttggccaggggcggtg

SEQ ID NO: 23741 - DNA, 16 bp, Homo sapiens
  chr1:158591676-158591692
  hypo
ggagtcttgctctgtc

SEQ ID NO: 23742 - DNA, 30 bp, Homo sapiens; identical to SEQ ID NO: 14287
  chr1:158639324-158639354
  hypo

SEQ ID NO: 23743 - DNA, 17 bp, Homo sapiens
  chr1:158730575-158730592
  hypo
ctgggtgcagtggctcg

SEQ ID NO: 23744 - DNA, 23 bp, Homo sapiens
  chr1:158748794-158748817
  hypo
cgagactgcgtctcaaaaaaaaa

SEQ ID NO: 23745 - DNA, 169 bp, Homo sapiens; identical to SEQ ID NO: 14290
  chr1:159883486-159883655
  hypo

SEQ ID NO: 23746 - DNA, 30 bp, Homo sapiens; identical to SEQ ID NO: 14291
  chr1:159932029-159932059
  hypo

SEQ ID NO: 23747 - DNA, 26 bp, Homo sapiens
  chr1:160451209-160451235
  hypo
ctgttcctattcggccatcttggctg

SEQ ID NO: 23748 - DNA, 19 bp, Homo sapiens
  chr1:160693915-160693934
  hypo
ctgtcctcctgaaaacggg

SEQ ID NO: 23749 - DNA, 30 bp, Homo sapiens; identical to SEQ ID NO: 14294
  chr1:160853373-160853403
  hypo

SEQ ID NO: 23750 - DNA, 35 bp, Homo sapiens; identical to SEQ ID NO: 14295
  chr1:160880659-160880694
  hypo

SEQ ID NO: 23751 - DNA, 16 bp, Homo sapiens
  chr1:161007746-161007762
  hypo
ccgcttgcccatctga

SEQ ID NO: 23752 - DNA, 28 bp, Homo sapiens
  chr1:161367768-161367796
  hypo
gcgtgaaacaccgcgcctggccaaaaaa

SEQ ID NO: 23753 - DNA, 22 bp, Homo sapiens
  chr1:161442419-161442441
  hypo
cggcgggcagtctctcgaccct

SEQ ID NO: 23754 - DNA, 30 bp, Homo sapiens; identical to SEQ ID NO: 14301
  chr1:161913509-161913539
  hypo

SEQ ID NO: 23755 - DNA, 19 bp, Homo sapiens
  chr1:167789093-167789112
  hypo
cgcccggcatgattttcta

SEQ ID NO: 23756 - DNA, 30 bp, Homo sapiens; identical to SEQ ID NO: 14304
  chr1:168150766-168150796
  hypo

SEQ ID NO: 23757 - DNA, 30 bp, Homo sapiens; identical to SEQ ID NO: 14306
  chr1:173993077-173993107
  hypo

SEQ ID NO: 23758 - DNA, 36 bp, Homo sapiens; identical to SEQ ID NO: 14307
  chr1:175365715-175365751
  hypo

SEQ ID NO: 23759 - DNA, 78 bp, Homo sapiens; identical to SEQ ID NO: 14308
  chr1:175372494-175372572
  hypo

SEQ ID NO: 23760 - DNA, 30 bp, Homo sapiens; identical to SEQ ID NO: 14309
  chr1:179849955-179849985
  hypo

SEQ ID NO: 23761 - DNA, 30 bp, Homo sapiens; identical to SEQ ID NO: 14310
  chr1:180235694-180235724
  hypo

SEQ ID NO: 23762 - DNA, 30 bp, Homo sapiens; identical to SEQ ID NO: 14313
  chr1:200519350-200519380
  hypo

SEQ ID NO: 23763 - DNA, 30 bp, Homo sapiens; identical to SEQ ID NO: 14314
  chr1:200864028-200864058
  hypo

SEQ ID NO: 23764 - DNA, 30 bp, Homo sapiens; identical to SEQ ID NO: 14315
  chr1:201244396-201244426
  hypo

SEQ ID NO: 23765 - DNA, 30 bp, Homo sapiens; identical to SEQ ID NO: 14316
  chr1:201797425-201797455
  hypo

SEQ ID NO: 23766 - DNA, 42 bp, Homo sapiens; identical to SEQ ID NO: 14317
  chr1:201982442-201982484
  hypo

SEQ ID NO: 23767 - DNA, 31 bp, Homo sapiens
  chr1:201983200-201983231
  hypo
gcgctcacactcccaccgccctctttctggc

SEQ ID NO: 23768 - DNA, 132 bp, Homo sapiens; identical to SEQ ID NO: 14320
  chr1:202312002-202312134
  hypo

SEQ ID NO: 23769 - DNA, 30 bp, Homo sapiens; identical to SEQ ID NO: 14321
  chr1:202995301-202995331
  hypo

SEQ ID NO: 23770 - DNA, 62 bp, Homo sapiens; identical to SEQ ID NO: 14322
  chr1:204588321-204588383
  hypo

SEQ ID NO: 23771 - DNA, 46 bp, Homo sapiens; identical to SEQ ID NO: 14323
  chr1:204721217-204721263
  hypo

SEQ ID NO: 23772 - DNA, 104 bp, Homo sapiens; identical to SEQ ID NO: 14324
  chr1:205310685-205310789
  hypo

SEQ ID NO: 23773 - DNA, 30 bp, Homo sapiens; identical to SEQ ID NO: 14325
  chr1:207656486-207656516
  hypo

SEQ ID NO: 23774 - DNA, 77 bp, Homo sapiens; identical to SEQ ID NO: 14326
  chr1:207991495-207991572
  hypo

SEQ ID NO: 23775 - DNA, 175 bp, Homo sapiens; identical to SEQ ID NO: 14327
  chr1:209601406-209601581
  hypo

SEQ ID NO: 23776 - DNA, 154 bp, Homo sapiens; identical to SEQ ID NO: 14328
  chr1:209999773-209999927
  hypo

SEQ ID NO: 23777 - DNA, 84 bp, Homo sapiens; identical to SEQ ID NO: 4958
  chr1:213189757-213189841
  hypo

SEQ ID NO: 23778 - DNA, 20 bp, Homo sapiens
  chr1:223907539-223907559
  hypo
gcgcgcgtataatgcagtat

SEQ ID NO: 23779 - DNA, 30 bp, Homo sapiens; identical to SEQ ID NO: 14332
  chr1:224267844-224267874
  hypo

SEQ ID NO: 23780 - DNA, 121 bp, Homo sapiens; identical to SEQ ID NO: 14333
  chr1:226062878-226062999
  hypo

SEQ ID NO: 23781 - DNA, 93 bp, Homo sapiens; identical to SEQ ID NO: 14334
  chr1:226163122-226163215
  hypo

SEQ ID NO: 23782 - DNA, 42 bp, Homo sapiens; identical to SEQ ID NO: 14335
  chr1:227750829-227750871
  hypo

SEQ ID NO: 23783 - DNA, 30 bp, Homo sapiens; identical to SEQ ID NO: 14336
  chr1:227921541-227921571
  hypo

SEQ ID NO: 23784 - DNA, 156 bp, Homo sapiens
  chr1:228529016-228529172
  hypo
tggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggaggg

SEQ ID NO: 23785 - DNA, 30 bp, Homo sapiens; identical to SEQ ID NO: 14338
  chr1:228536492-228536522
  hypo

SEQ ID NO: 23786 - DNA, 30 bp, Homo sapiens; identical to SEQ ID NO: 14339
  chr1:228552593-228552623
  hypo

SEQ ID NO: 23787 - DNA, 30 bp, Homo sapiens; identical to SEQ ID NO: 14341
  chr1:228919370-228919400
  hypo

SEQ ID NO: 23788 - DNA, 53 bp, Homo sapiens; identical to SEQ ID NO: 14343
  chr1:230453632-230453685
  hypo

SEQ ID NO: 23789 - DNA, 30 bp, Homo sapiens; identical to SEQ ID NO: 14344
  chr1:231163109-231163139
  hypo

SEQ ID NO: 23790 - DNA, 30 bp, Homo sapiens; identical to SEQ ID NO: 14346
  chr1:234621166-234621196
  hypo

SEQ ID NO: 23791 - DNA, 30 bp, Homo sapiens; identical to SEQ ID NO: 14347
  chr1:234882549-234882579
  hypo

SEQ ID NO: 23792 - DNA, 30 bp, Homo sapiens; identical to SEQ ID NO: 14348
  chr1:234959409-234959439
  hypo

SEQ ID NO: 23793 - DNA, 30 bp, Homo sapiens; identical to SEQ ID NO: 14349
  chr1:235267149-235267179
  hypo

SEQ ID NO: 23794 - DNA, 96 bp, Homo sapiens; identical to SEQ ID NO: 14350
  chr1:235325416-235325512
  hypo

SEQ ID NO: 23795 - DNA, 169 bp, Homo sapiens; identical to SEQ ID NO: 14351
  chr1:240463082-240463251
  hypo

SEQ ID NO: 23796 - DNA, 177 bp, Homo sapiens; identical to SEQ ID NO: 14352
  chr1:242286750-242286927
  hypo

SEQ ID NO: 23797 - DNA, 30 bp, Homo sapiens; identical to SEQ ID NO: 14353
  chr1:243057075-243057105
  hypo

SEQ ID NO: 23798 - DNA, 30 bp, Homo sapiens; identical to SEQ ID NO: 14354
  chr1:244143029-244143059
  hypo

SEQ ID NO: 23799 - DNA, 34 bp, Homo sapiens
  chr1:245135719-245135753
  hypo
tgtatccttgtagtccgtggacagcagcctggac

SEQ ID NO: 23800 - DNA, 197 bp, Homo sapiens; identical to SEQ ID NO: 14356
  chr1:245772643-245772840
  hypo

SEQ ID NO: 23801 - DNA, 30 bp, Homo sapiens; identical to SEQ ID NO: 14357
  chr1:245986707-245986737
  hypo

SEQ ID NO: 23802 - DNA, 30 bp, Homo sapiens; identical to SEQ ID NO: 14358
  chr1:246172269-246172299
  hypo

SEQ ID NO: 23803 - DNA, 30 bp, Homo sapiens; identical to SEQ ID NO: 14359
  chr1:247589929-247589959
  hypo

SEQ ID NO: 23804 - DNA, 172 bp, Homo sapiens; identical to SEQ ID NO: 14360
  chr1:247709336-247709508
  hypo

SEQ ID NO: 23805 - DNA, 180 bp, Homo sapiens; identical to SEQ ID NO: 14361
  chr1:247752018-247752198
  hypo

SEQ ID NO: 23806 - DNA, 87 bp, Homo sapiens; identical to SEQ ID NO: 14364
  chr1:248099843-248099930
  hypo

SEQ ID NO: 23807 - DNA, 11 bp, Homo sapiens
  chr1:248328690-248328701
  hypo
gctccgtctga

SEQ ID NO: 23808 - DNA, 100 bp, Homo sapiens; identical to SEQ ID NO: 14366
  chr2:314569-314669
  hypo

SEQ ID NO: 23809 - DNA, 30 bp, Homo sapiens; identical to SEQ ID NO: 14367
  chr2:484928-484958
  hypo

SEQ ID NO: 23810 - DNA, 14 bp, Homo sapiens
  chr2:496214-496228
  hypo
gaagctacaggagg

SEQ ID NO: 23811 - DNA, 3 bp, Homo sapiens
  chr2:720894-720897
  hypo
att

SEQ ID NO: 23812 - DNA, 30 bp, Homo sapiens; identical to SEQ ID NO: 14370
  chr2:1893031-1893061
  hypo

SEQ ID NO: 23813 - DNA, 189 bp, Homo sapiens; identical to SEQ ID NO: 14371
  chr2:2522670-2522859
  hypo

SEQ ID NO: 23814 - DNA, 64 bp, Homo sapiens; identical to SEQ ID NO: 14372
  chr2:2725048-2725112
  hypo

SEQ ID NO: 23815 - DNA, 30 bp, Homo sapiens; identical to SEQ ID NO: 14373
  chr2:3331786-3331816
  hypo

SEQ ID NO: 23816 - DNA, 61 bp, Homo sapiens; identical to SEQ ID NO: 14374
  chr2:3833825-3833886
  hypo

SEQ ID NO: 23817 - DNA, 57 bp, Homo sapiens; identical to SEQ ID NO: 14375
  chr2:5704308-5704365
  hypo

SEQ ID NO: 23818 - DNA, 30 bp, Homo sapiens; identical to SEQ ID NO: 14376
  chr2:7036178-7036208
  hypo

SEQ ID NO: 23819 - DNA, 272 bp, Homo sapiens; identical to SEQ ID NO: 14377
  chr2:7172487-7172759
  hypo

SEQ ID NO: 23820 - DNA, 171 bp, Homo sapiens; identical to SEQ ID NO: 14378
  chr2:8833973-8834144
  hypo

SEQ ID NO: 23821 - DNA, 30 bp, Homo sapiens; identical to SEQ ID NO: 14379
  chr2:8834800-8834830
  hypo

SEQ ID NO: 23822 - DNA, 24 bp, Homo sapiens
  chr2:8835577-8835601
  hypo
gattccaggcgtgaccccctgcgc

SEQ ID NO: 23823 - DNA, 92 bp, Homo sapiens; identical to SEQ ID NO: 14381
  chr2:8978147-8978239
  hypo

SEQ ID NO: 23824 - DNA, 180 bp, Homo sapiens; identical to SEQ ID NO: 14383
  chr2:9352635-9352815
  hypo

SEQ ID NO: 23825 - DNA, 118 bp, Homo sapiens
  chr2:10153325-10153443
  hypo
atgggagagtcaggtggacaggattgcgtatagccggatcaggtgggcaggcatgcgtatgagcgagtcaggtgggcagacatgcgtatgggcgggtcaggtggacaggcgtgtgtat

SEQ ID NO: 23826 - DNA, 240 bp, Homo sapiens; identical to SEQ ID NO: 4962
  chr2:10153898-10154138
  hypo

SEQ ID NO: 23827 - DNA, 12 bp, Homo sapiens
  chr2:10154918-10154930
  hypo
ggtcaggtgtgc

SEQ ID NO: 23828 - DNA, 77 bp, Homo sapiens; identical to SEQ ID NO: 14389
  chr2:10344641-10344718
  hypo

SEQ ID NO: 23829 - DNA, 136 bp, Homo sapiens; identical to SEQ ID NO: 14390
  chr2:10924927-10925063
  hypo

SEQ ID NO: 23830 - DNA, 30 bp, Homo sapiens; identical to SEQ ID NO: 14391
  chr2:11538637-11538667
  hypo

SEQ ID NO: 23831 - DNA, 30 bp, Homo sapiens; identical to SEQ ID NO: 14392
  chr2:18453289-18453319
  hypo

SEQ ID NO: 23832 - DNA, 23 bp, Homo sapiens
  chr2:20253274-20253297
  hypo
taagatcaggggagccgggcgcg

SEQ ID NO: 23833 - DNA, 42 bp, Homo sapiens; identical to SEQ ID NO: 14394
  chr2:20431336-20431378
  hypo

SEQ ID NO: 23834 - DNA, 142 bp, Homo sapiens; identical to SEQ ID NO: 14395
  chr2:20432683-20432825
  hypo

SEQ ID NO: 23835 - DNA, 30 bp, Homo sapiens; identical to SEQ ID NO: 14396
  chr2:20456198-20456228
  hypo

SEQ ID NO: 23836 - DNA, 30 bp, Homo sapiens; identical to SEQ ID NO: 14398
  chr2:25241776-25241806
  hypo

SEQ ID NO: 23837 - DNA, 42 bp, Homo sapiens; identical to SEQ ID NO: 14399
  chr2:27090590-27090632
  hypo

SEQ ID NO: 23838 - DNA, 111 bp, Homo sapiens
  chr2:27887555-27887666
  hypo
aggaatcaagtctggcctatcatcttcagacggctgtacacattgctatatttctgaaagtcatgttcacaatcccgaactctaaaataacttgtttggccaggcgcggtg

SEQ ID NO: 23839 - DNA, 22 bp, Homo sapiens
  chr2:32263988-32264010
  hypo
tgataggcgtgggccatcgcgc

SEQ ID NO: 23840 - DNA, 27 bp, Homo sapiens
  chr2:32551637-32551664
  hypo
tgtgagccaccgcgcccagcctaccct

SEQ ID NO: 23841 - DNA, 45 bp, Homo sapiens; identical to SEQ ID NO: 14404
  chr2:33313226-33313271
  hypo

SEQ ID NO: 23842 - DNA, 34 bp, Homo sapiens; identical to SEQ ID NO: 14405
  chr2:36824207-36824241
  hypo

SEQ ID NO: 23843 - DNA, 189 bp, Homo sapiens; identical to SEQ ID NO: 4967
  chr2:43408168-43408357
  hypo

SEQ ID NO: 23844 - DNA, 39 bp, Homo sapiens; identical to SEQ ID NO: 14407
  chr2:43412683-43412722
  hypo

SEQ ID NO: 23845 - DNA, 40 bp, Homo sapiens; identical to SEQ ID NO: 14408
  chr2:43824353-43824393
  hypo

SEQ ID NO: 23846 - DNA, 34 bp, Homo sapiens; identical to SEQ ID NO: 14409
  chr2:44224213-44224247
  hypo

SEQ ID NO: 23847 - DNA, 16 bp, Homo sapiens
  chr2:55669245-55669261
  hypo
tggagccaagatggcc

SEQ ID NO: 23848 - DNA, 30 bp, Homo sapiens; identical to SEQ ID NO: 14413
  chr2:60442223-60442253
  hypo

SEQ ID NO: 23849 - DNA, 110 bp, Homo sapiens; identical to SEQ ID NO: 14414
  chr2:60705907-60706017
  hypo

SEQ ID NO: 23850 - DNA, 30 bp, Homo sapiens; identical to SEQ ID NO: 14415
  chr2:60887794-60887824
  hypo

SEQ ID NO: 23851 - DNA, 30 bp, Homo sapiens; identical to SEQ ID NO: 14416
  chr2:61406196-61406226
  hypo

SEQ ID NO: 23852 - DNA, 86 bp, Homo sapiens; identical to SEQ ID NO: 4970
  chr2:62589799-62589885
  hypo

SEQ ID NO: 23853 - DNA, 76 bp, Homo sapiens; identical to SEQ ID NO: 14418
  chr2:64835557-64835633
  hypo

SEQ ID NO: 23854 - DNA, 20 bp, Homo sapiens
  chr2:69720191-69720211
  hypo
gaggcaggagaatggcgtga

SEQ ID NO: 23855 - DNA, 48 bp, Homo sapiens; identical to SEQ ID NO: 14421
  chr2:70364215-70364263
  hypo

SEQ ID NO: 23856 - DNA, 30 bp, Homo sapiens; identical to SEQ ID NO: 14422
  chr2:70367818-70367848
  hypo

SEQ ID NO: 23857 - DNA, 75 bp, Homo sapiens; identical to SEQ ID NO: 14423
  chr2:72778920-72778995
  hypo

SEQ ID NO: 23858 - DNA, 58 bp, Homo sapiens
  chr2:74454261-74454319
  hypo
ggggacagcgggggctcagccaggcagccagaccccgagggcccgctgggtcctggga

SEQ ID NO: 23859 - DNA, 25 bp, Homo sapiens
  chr2:74700453-74700478
  hypo
tttctttttttgagacgaagttttg

SEQ ID NO: 23860 - DNA, 24 bp, Homo sapiens
  chr2:85838299-85838323
  hypo
cagcctgggcgacagagacctagt

SEQ ID NO: 23861 - DNA, 43 bp, Homo sapiens; identical to SEQ ID NO: 4973
  chr2:86423726-86423769
  hypo

SEQ ID NO: 23862 - DNA, 65 bp, Homo sapiens
  chr2:88990264-88990329
  hypo
gcccataccagtgacttgcgctcacggaagagttctgaaggcctggaatgcgtttgaagatgagt

SEQ ID NO: 23863 - DNA, 30 bp, Homo sapiens; identical to SEQ ID NO: 14430
  chr2:95742145-95742175
  hypo

SEQ ID NO: 23864 - DNA, 40 bp, Homo sapiens
  chr2:95941812-95941852
  hypo
cacaaggcgctggcctgtgagcgcgcggccctcatggtct

SEQ ID NO: 23865 - DNA, 24 bp, Homo sapiens
  chr2:96872240-96872264
  hypo
cttaaaagtggaacacggccgggc

SEQ ID NO: 23866 - DNA, 30 bp, Homo sapiens; identical to SEQ ID NO: 14435
  chr2:98025687-98025717
  hypo

SEQ ID NO: 23867 - DNA, 28 bp, Homo sapiens
  chr2:101835069-101835097
  hypo
gcatgagccaccgcgcccagcctagtca

SEQ ID NO: 23868 - DNA, 157 bp, Homo sapiens; identical to SEQ ID NO: 14438
  chr2:105972350-105972507
  hypo

SEQ ID NO: 23869 - DNA, 191 bp, Homo sapiens; identical to SEQ ID NO: 14439
  chr2:106016141-106016332
  hypo

SEQ ID NO: 23870 - DNA, 30 bp, Homo sapiens; identical to SEQ ID NO: 14441
  chr2:106672847-106672877
  hypo

SEQ ID NO: 23871 - DNA, 30 bp, Homo sapiens
  chr2:106959338-106959368
  hypo
acactccctgcctctcgaggactctgcttg

SEQ ID NO: 23872 - DNA, 55 bp, Homo sapiens
  chr2:106959988-106960043
  hypo
cattgcaggggtgatgggacagccctgcttttgagaggcgcggcactctgccaag

SEQ ID NO: 23873 - DNA, 183 bp, Homo sapiens; identical to SEQ ID NO: 14444
  chr2:107460171-107460354
  hypo

SEQ ID NO: 23874 - DNA, 30 bp, Homo sapiens; identical to SEQ ID NO: 14445
  chr2:108160895-108160925
  hypo

SEQ ID NO: 23875 - DNA, 30 bp, Homo sapiens; identical to SEQ ID NO: 14447
  chr2:113013287-113013317
  hypo

SEQ ID NO: 23876 - DNA, 30 bp, Homo sapiens; identical to SEQ ID NO: 14448
  chr2:113103393-113103423
  hypo

SEQ ID NO: 23877 - DNA, 255 bp, Homo sapiens
  chr2:120980098-120980353
  hypo
gcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgc

SEQ ID NO: 23878 - DNA, 97 bp, Homo sapiens
  chr2:120980395-120980492
  hypo
gaagcttccacagccatatgggggcaaagacggcccagtagctccattggatgatgccgtccaggcggaggggcagcagcaccgagaagagcagcag

SEQ ID NO: 23879 - DNA, 122 bp, Homo sapiens
  chr2:122495413-122495535
  hypo
ttacagcctgagggcagcatggctgctttaagagaccaaagaggcttgtgggggagaggcacactgggtggcgccggagggtcccccttaggaggtggcgttagcaccgaggcctgaaggct

SEQ ID NO: 23880 - DNA, 135 bp, Homo sapiens; identical to SEQ ID NO: 14452
  chr2:127422944-127423079
  hypo

SEQ ID NO: 23881 - DNA, 25 bp, Homo sapiens
  chr2:127428985-127429010
  hypo
gctttatcacaggcacgagcacagg

SEQ ID NO: 23882 - DNA, 40 bp, Homo sapiens; identical to SEQ ID NO: 14455
  chr2:127435251-127435291
  hypo

SEQ ID NO: 23883 - DNA, 30 bp, Homo sapiens; identical to SEQ ID NO: 14456
  chr2:127438110-127438140
  hypo

SEQ ID NO: 23884 - DNA, 30 bp, Homo sapiens; identical to SEQ ID NO: 14457
  chr2:127438702-127438732
  hypo

SEQ ID NO: 23885 - DNA, 63 bp, Homo sapiens; identical to SEQ ID NO: 14458
  chr2:127801172-127801235
  hypo

SEQ ID NO: 23886 - DNA, 22 bp, Homo sapiens
  chr2:131114462-131114484
  hypo
tataaagattctaaacgtgggc

SEQ ID NO: 23887 - DNA, 261 bp, Homo sapiens; identical to SEQ ID NO: 14463
  chr2:131967115-131967376
  hypo

SEQ ID NO: 23888 - DNA, 19 bp, Homo sapiens
  chr2:145167762-145167781
  hypo
accgcgcccagccataaaa

SEQ ID NO: 23889 - DNA, 34 bp, Homo sapiens
  chr2:148776775-148776809
  hypo
gcaatgatgcataaacggggtccactgcccaaac

SEQ ID NO: 23890 - DNA, 34 bp, Homo sapiens; identical to SEQ ID NO: 14466
  chr2:152266037-152266071
  hypo

SEQ ID NO: 23891 - DNA, 6 bp, Homo sapiens
  chr2:170282975-170282981
  hypo
tggccc

SEQ ID NO: 23892 - DNA, 20 bp, Homo sapiens
  chr2:173036684-173036704
  hypo
caccgcgcccagcccaataa

SEQ ID NO: 23893 - DNA, 38 bp, Homo sapiens; identical to SEQ ID NO: 14474
  chr2:177498112-177498150
  hypo

SEQ ID NO: 23894 - DNA, 32 bp, Homo sapiens; identical to SEQ ID NO: 14476
  chr2:180886813-180886845
  hypo

SEQ ID NO: 23895 - DNA, 30 bp, Homo sapiens; identical to SEQ ID NO: 14477
  chr2:188236072-188236102
  hypo

SEQ ID NO: 23896 - DNA, 30 bp, Homo sapiens; identical to SEQ ID NO: 14478
  chr2:200524640-200524670
  hypo

SEQ ID NO: 23897 - DNA, 30 bp, Homo sapiens; identical to SEQ ID NO: 14479
  chr2:203129332-203129362
  hypo

SEQ ID NO: 23898 - DNA, 23 bp, Homo sapiens
  chr2:203484340-203484363
  hypo
tgccatatcgggtgcaccagtta

SEQ ID NO: 23899 - DNA, 86 bp, Homo sapiens; identical to SEQ ID NO: 14481
  chr2:207557814-207557900
  hypo

SEQ ID NO: 23900 - DNA, 30 bp, Homo sapiens; identical to SEQ ID NO: 14482
  chr2:220316287-220316317
  hypo

SEQ ID NO: 23901 - DNA, 30 bp, Homo sapiens; identical to SEQ ID NO: 14483
  chr2:223764711-223764741
  hypo

SEQ ID NO: 23902 - DNA, 30 bp, Homo sapiens; identical to SEQ ID NO: 14485
  chr2:232485651-232485681
  hypo

SEQ ID NO: 23903 - DNA, 20 bp, Homo sapiens
  chr2:233750505-233750525
  hypo
gtgacacatggggcccggca

SEQ ID NO: 23904 - DNA, 30 bp, Homo sapiens; identical to SEQ ID NO: 14487
  chr2:233960620-233960650
  hypo

SEQ ID NO: 23905 - DNA, 123 bp, Homo sapiens; identical to SEQ ID NO: 14488
  chr2:234109988-234110111
  hypo

SEQ ID NO: 23906 - DNA, 165 bp, Homo sapiens; identical to SEQ ID NO: 14489
  chr2:234369732-234369897
  hypo

SEQ ID NO: 23907 - DNA, 67 bp, Homo sapiens; identical to SEQ ID NO: 14490
  chr2:239051088-239051155
  hypo

SEQ ID NO: 23908 - DNA, 43 bp, Homo sapiens
  chr2:239957287-239957330
  hypo
tcctgcgggctcccccgtgggccaagtctcctaaactgggcca

SEQ ID NO: 23909 - DNA, 48 bp, Homo sapiens; identical to SEQ ID NO: 14492
  chr2:239997539-239997587
  hypo

SEQ ID NO: 23910 - DNA, 30 bp, Homo sapiens; identical to SEQ ID NO: 14493
  chr2:240103944-240103974
  hypo

SEQ ID NO: 23911 - DNA, 58 bp, Homo sapiens
  chr2:240169051-240169109
  hypo
cctgcagggtttggggtggaatatcccccctgtcgagtggagacgaggctgacatgag

SEQ ID NO: 23912 - DNA, 30 bp, Homo sapiens; identical to SEQ ID NO: 14496
  chr2:240658886-240658916
  hypo

SEQ ID NO: 23913 - DNA, 126 bp, Homo sapiens; identical to SEQ ID NO: 14497
  chr2:240809527-240809653
  hypo

SEQ ID NO: 23914 - DNA, 13 bp, Homo sapiens
  chr2:241095772-241095785
  hypo
attcatgaagagt

SEQ ID NO: 23915 - DNA, 21 bp, Homo sapiens
  chr2:241544980-241545001
  hypo
ttctggggtgagtgtcgagat

SEQ ID NO: 23916 - DNA, 58 bp, Homo sapiens; identical to SEQ ID NO: 14500
  chr2:241722184-241722242
  hypo

SEQ ID NO: 23917 - DNA, 207 bp, Homo sapiens
  chr2:241864987-241865194
  hypo
gtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatat

SEQ ID NO: 23918 - DNA, 46 bp, Homo sapiens; identical to SEQ ID NO: 14502
  chr2:242004922-242004968
  hypo

SEQ ID NO: 23919 - DNA, 43 bp, Homo sapiens; identical to SEQ ID NO: 14503
  chr2:242009609-242009652
  hypo

SEQ ID NO: 23920 - DNA, 30 bp, Homo sapiens; identical to SEQ ID NO: 14504
  chr2:242436356-242436386
  hypo

SEQ ID NO: 23921 - DNA, 120 bp, Homo sapiens; identical to SEQ ID NO: 4988
  chr2:242636861-242636981
  hypo

SEQ ID NO: 23922 - DNA, 91 bp, Homo sapiens; identical to SEQ ID NO: 4989
  chr2:242637041-242637132
  hypo

SEQ ID NO: 23923 - DNA, 33 bp, Homo sapiens; identical to SEQ ID NO: 14508
  chr2:242672951-242672984
  hypo

SEQ ID NO: 23924 - DNA, 34 bp, Homo sapiens
  chr2:242756110-242756144
  hypo
ggacagcagccctggcggagcaccggtccatgaa

SEQ ID NO: 23925 - DNA, 243 bp, Homo sapiens
  chr2:242756297-242756540
  hypo
cagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctccc

SEQ ID NO: 23926 - DNA, 52 bp, Homo sapiens; identical to SEQ ID NO: 14510
  chr2:242757509-242757561
  hypo

SEQ ID NO: 23927 - DNA, 36 bp, Homo sapiens; identical to SEQ ID NO: 14511
  chr2:242794906-242794942
  hypo

SEQ ID NO: 23928 - DNA, 32 bp, Homo sapiens
  chr2:242833159-242833191
  hypo
cttggcaaggcaggtggcggcaccaacaggcc

SEQ ID NO: 23929 - DNA, 33 bp, Homo sapiens
  chr2:242833525-242833558
  hypo
caggagctcagaccccggcatcagaccggcctc

SEQ ID NO: 23930 - DNA, 9 bp, Homo sapiens
  chr2:242836486-242836495
  hypo
gagcctggg

SEQ ID NO: 23931 - DNA, 47 bp, Homo sapiens; identical to SEQ ID NO: 14517
  chr2:242985116-242985163
  hypo

SEQ ID NO: 23932 - DNA, 30 bp, Homo sapiens; identical to SEQ ID NO: 14518
  chr3:3167687-3167717
  hypo

SEQ ID NO: 23933 - DNA, 30 bp, Homo sapiens; identical to SEQ ID NO: 14520
  chr3:12586227-12586257
  hypo

SEQ ID NO: 23934 - DNA, 40 bp, Homo sapiens
  chr3:13679132-13679172
  hypo
agctcaacttccagacgggcctcctggtgcctgcgcatat

SEQ ID NO: 23935 - DNA, 30 bp, Homo sapiens; identical to SEQ ID NO: 14522
  chr3:13680779-13680809
  hypo

SEQ ID NO: 23936 - DNA, 66 bp, Homo sapiens; identical to SEQ ID NO: 14524
  chr3:17499802-17499868
  hypo

SEQ ID NO: 23937 - DNA, 95 bp, Homo sapiens; identical to SEQ ID NO: 14525
  chr3:32151324-32151419
  hypo

SEQ ID NO: 23938 - DNA, 163 bp, Homo sapiens; identical to SEQ ID NO: 14526
  chr3:33841159-33841322
  hypo

SEQ ID NO: 23939 - DNA, 37 bp, Homo sapiens; identical to SEQ ID NO: 14527
  chr3:40501058-40501095
  hypo

SEQ ID NO: 23940 - DNA, 21 bp, Homo sapiens
  chr3:43664372-43664393
  hypo
tttgagatagagcctcgcaat

SEQ ID NO: 23941 - DNA, 30 bp, Homo sapiens; identical to SEQ ID NO: 14530
  chr3:45885052-45885082
  hypo

SEQ ID NO: 23942 - DNA, 22 bp, Homo sapiens
  chr3:47555871-47555893
  hypo
gccgacacggaattatatcttg

SEQ ID NO: 23943 - DNA, 170 bp, Homo sapiens; identical to SEQ ID NO: 14533
  chr3:48636676-48636846
  hypo

SEQ ID NO: 23944 - DNA, 30 bp, Homo sapiens; identical to SEQ ID NO: 14534
  chr3:48948476-48948506
  hypo

SEQ ID NO: 23945 - DNA, 19 bp, Homo sapiens
  chr3:49056918-49056937
  hypo
tttttttttttgagacgga

SEQ ID NO: 23946 - DNA, 44 bp, Homo sapiens; identical to SEQ ID NO: 14537
  chr3:49940550-49940594
  hypo

SEQ ID NO: 23947 - DNA, 30 bp, Homo sapiens; identical to SEQ ID NO: 14539
  chr3:50425383-50425413
  hypo

SEQ ID NO: 23948 - DNA, 173 bp, Homo sapiens; identical to SEQ ID NO: 14540
  chr3:50433950-50434123
  hypo

SEQ ID NO: 23949 - DNA, 14 bp, Homo sapiens
  chr3:50575602-50575616
  hypo
ggggctcaagcaat

SEQ ID NO: 23950 - DNA, 240 bp, Homo sapiens; identical to SEQ ID NO: 14543
  chr3:52553207-52553447
  hypo

SEQ ID NO: 23951 - DNA, 30 bp, Homo sapiens; identical to SEQ ID NO: 14544
  chr3:52900819-52900849
  hypo

SEQ ID NO: 23952 - DNA, 30 bp, Homo sapiens; identical to SEQ ID NO: 14546
  chr3:53033605-53033635
  hypo

SEQ ID NO: 23953 - DNA, 83 bp, Homo sapiens; identical to SEQ ID NO: 14547
  chr3:69740999-69741082
  hypo

SEQ ID NO: 23954 - DNA, 21 bp, Homo sapiens
  chr3:70083716-70083737
  hypo
aggcgtggtggctcacgctta

SEQ ID NO: 23955 - DNA, 22 bp, Homo sapiens
  chr3:73045583-73045605
  hypo
ttctgaacgtgaagtgtataca

SEQ ID NO: 23956 - DNA, 17 bp, Homo sapiens
  chr3:86960228-86960245
  hypo
tgaaagttgacacttcg

SEQ ID NO: 23957 - DNA, 163 bp, Homo sapiens; identical to SEQ ID NO: 14551
  chr3:87782694-87782857
  hypo

SEQ ID NO: 23958 - DNA, 34 bp, Homo sapiens
  chr3:101231070-101231104
  hypo
ctgtaagcatatgagtcctcgtcctctcctccta

SEQ ID NO: 23959 - DNA, 30 bp, Homo sapiens; identical to SEQ ID NO: 14555
  chr3:107833994-107834024
  hypo

SEQ ID NO: 23960 - DNA, 22 bp, Homo sapiens
  chr3:113557437-113557459
  hypo
aagtttccgagcaattcacctt

SEQ ID NO: 23961 - DNA, 49 bp, Homo sapiens; identical to SEQ ID NO: 14557
  chr3:115752446-115752495
  hypo

SEQ ID NO: 23962 - DNA, 37 bp, Homo sapiens; identical to SEQ ID NO: 14558
  chr3:118976384-118976421
  hypo

SEQ ID NO: 23963 - DNA, 120 bp, Homo sapiens; identical to SEQ ID NO: 14559
  chr3:119815773-119815893
  hypo

SEQ ID NO: 23964 - DNA, 18 bp, Homo sapiens
  chr3:119817451-119817469
  hypo
aaacgctaggattactgg

SEQ ID NO: 23965 - DNA, 25 bp, Homo sapiens
  chr3:121265940-121265965
  hypo
aaataaaagagatctcgccggccgt

SEQ ID NO: 23966 - DNA, 79 bp, Homo sapiens; identical to SEQ ID NO: 4998
  chr3:122234561-122234640
  hypo

SEQ ID NO: 23967 - DNA, 29 bp, Homo sapiens
  chr3:122573648-122573677
  hypo
gactcaaaggctgggcgcggtggctcacg

SEQ ID NO: 23968 - DNA, 6 bp, Homo sapiens
  chr3:122702282-122702288
  hypo
aaatca

SEQ ID NO: 23969 - DNA, 102 bp, Homo sapiens; identical to SEQ ID NO: 14566
  chr3:125456444-125456546
  hypo

SEQ ID NO: 23970 - DNA, 39 bp, Homo sapiens; identical to SEQ ID NO: 14567
  chr3:125785793-125785832
  hypo

SEQ ID NO: 23971 - DNA, 130 bp, Homo sapiens; identical to SEQ ID NO: 14568
  chr3:126195886-126196016
  hypo

SEQ ID NO: 23972 - DNA, 30 bp, Homo sapiens; identical to SEQ ID NO: 14570
  chr3:134320427-134320457
  hypo

SEQ ID NO: 23973 - DNA, 111 bp, Homo sapiens
  chr3:136582951-136583062
  hypo
aataaaatgtgtatttatttttctaggcattatcctttgtccaggtttctgcagtgctttcaggtccatctaaataaaatttgaaacctacgtgtaatgttggccgggctc

SEQ ID NO: 23974 - DNA, 32 bp, Homo sapiens; identical to SEQ ID NO: 14572
  chr3:137561189-137561221
  hypo

SEQ ID NO: 23975 - DNA, 57 bp, Homo sapiens; identical to SEQ ID NO: 14573
  chr3:137717830-137717887
  hypo

SEQ ID NO: 23976 - DNA, 33 bp, Homo sapiens
  chr3:141482073-141482106
  hypo
agccatagtgctgtgtttcggtcaaacaacagc

SEQ ID NO: 23977 - DNA, 35 bp, Homo sapiens; identical to SEQ ID NO: 5001
  chr3:142913215-142913250
  hypo

SEQ ID NO: 23978 - DNA, 21 bp, Homo sapiens
  chr3:142977041-142977062
  hypo
acagagcgatactccatctca

SEQ ID NO: 23979 - DNA, 45 bp, Homo sapiens; identical to SEQ ID NO: 14579
  chr3:143092973-143093018
  hypo

SEQ ID NO: 23980 - DNA, 22 bp, Homo sapiens
  chr3:143210840-143210862
  hypo
cacctaccacttggccgggtgt

SEQ ID NO: 23981 - DNA, 27 bp, Homo sapiens
  chr3:148802983-148803010
  hypo
actacaattatgggccggatgcggtgg

SEQ ID NO: 23982 - DNA, 161 bp, Homo sapiens; identical to SEQ ID NO: 14584
  chr3:150135175-150135336
  hypo

SEQ ID NO: 23983 - DNA, 76 bp, Homo sapiens; identical to SEQ ID NO: 14585
  chr3:150237920-150237996
  hypo

SEQ ID NO: 23984 - DNA, 19 bp, Homo sapiens
  chr3:152744869-152744888
  hypo
actccgtctcaaataaata

SEQ ID NO: 23985 - DNA, 27 bp, Homo sapiens
  chr3:152829598-152829625
  hypo
ggcgtgagcgaccgcacccagctgata

SEQ ID NO: 23986 - DNA, 58 bp, Homo sapiens; identical to SEQ ID NO: 14590
  chr3:172384961-172385019
  hypo

SEQ ID NO: 23987 - DNA, 37 bp, Homo sapiens; identical to SEQ ID NO: 14592
  chr3:172470190-172470227
  hypo

SEQ ID NO: 23988 - DNA, 23 bp, Homo sapiens
  chr3:179171196-179171219
  hypo
accgatcccggccccatattctt

SEQ ID NO: 23989 - DNA, 25 bp, Homo sapiens
  chr3:182812783-182812808
  hypo
tgccctggccaggcacggtggctca

SEQ ID NO: 23990 - DNA, 38 bp, Homo sapiens; identical to SEQ ID NO: 14597
  chr3:182987877-182987915
  hypo

SEQ ID NO: 23991 - DNA, 22 bp, Homo sapiens
  chr3:183183665-183183687
  hypo
ttacaggcgtgagccactgccc

SEQ ID NO: 23992 - DNA, 48 bp, Homo sapiens; identical to SEQ ID NO: 14599
  chr3:183622035-183622083
  hypo

SEQ ID NO: 23993 - DNA, 30 bp, Homo sapiens; identical to SEQ ID NO: 14600
  chr3:183648152-183648182
  hypo

SEQ ID NO: 23994 - DNA, 171 bp, Homo sapiens; identical to SEQ ID NO: 14601
  chr3:183684023-183684194
  hypo

SEQ ID NO: 23995 - DNA, 30 bp, Homo sapiens; identical to SEQ ID NO: 5005
  chr3:183965921-183965951
  hypo

SEQ ID NO: 23996 - DNA, 42 bp, Homo sapiens; identical to SEQ ID NO: 14604
  chr3:184200659-184200701
  hypo

SEQ ID NO: 23997 - DNA, 59 bp, Homo sapiens; identical to SEQ ID NO: 14605
  chr3:184785167-184785226
  hypo

SEQ ID NO: 23998 - DNA, 16 bp, Homo sapiens
  chr3:185001919-185001935
  hypo
gcggccactttccttt

SEQ ID NO: 23999 - DNA, 23 bp, Homo sapiens
  chr3:185270882-185270905
  hypo
aaaagaaaaacaggccggcacgg

SEQ ID NO: 24000 - DNA, 30 bp, Homo sapiens; identical to SEQ ID NO: 14609
  chr3:185278325-185278355
  hypo

SEQ ID NO: 24001 - DNA, 44 bp, Homo sapiens
  chr3:185363261-185363305
  hypo
tgtcaggtgttggaagggctacattcatccgttgttttgctggt

SEQ ID NO: 24002 - DNA, 25 bp, Homo sapiens
  chr3:185551925-185551950
  hypo
atcccaggctgggtgcggtggctca

SEQ ID NO: 24003 - DNA, 107 bp, Homo sapiens
  chr3:193548530-193548637
  hypo
caaccacctatttatcgttgcccaggctcctaggcctggatctgtcagccagggcctgcccatggccctgggaggtgatgggagtggtggtagtttcagtctctgat

SEQ ID NO: 24004 - DNA, 30 bp, Homo sapiens; identical to SEQ ID NO: 14615
  chr3:193588129-193588159
  hypo

SEQ ID NO: 24005 - DNA, 36 bp, Homo sapiens; identical to SEQ ID NO: 14616
  chr3:193922775-193922811
  hypo

SEQ ID NO: 24006 - DNA, 30 bp, Homo sapiens; identical to SEQ ID NO: 14618
  chr3:195536686-195536716
  hypo

SEQ ID NO: 24007 - DNA, 59 bp, Homo sapiens; identical to SEQ ID NO: 14620
  chr3:195597490-195597549
  hypo

SEQ ID NO: 24008 - DNA, 68 bp, Homo sapiens; identical to SEQ ID NO: 14621
  chr3:195599772-195599840
  hypo

SEQ ID NO: 24009 - DNA, 77 bp, Homo sapiens; identical to SEQ ID NO: 14622
  chr3:195600494-195600571
  hypo

SEQ ID NO: 24010 - DNA, 110 bp, Homo sapiens; identical to SEQ ID NO: 14623
  chr3:195600916-195601026
  hypo

SEQ ID NO: 24011 - DNA, 36 bp, Homo sapiens; identical to SEQ ID NO: 14624
  chr3:195637307-195637343
  hypo

SEQ ID NO: 24012 - DNA, 30 bp, Homo sapiens; identical to SEQ ID NO: 14625
  chr3:195648737-195648767
  hypo

SEQ ID NO: 24013 - DNA, 30 bp, Homo sapiens; identical to SEQ ID NO: 14627
  chr3:196256292-196256322
  hypo

SEQ ID NO: 24014 - DNA, 30 bp, Homo sapiens; identical to SEQ ID NO: 14628
  chr3:196294577-196294607
  hypo

SEQ ID NO: 24015 - DNA, 137 bp, Homo sapiens
  chr3:196387158-196387295
  hypo
caacctcccctgcatcgtggacttcgggctcacgcggctgcgggtcctcaacgtcagctacaacgtcctggagtggttcctcgcgaccgggggagaggctgccttcgagctggagacgctggacctgtctcacaacc

SEQ ID NO: 24016 - DNA, 213 bp, Homo sapiens
  chr3:196387415-196387628
  hypo
cccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagc

SEQ ID NO: 24017 - DNA, 30 bp, Homo sapiens; identical to SEQ ID NO: 14632
  chr3:196754516-196754546
  hypo

SEQ ID NO: 24018 - DNA, 34 bp, Homo sapiens; identical to SEQ ID NO: 14633
  chr3:197313900-197313934
  hypo

SEQ ID NO: 24019 - DNA, 34 bp, Homo sapiens; identical to SEQ ID NO: 14635
  chr3:197327804-197327838
  hypo

SEQ ID NO: 24020 - DNA, 32 bp, Homo sapiens; identical to SEQ ID NO: 14636
  chr3:197402171-197402203
  hypo

SEQ ID NO: 24021 - DNA, 61 bp, Homo sapiens; identical to SEQ ID NO: 14637
  chr4:619541-619602
  hypo

SEQ ID NO: 24022 - DNA, 30 bp, Homo sapiens; identical to SEQ ID NO: 14638
  chr4:628444-628474
  hypo

SEQ ID NO: 24023 - DNA, 284 bp, Homo sapiens
  chr4:650912-651196
  hypo
gtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatg

SEQ ID NO: 24024 - DNA, 53 bp, Homo sapiens
  chr4:651261-651314
  hypo
ggacgagatccagctcatcctggtgcggcggggcaggacgtccaggggtcacc

SEQ ID NO: 24025 - DNA, 137 bp, Homo sapiens; identical to SEQ ID NO: 14640
  chr4:660921-661058
  hypo

SEQ ID NO: 24026 - DNA, 59 bp, Homo sapiens; identical to SEQ ID NO: 14641
  chr4:718181-718240
  hypo

SEQ ID NO: 24027 - DNA, 102 bp, Homo sapiens; identical to SEQ ID NO: 14642
  chr4:738388-738490
  hypo

SEQ ID NO: 24028 - DNA, 82 bp, Homo sapiens; identical to SEQ ID NO: 14643
  chr4:828978-829060
  hypo

SEQ ID NO: 24029 - DNA, 22 bp, Homo sapiens
  chr4:829641-829663
  hypo
agctccccgaggaaagagtgcc

SEQ ID NO: 24030 - DNA, 416 bp, Homo sapiens
  chr4:955919-956335
  hypo
ccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagca

SEQ ID NO: 24031 - DNA, 179 bp, Homo sapiens; identical to SEQ ID NO: 14647
  chr4:956578-956757
  hypo

SEQ ID NO: 24032 - DNA, 42 bp, Homo sapiens; identical to SEQ ID NO: 14648
  chr4:1016960-1017002
  hypo

SEQ ID NO: 24033 - DNA, 36 bp, Homo sapiens; identical to SEQ ID NO: 14649
  chr4:1024375-1024411
  hypo

SEQ ID NO: 24034 - DNA, 53 bp, Homo sapiens
  chr4:1025875-1025928
  hypo
cctgggcacgcaggccgacatggattctgtggctgaggccgtcagcgtgtgaa

SEQ ID NO: 24035 - DNA, 63 bp, Homo sapiens
  chr4:1026074-1026137
  hypo
tctgaggggcaaccccaccagcctgcttgggccccagcgtcttctcagcgtctgcctcctgtg

SEQ ID NO: 24036 - DNA, 117 bp, Homo sapiens; identical to SEQ ID NO: 14651
  chr4:1036393-1036510
  hypo

SEQ ID NO: 24037 - DNA, 108 bp, Homo sapiens; identical to SEQ ID NO: 14652
  chr4:1299074-1299182
  hypo

SEQ ID NO: 24038 - DNA, 30 bp, Homo sapiens; identical to SEQ ID NO: 5013
  chr4:1299450-1299480
  hypo

SEQ ID NO: 24039 - DNA, 88 bp, Homo sapiens; identical to SEQ ID NO: 14654
  chr4:1332572-1332660
  hypo

SEQ ID NO: 24040 - DNA, 178 bp, Homo sapiens; identical to SEQ ID NO: 14655
  chr4:1332886-1333064
  hypo

SEQ ID NO: 24041 - DNA, 27 bp, Homo sapiens
  chr4:1338688-1338715
  hypo
ctggcagaagcttcccggcagagggat

SEQ ID NO: 24042 - DNA, 138 bp, Homo sapiens; identical to SEQ ID NO: 14657
  chr4:1504936-1505074
  hypo

SEQ ID NO: 24043 - DNA, 24 bp, Homo sapiens
  chr4:1512344-1512368
  hypo
tgcggttttaacctgcgttttcct

SEQ ID NO: 24044 - DNA, 21 bp, Homo sapiens
  chr4:1556398-1556419
  hypo
tgtccacccccagaccgcctt

SEQ ID NO: 24045 - DNA, 30 bp, Homo sapiens; identical to SEQ ID NO: 14660
  chr4:1562145-1562175
  hypo

SEQ ID NO: 24046 - DNA, 21 bp, Homo sapiens
  chr4:1576463-1576484
  hypo
aggtgggcctggagccggtgg

SEQ ID NO: 24047 - DNA, 82 bp, Homo sapiens
  chr4:1616600-1616682
  hypo
ggggtgccccatggccgtcctatgctgacggacaccagatggcatttcagcaccgggcacaggggccgctttaaacagcaaa

SEQ ID NO: 24048 - DNA, 235 bp, Homo sapiens; identical to SEQ ID NO: 14663
  chr4:1687244-1687479
  hypo

SEQ ID NO: 24049 - DNA, 82 bp, Homo sapiens; identical to SEQ ID NO: 14664
  chr4:1803282-1803364
  hypo

SEQ ID NO: 24050 - DNA, 147 bp, Homo sapiens; identical to SEQ ID NO: 14665
  chr4:1807505-1807652
  hypo

SEQ ID NO: 24051 - DNA, 61 bp, Homo sapiens; identical to SEQ ID NO: 14666
  chr4:1977033-1977094
  hypo

SEQ ID NO: 24052 - DNA, 74 bp, Homo sapiens; identical to SEQ ID NO: 14668
  chr4:1994756-1994830
  hypo

SEQ ID NO: 24053 - DNA, 33 bp, Homo sapiens; identical to SEQ ID NO: 14669
  chr4:2065634-2065667
  hypo

SEQ ID NO: 24054 - DNA, 91 bp, Homo sapiens
  chr4:2305827-2305918
  hypo
gtgcctctgcagccagctcctgcccctgcccctcctcacacacagaccccacactcggccagggcccagcacctgccggtggccaagatgg

SEQ ID NO: 24055 - DNA, 5 bp, Homo sapiens
  chr4:2527902-2527907
  hypo
aaact

SEQ ID NO: 24056 - DNA, 36 bp, Homo sapiens; identical to SEQ ID NO: 14673
  chr4:2932947-2932983
  hypo

SEQ ID NO: 24057 - DNA, 30 bp, Homo sapiens; identical to SEQ ID NO: 14674
  chr4:3310521-3310551
  hypo

SEQ ID NO: 24058 - DNA, 47 bp, Homo sapiens; identical to SEQ ID NO: 14675
  chr4:3445894-3445941
  hypo

SEQ ID NO: 24059 - DNA, 304 bp, Homo sapiens; identical to SEQ ID NO: 14676
  chr4:3446463-3446767
  hypo

SEQ ID NO: 24060 - DNA, 82 bp, Homo sapiens; identical to SEQ ID NO: 14678
  chr4:4256159-4256241
  hypo

SEQ ID NO: 24061 - DNA, 31 bp, Homo sapiens
  chr4:6670153-6670184
  hypo
acgtgcaagacaccacgttttactgccccgc

SEQ ID NO: 24062 - DNA, 37 bp, Homo sapiens; identical to SEQ ID NO: 14680
  chr4:6719869-6719906
  hypo

SEQ ID NO: 24063 - DNA, 17 bp, Homo sapiens
  chr4:6748557-6748574
  hypo
gtcggcctgggtctgga

SEQ ID NO: 24064 - DNA, 110 bp, Homo sapiens; identical to SEQ ID NO: 14683
  chr4:7047093-7047203
  hypo

SEQ ID NO: 24065 - DNA, 30 bp, Homo sapiens
  chr4:7647740-7647770
  hypo
tgccctagagtcaaacgtgttcattcggtc

SEQ ID NO: 24066 - DNA, 9 bp, Homo sapiens
  chr4:7647945-7647954
  hypo
gcgcacacg

SEQ ID NO: 24067 - DNA, 179 bp, Homo sapiens; identical to SEQ ID NO: 14685
  chr4:7741325-7741504
  hypo

SEQ ID NO: 24068 - DNA, 38 bp, Homo sapiens; identical to SEQ ID NO: 14686
  chr4:8607740-8607778
  hypo

SEQ ID NO: 24069 - DNA, 33 bp, Homo sapiens; identical to SEQ ID NO: 14687
  chr4:8608618-8608651
  hypo

SEQ ID NO: 24070 - DNA, 30 bp, Homo sapiens; identical to SEQ ID NO: 14688
  chr4:8615890-8615920
  hypo

SEQ ID NO: 24071 - DNA, 55 bp, Homo sapiens; identical to SEQ ID NO: 14689
  chr4:39448324-39448379
  hypo

SEQ ID NO: 24072 - DNA, 98 bp, Homo sapiens; identical to SEQ ID NO: 5017
  chr4:39816677-39816775
  hypo

SEQ ID NO: 24073 - DNA, 38 bp, Homo sapiens; identical to SEQ ID NO: 5018
  chr4:39817075-39817113
  hypo

SEQ ID NO: 24074 - DNA, 23 bp, Homo sapiens
  chr4:40910280-40910303
  hypo
actgtgagaaaagaacgtttctg

SEQ ID NO: 24075 - DNA, 28 bp, Homo sapiens
  chr4:74468515-74468543
  hypo
caagtttcggccaggcgcggtggctcat

SEQ ID NO: 24076 - DNA, 44 bp, Homo sapiens
  chr4:75241435-75241479
  hypo
accctagtttgcaagtgtttgggagcagacgcatattgcaggaa

SEQ ID NO: 24077 - DNA, 30 bp, Homo sapiens; identical to SEQ ID NO: 14695
  chr4:76912406-76912436
  hypo

SEQ ID NO: 24078 - DNA, 41 bp, Homo sapiens; identical to SEQ ID NO: 14696
  chr4:84169961-84170002
  hypo

SEQ ID NO: 24079 - DNA, 37 bp, Homo sapiens; identical to SEQ ID NO: 14697
  chr4:87899606-87899643
  hypo

SEQ ID NO: 24080 - DNA, 18 bp, Homo sapiens
  chr4:95762911-95762929
  hypo
attcggccatcttggctc

SEQ ID NO: 24081 - DNA, 24 bp, Homo sapiens
  chr4:110735814-110735838
  hypo
accacgccccgcctacaaaggtat

SEQ ID NO: 24082 - DNA, 30 bp, Homo sapiens; identical to SEQ ID NO: 14701
  chr4:113154853-113154883
  hypo

SEQ ID NO: 24083 - DNA, 12 bp, Homo sapiens
  chr4:113559151-113559163
  hypo
tattaaaacatt

SEQ ID NO: 24084 - DNA, 34 bp, Homo sapiens; identical to SEQ ID NO: 14703
  chr4:113559426-113559460
  hypo

SEQ ID NO: 24085 - DNA, 89 bp, Homo sapiens; identical to SEQ ID NO: 14704
  chr4:123866964-123867053
  hypo

SEQ ID NO: 24086 - DNA, 27 bp, Homo sapiens
  chr4:128984288-128984315
  hypo
aaagtaaaaatgggccggcgcggtggc

SEQ ID NO: 24087 - DNA, 135 bp, Homo sapiens; identical to SEQ ID NO: 14706
  chr4:154216763-154216898
  hypo

SEQ ID NO: 24088 - DNA, 65 bp, Homo sapiens; identical to SEQ ID NO: 14707
  chr4:154540165-154540230
  hypo

SEQ ID NO: 24089 - DNA, 67 bp, Homo sapiens; identical to SEQ ID NO: 14708
  chr4:170484641-170484708
  hypo

SEQ ID NO: 24090 - DNA, 132 bp, Homo sapiens
  chr5:480880-481012
  hypo
caagcaaacacagatcgctcagaaaatgggaacccagggcaaattgtatgtgctccttactgggtttattataagtgtcacatgttttttataataaaacataggtgatttcaccttaatggacaaactctt

SEQ ID NO: 24091 - DNA, 30 bp, Homo sapiens; identical to SEQ ID NO: 14711
  chr5:488962-488992
  hypo

SEQ ID NO: 24092 - DNA, 219 bp, Homo sapiens
  chr5:491536-491755
  hypo
tgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagcca

SEQ ID NO: 24093 - DNA, 32 bp, Homo sapiens; identical to SEQ ID NO: 14713
  chr5:492064-492096
  hypo

SEQ ID NO: 24094 - DNA, 72 bp, Homo sapiens
  chr5:538686-538758
  hypo
cctgtgcctgcctgacgatgccgcctcagccgcccagggctccctcagggaaaacgtcgccaagcaccgacg

SEQ ID NO: 24095 - DNA, 145 bp, Homo sapiens
  chr5:538806-538951
  hypo
tgtggcaccaggctggccaggggactgttggaacatttgcggaggagcacagttgccatttccttcatgccacacctgccccagcttgtgtctgtgtgtgatggcacggtttgggctggcaggaggggcacgggtgcttgggtgt

SEQ ID NO: 24096 - DNA, 333 bp, Homo sapiens
  chr5:554538-554871
  hypo
ggataaaccaggggtggggtctgggtcacaggatgacccgggggtgggtcacgggataaaccaggggtggggggctgggtcacgggatgaacggggggcgggtcacaggatgaaccgtgggcgggtcatgggataaaccagggtggggtctgggtcacaggatgacccgggggtgggtcacgggataaaccaggggtggggggtgggtcacgggatgaacggggggcgggtcacaggatgaaccgtgggtgggtcatgggataaaccagggtggggtctgggtcacgggatgaacggggttgggggctgggtcacgggatgaaccggggggtg

SEQ ID NO: 24097 - DNA, 16 bp, Homo sapiens
  chr5:554900-554916
  hypo
tcacgggctaaaccgg

SEQ ID NO: 24098 - DNA, 2 bp, Homo sapiens
  chr5:555156-555158
  hypo
aa

SEQ ID NO: 24099 - DNA, 94 bp, Homo sapiens; identical to SEQ ID NO: 14717
  chr5:556211-556305
  hypo

SEQ ID NO: 24100 - DNA, 6 bp, Homo sapiens
  chr5:677883-677889
  hypo
tgtcca

SEQ ID NO: 24101 - DNA, 17 bp, Homo sapiens
  chr5:678006-678023
  hypo
gccggaaggcctcctcc

SEQ ID NO: 24102 - DNA, 30 bp, Homo sapiens; identical to SEQ ID NO: 14719
  chr5:1003129-1003159
  hypo

SEQ ID NO: 24103 - DNA, 38 bp, Homo sapiens; identical to SEQ ID NO: 14720
  chr5:1021444-1021482
  hypo

SEQ ID NO: 24104 - DNA, 230 bp, Homo sapiens
  chr5:1034370-1034600
  hypo
gtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttca

SEQ ID NO: 24105 - DNA, 82 bp, Homo sapiens; identical to SEQ ID NO: 14722
  chr5:1073600-1073682
  hypo

SEQ ID NO: 24106 - DNA, 136 bp, Homo sapiens; identical to SEQ ID NO: 14723
  chr5:1073918-1074054
  hypo

SEQ ID NO: 24107 - DNA, 125 bp, Homo sapiens; identical to SEQ ID NO: 5026
  chr5:1174263-1174388
  hypo

SEQ ID NO: 24108 - DNA, 32 bp, Homo sapiens; identical to SEQ ID NO: 14725
  chr5:1189595-1189627
  hypo

SEQ ID NO: 24109 - DNA, 29 bp, Homo sapiens
  chr5:1193944-1193973
  hypo
tctgagcggaacagcgagccacctgcagc

SEQ ID NO: 24110 - DNA, 16 bp, Homo sapiens
  chr5:1221181-1221197
  hypo
gttcgggtagcagaac

SEQ ID NO: 24111 - DNA, 30 bp, Homo sapiens; identical to SEQ ID NO: 14728
  chr5:1223271-1223301
  hypo

SEQ ID NO: 24112 - DNA, 30 bp, Homo sapiens; identical to SEQ ID NO: 14729
  chr5:1233049-1233079
  hypo

SEQ ID NO: 24113 - DNA, 47 bp, Homo sapiens; identical to SEQ ID NO: 14731
  chr5:1746593-1746640
  hypo

SEQ ID NO: 24114 - DNA, 19 bp, Homo sapiens
  chr5:1747003-1747022
  hypo
tgggtgctgggtccccggc

SEQ ID NO: 24115 - DNA, 56 bp, Homo sapiens
  chr5:1747098-1747154
  hypo
caccacagcggaagtcggtctctctcatcctggagtccgcgcggctgagggcgagg

SEQ ID NO: 24116 - DNA, 30 bp, Homo sapiens; identical to SEQ ID NO: 14733
  chr5:1795233-1795263
  hypo

SEQ ID NO: 24117 - DNA, 30 bp, Homo sapiens; identical to SEQ ID NO: 14734
  chr5:1865547-1865577
  hypo

SEQ ID NO: 24118 - DNA, 30 bp, Homo sapiens; identical to SEQ ID NO: 14735
  chr5:1949574-1949604
  hypo

SEQ ID NO: 24119 - DNA, 17 bp, Homo sapiens
  chr5:1950777-1950794
  hypo
ccctcggcagcttcacg

SEQ ID NO: 24120 - DNA, 211 bp, Homo sapiens
  chr5:1950960-1951171
  hypo
gtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgct

SEQ ID NO: 24121 - DNA, 150 bp, Homo sapiens; identical to SEQ ID NO: 14737
  chr5:2136920-2137070
  hypo

SEQ ID NO: 24122 - DNA, 30 bp, Homo sapiens; identical to SEQ ID NO: 14738
  chr5:2180638-2180668
  hypo

SEQ ID NO: 24123 - DNA, 68 bp, Homo sapiens; identical to SEQ ID NO: 14739
  chr5:2369614-2369682
  hypo

SEQ ID NO: 24124 - DNA, 6 bp, Homo sapiens
  chr5:2541481-2541487
  hypo
gtgtgc

SEQ ID NO: 24125 - DNA, 19 bp, Homo sapiens
  chr5:2541611-2541630
  hypo
gtgccgactctgatgtgcg

SEQ ID NO: 24126 - DNA, 30 bp, Homo sapiens; identical to SEQ ID NO: 14741
  chr5:3221107-3221137
  hypo

SEQ ID NO: 24127 - DNA, 198 bp, Homo sapiens
  chr5:3324844-3325042
  hypo
caagagcaaagccaccgctccacgcctgcccggggaattggtggccgagcttatctgggaccactggtccacgcgatgccccgtgacgggccaggaagggttcaggcttggaaatgtcggacggggacgactctgggccttgctggttggtggagctgggagcagcttcattctcctctgactgtgtggacacagccc

SEQ ID NO: 24128 - DNA, 5 bp, Homo sapiens
  chr5:3674048-3674053
  hypo
ctctg

SEQ ID NO: 24129 - DNA, 30 bp, Homo sapiens; identical to SEQ ID NO: 14744
  chr5:3740976-3741006
  hypo

SEQ ID NO: 24130 - DNA, 165 bp, Homo sapiens; identical to SEQ ID NO: 14745
  chr5:3806428-3806593
  hypo

SEQ ID NO: 24131 - DNA, 10 bp, Homo sapiens
  chr5:4144357-4144367
  hypo
atgtgttctg

SEQ ID NO: 24132 - DNA, 32 bp, Homo sapiens; identical to SEQ ID NO: 14747
  chr5:4629575-4629607
  hypo

SEQ ID NO: 24133 - DNA, 20 bp, Homo sapiens
  chr5:10248726-10248746
  hypo
tatagcgcactgtaaactga

SEQ ID NO: 24134 - DNA, 167 bp, Homo sapiens; identical to SEQ ID NO: 14749
  chr5:10267279-10267446
  hypo

SEQ ID NO: 24135 - DNA, 30 bp, Homo sapiens; identical to SEQ ID NO: 14750
  chr5:10675402-10675432
  hypo

SEQ ID NO: 24136 - DNA, 30 bp, Homo sapiens; identical to SEQ ID NO: 14751
  chr5:14732034-14732064
  hypo

SEQ ID NO: 24137 - DNA, 28 bp, Homo sapiens
  chr5:14774569-14774597
  hypo
acagtcgcgctctgtcgcccagtctgga

SEQ ID NO: 24138 - DNA, 30 bp, Homo sapiens; identical to SEQ ID NO: 14753
  chr5:16032780-16032810
  hypo

SEQ ID NO: 24139 - DNA, 78 bp, Homo sapiens; identical to SEQ ID NO: 14754
  chr5:16436327-16436405
  hypo

SEQ ID NO: 24140 - DNA, 57 bp, Homo sapiens; identical to SEQ ID NO: 14756
  chr5:17502391-17502448
  hypo

SEQ ID NO: 24141 - DNA, 16 bp, Homo sapiens
  chr5:32526565-32526581
  hypo
cttctccacgccgggc

SEQ ID NO: 24142 - DNA, 30 bp, Homo sapiens; identical to SEQ ID NO: 14758
  chr5:33162572-33162602
  hypo

SEQ ID NO: 24143 - DNA, 25 bp, Homo sapiens
  chr5:33234426-33234451
  hypo
tgagctgacacgcctggctgaattt

SEQ ID NO: 24144 - DNA, 27 bp, Homo sapiens
  chr5:33298124-33298151
  hypo
gcaccctgctggcgcaccctgctggcg

SEQ ID NO: 24145 - DNA, 35 bp, Homo sapiens; identical to SEQ ID NO: 14761
  chr5:37255512-37255547
  hypo

SEQ ID NO: 24146 - DNA, 16 bp, Homo sapiens
  chr5:39343165-39343181
  hypo
tgaacaggaacagctc

SEQ ID NO: 24147 - DNA, 33 bp, Homo sapiens; identical to SEQ ID NO: 1561
  chr5:43402630-43402663
  hypo

SEQ ID NO: 24148 - DNA, 30 bp, Homo sapiens; identical to SEQ ID NO: 14764
  chr5:64860574-64860604
  hypo

SEQ ID NO: 24149 - DNA, 30 bp, Homo sapiens; identical to SEQ ID NO: 14765
  chr5:67840329-67840359
  hypo

SEQ ID NO: 24150 - DNA, 22 bp, Homo sapiens
  chr5:68391002-68391024
  hypo
gtaatagcattataacgtaact

SEQ ID NO: 24151 - DNA, 21 bp, Homo sapiens
  chr5:74536034-74536055
  hypo
aatttttttttgagacggagt

SEQ ID NO: 24152 - DNA, 17 bp, Homo sapiens
  chr5:77047294-77047311
  hypo
gccggccagcctgacca

SEQ ID NO: 24153 - DNA, 30 bp, Homo sapiens; identical to SEQ ID NO: 14769
  chr5:78985161-78985191
  hypo

SEQ ID NO: 24154 - DNA, 30 bp, Homo sapiens; identical to SEQ ID NO: 5034
  chr5:79947734-79947764
  hypo

SEQ ID NO: 24155 - DNA, 30 bp, Homo sapiens; identical to SEQ ID NO: 14774
  chr5:98201074-98201104
  hypo

SEQ ID NO: 24156 - DNA, 172 bp, Homo sapiens; identical to SEQ ID NO: 14776
  chr5:112198328-112198500
  hypo

SEQ ID NO: 24157 - DNA, 30 bp, Homo sapiens; identical to SEQ ID NO: 14777
  chr5:126200056-126200086
  hypo

SEQ ID NO: 24158 - DNA, 30 bp, Homo sapiens; identical to SEQ ID NO: 14778
  chr5:131610019-131610049
  hypo

SEQ ID NO: 24159 - DNA, 30 bp, Homo sapiens; identical to SEQ ID NO: 14779
  chr5:132083934-132083964
  hypo

SEQ ID NO: 24160 - DNA, 31 bp, Homo sapiens; identical to SEQ ID NO: 14780
  chr5:137548023-137548054
  hypo

SEQ ID NO: 24161 - DNA, 30 bp, Homo sapiens; identical to SEQ ID NO: 14781
  chr5:137769708-137769738
  hypo

SEQ ID NO: 24162 - DNA, 19 bp, Homo sapiens
  chr5:139556366-139556385
  hypo
agacctggcctggtgcggt

SEQ ID NO: 24163 - DNA, 30 bp, Homo sapiens; identical to SEQ ID NO: 14784
  chr5:151383730-151383760
  hypo

SEQ ID NO: 24164 - DNA, 12 bp, Homo sapiens
  chr5:157078407-157078419
  hypo
cgagcctgcagt

SEQ ID NO: 24165 - DNA, 39 bp, Homo sapiens; identical to SEQ ID NO: 14789
  chr5:158612937-158612976
  hypo

SEQ ID NO: 24166 - DNA, 22 bp, Homo sapiens
  chr5:159672080-159672102
  hypo
ggtaggggctgggtgcggtggc

SEQ ID NO: 24167 - DNA, 8 bp, Homo sapiens
  chr5:166865441-166865449
  hypo
gctggagt

SEQ ID NO: 24168 - DNA, 141 bp, Homo sapiens; identical to SEQ ID NO: 14792
  chr5:168192180-168192321
  hypo

SEQ ID NO: 24169 - DNA, 30 bp, Homo sapiens; identical to SEQ ID NO: 14793
  chr5:168268106-168268136
  hypo

SEQ ID NO: 24170 - DNA, 17 bp, Homo sapiens
  chr5:168337470-168337487
  hypo
gggcgtggtggctcacg

SEQ ID NO: 24171 - DNA, 30 bp, Homo sapiens; identical to SEQ ID NO: 14795
  chr5:169157436-169157466
  hypo

SEQ ID NO: 24172 - DNA, 30 bp, Homo sapiens; identical to SEQ ID NO: 14797
  chr5:172235667-172235697
  hypo

SEQ ID NO: 24173 - DNA, 30 bp, Homo sapiens; identical to SEQ ID NO: 14798
  chr5:175610717-175610747
  hypo

SEQ ID NO: 24174 - DNA, 17 bp, Homo sapiens
  chr5:175876289-175876306
  hypo
cccccaggccaggagcg

SEQ ID NO: 24175 - DNA, 17 bp, Homo sapiens
  chr5:175876606-175876623
  hypo
ttcgggagatcaaatgg

SEQ ID NO: 24176 - DNA, 30 bp, Homo sapiens; identical to SEQ ID NO: 14801
  chr5:175924856-175924886
  hypo

SEQ ID NO: 24177 - DNA, 30 bp, Homo sapiens; identical to SEQ ID NO: 14803
  chr5:175975036-175975066
  hypo

SEQ ID NO: 24178 - DNA, 23 bp, Homo sapiens
  chr5:175978997-175979020
  hypo
accgcgcccggttaatagttccc

SEQ ID NO: 24179 - DNA, 30 bp, Homo sapiens; identical to SEQ ID NO: 14805
  chr5:176225880-176225910
  hypo

SEQ ID NO: 24180 - DNA, 92 bp, Homo sapiens; identical to SEQ ID NO: 14806
  chr5:176315380-176315472
  hypo

SEQ ID NO: 24181 - DNA, 20 bp, Homo sapiens
  chr5:177019993-177020013
  hypo
ccttctgtcacttttcgtta

SEQ ID NO: 24182 - DNA, 25 bp, Homo sapiens
  chr5:177031197-177031222
  hypo
cggcctccctcggaagtgttccgtc

SEQ ID NO: 24183 - DNA, 37 bp, Homo sapiens
  chr5:177713468-177713505
  hypo
actcagcttcgtctttaattcccgacagtcctgtcat

SEQ ID NO: 24184 - DNA, 30 bp, Homo sapiens; identical to SEQ ID NO: 14810
  chr5:177982679-177982709
  hypo

SEQ ID NO: 24185 - DNA, 30 bp, Homo sapiens; identical to SEQ ID NO: 14811
  chr5:178481870-178481900
  hypo

SEQ ID NO: 24186 - DNA, 34 bp, Homo sapiens; identical to SEQ ID NO: 14812
  chr5:178565449-178565483
  hypo

SEQ ID NO: 24187 - DNA, 37 bp, Homo sapiens
  chr5:178655871-178655908
  hypo
ctgcactgaagtctgtggtgtgcggtcacctgagaac

SEQ ID NO: 24188 - DNA, 49 bp, Homo sapiens; identical to SEQ ID NO: 14815
  chr5:178665413-178665462
  hypo

SEQ ID NO: 24189 - DNA, 30 bp, Homo sapiens; identical to SEQ ID NO: 14816
  chr5:178878685-178878715
  hypo

SEQ ID NO: 24190 - DNA, 27 bp, Homo sapiens
  chr5:178969579-178969606
  hypo
agaatgggccaggtgcggtggctcacg

SEQ ID NO: 24191 - DNA, 41 bp, Homo sapiens
  chr5:179214072-179214113
  hypo
aggggtggggcccagcgggatcccagcatcgtggctctggc

SEQ ID NO: 24192 - DNA, 69 bp, Homo sapiens
  chr5:179214196-179214265
  hypo
gggactgagtgaggagaccagtcaccacccggtgcaaactgagtcccttccacgcgggaaagggccacg

SEQ ID NO: 24193 - DNA, 30 bp, Homo sapiens; identical to SEQ ID NO: 14819
  chr5:180041104-180041134
  hypo

SEQ ID NO: 24194 - DNA, 53 bp, Homo sapiens; identical to SEQ ID NO: 14820
  chr5:180057500-180057553
  hypo

SEQ ID NO: 24195 - DNA, 33 bp, Homo sapiens; identical to SEQ ID NO: 14821
  chr5:180709002-180709035
  hypo

SEQ ID NO: 24196 - DNA, 35 bp, Homo sapiens; identical to SEQ ID NO: 14822
  chr6:348724-348759
  hypo

SEQ ID NO: 24197 - DNA, 39 bp, Homo sapiens; identical to SEQ ID NO: 14823
  chr6:448927-448966
  hypo

SEQ ID NO: 24198 - DNA, 65 bp, Homo sapiens
  chr6:3285157-3285222
  hypo
atagtgtccaacctacggccaacttcagctgcagttcttggagggcaacggggagaaagagaaaa

SEQ ID NO: 24199 - DNA, 30 bp, Homo sapiens; identical to SEQ ID NO: 14827
  chr6:6045657-6045687
  hypo

SEQ ID NO: 24200 - DNA, 7 bp, Homo sapiens
  chr6:6367079-6367086
  hypo
agcagtg

SEQ ID NO: 24201 - DNA, 61 bp, Homo sapiens; identical to SEQ ID NO: 14829
  chr6:6534792-6534853
  hypo

SEQ ID NO: 24202 - DNA, 66 bp, Homo sapiens; identical to SEQ ID NO: 14830
  chr6:6891420-6891486
  hypo

SEQ ID NO: 24203 - DNA, 21 bp, Homo sapiens
  chr6:7237775-7237796
  hypo
cgctcgcgttggggcttgcag

SEQ ID NO: 24204 - DNA, 16 bp, Homo sapiens
  chr6:10595805-10595821
  hypo
ccggttggttgggttg

SEQ ID NO: 24205 - DNA, 22 bp, Homo sapiens
  chr6:12288681-12288703
  hypo
tgtcctccgggagctgtggcct

SEQ ID NO: 24206 - DNA, 30 bp, Homo sapiens; identical to SEQ ID NO: 14834
  chr6:13293172-13293202
  hypo

SEQ ID NO: 24207 - DNA, 38 bp, Homo sapiens; identical to SEQ ID NO: 14835
  chr6:15456030-15456068
  hypo

SEQ ID NO: 24208 - DNA, 21 bp, Homo sapiens
  chr6:16197009-16197030
  hypo
agtagaaaacaaaagcgggct

SEQ ID NO: 24209 - DNA, 25 bp, Homo sapiens
  chr6:16218445-16218470
  hypo
gcctgcacaccggggctgtaaatgg

SEQ ID NO: 24210 - DNA, 30 bp, Homo sapiens; identical to SEQ ID NO: 14838
  chr6:16293453-16293483
  hypo

SEQ ID NO: 24211 - DNA, 17 bp, Homo sapiens
  chr6:18035850-18035867
  hypo
gtcctcaccactctccg

SEQ ID NO: 24212 - DNA, 92 bp, Homo sapiens; identical to SEQ ID NO: 14840
  chr6:20239485-20239577
  hypo

SEQ ID NO: 24213 - DNA, 102 bp, Homo sapiens
  chr6:34170868-34170970
  hypo
cttctgtcggctccatggagccggaggcccgggtctgcctccgtttggtttgggtggccatggtttgggtggctgcagcggcaccccagggcgctcctgccc

SEQ ID NO: 24214 - DNA, 18 bp, Homo sapiens
  chr6:34171061-34171079
  hypo
caccgccaggagtgtggg

SEQ ID NO: 24215 - DNA, 30 bp, Homo sapiens; identical to SEQ ID NO: 14846
  chr6:34514348-34514378
  hypo

SEQ ID NO: 24216 - DNA, 23 bp, Homo sapiens
  chr6:34854786-34854809
  hypo
tgggtccctgatcaccgggtgcg

SEQ ID NO: 24217 - DNA, 30 bp, Homo sapiens; identical to SEQ ID NO: 14848
  chr6:35149810-35149840
  hypo

SEQ ID NO: 24218 - DNA, 27 bp, Homo sapiens
  chr6:35150080-35150107
  hypo
gcagccaccgggcgcccagctggggtc

SEQ ID NO: 24219 - DNA, 37 bp, Homo sapiens; identical to SEQ ID NO: 14850
  chr6:35309524-35309561
  hypo

SEQ ID NO: 24220 - DNA, 30 bp, Homo sapiens; identical to SEQ ID NO: 14851
  chr6:36165619-36165649
  hypo

SEQ ID NO: 24221 - DNA, 30 bp, Homo sapiens; identical to SEQ ID NO: 14852
  chr6:36831576-36831606
  hypo

SEQ ID NO: 24222 - DNA, 177 bp, Homo sapiens
  chr6:37024382-37024559
  hypo
ggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcaggg

SEQ ID NO: 24223 - DNA, 44 bp, Homo sapiens
  chr6:37024589-37024633
  hypo
agcaggcaccctctgaggggcagagacctcgttccctcagctcc

SEQ ID NO: 24224 - DNA, 30 bp, Homo sapiens; identical to SEQ ID NO: 14854
  chr6:37053276-37053306
  hypo

SEQ ID NO: 24225 - DNA, 30 bp, Homo sapiens; identical to SEQ ID NO: 14855
  chr6:37391410-37391440
  hypo

SEQ ID NO: 24226 - DNA, 36 bp, Homo sapiens; identical to SEQ ID NO: 5047
  chr6:42062066-42062102
  hypo

SEQ ID NO: 24227 - DNA, 23 bp, Homo sapiens
  chr6:42813507-42813530
  hypo
ttatagattcctggccgggcgcg

SEQ ID NO: 24228 - DNA, 38 bp, Homo sapiens; identical to SEQ ID NO: 14858
  chr6:42846392-42846430
  hypo

SEQ ID NO: 24229 - DNA, 37 bp, Homo sapiens; identical to SEQ ID NO: 14859
  chr6:42846610-42846647
  hypo

SEQ ID NO: 24230 - DNA, 90 bp, Homo sapiens; identical to SEQ ID NO: 14860
  chr6:43424517-43424607
  hypo

SEQ ID NO: 24231 - DNA, 30 bp, Homo sapiens; identical to SEQ ID NO: 14862
  chr6:43486338-43486368
  hypo

SEQ ID NO: 24232 - DNA, 41 bp, Homo sapiens; identical to SEQ ID NO: 14865
  chr6:44437145-44437186
  hypo

SEQ ID NO: 24233 - DNA, 25 bp, Homo sapiens
  chr6:52156895-52156920
  hypo
gtttcaaaactttggcgccgggcgc

SEQ ID NO: 24234 - DNA, 30 bp, Homo sapiens; identical to SEQ ID NO: 14867
  chr6:52268217-52268247
  hypo

SEQ ID NO: 24235 - DNA, 180 bp, Homo sapiens; identical to SEQ ID NO: 5048
  chr6:52928863-52929043
  hypo

SEQ ID NO: 24236 - DNA, 21 bp, Homo sapiens
  chr6:57694617-57694638
  hypo
aagaaccgccagtaacaacat

SEQ ID NO: 24237 - DNA, 23 bp, Homo sapiens
  chr6:74234189-74234212
  hypo
gaaaagatgatggcccggtgcgg

SEQ ID NO: 24238 - DNA, 102 bp, Homo sapiens; identical to SEQ ID NO: 14871
  chr6:84513455-84513557
  hypo

SEQ ID NO: 24239 - DNA, 68 bp, Homo sapiens
  chr6:86302345-86302413
  hypo
tcaattttaacctttcggaatatttcaggtttttttggggagggtggcatcaagtcctcttaagaata

SEQ ID NO: 24240 - DNA, 81 bp, Homo sapiens; identical to SEQ ID NO: 14873
  chr6:89857646-89857727
  hypo

SEQ ID NO: 24241 - DNA, 30 bp, Homo sapiens; identical to SEQ ID NO: 14874
  chr6:90367322-90367352
  hypo

SEQ ID NO: 24242 - DNA, 29 bp, Homo sapiens
  chr6:99396702-99396731
  hypo
gctgggattacagccgtgagccaccgcgc

SEQ ID NO: 24243 - DNA, 30 bp, Homo sapiens; identical to SEQ ID NO: 14876
  chr6:105750542-105750572
  hypo

SEQ ID NO: 24244 - DNA, 31 bp, Homo sapiens
  chr6:108280352-108280383
  hypo
gacagatttgaatctacgctgtgcccatctt

SEQ ID NO: 24245 - DNA, 17 bp, Homo sapiens
  chr6:109057736-109057753
  hypo
tgttaggaatattctcg

SEQ ID NO: 24246 - DNA, 82 bp, Homo sapiens; identical to SEQ ID NO: 14879
  chr6:109059835-109059917
  hypo

SEQ ID NO: 24247 - DNA, 30 bp, Homo sapiens; identical to SEQ ID NO: 14880
  chr6:116574057-116574087
  hypo

SEQ ID NO: 24248 - DNA, 99 bp, Homo sapiens; identical to SEQ ID NO: 5053
  chr6:137144497-137144596
  hypo

SEQ ID NO: 24249 - DNA, 92 bp, Homo sapiens; identical to SEQ ID NO: 14884
  chr6:138790478-138790570
  hypo

SEQ ID NO: 24250 - DNA, 151 bp, Homo sapiens; identical to SEQ ID NO: 14885
  chr6:149177419-149177570
  hypo

SEQ ID NO: 24251 - DNA, 30 bp, Homo sapiens; identical to SEQ ID NO: 14887
  chr6:155988231-155988261
  hypo

SEQ ID NO: 24252 - DNA, 39 bp, Homo sapiens; identical to SEQ ID NO: 14888
  chr6:157478299-157478338
  hypo

SEQ ID NO: 24253 - DNA, 30 bp, Homo sapiens; identical to SEQ ID NO: 14889
  chr6:157637384-157637414
  hypo

SEQ ID NO: 24254 - DNA, 30 bp, Homo sapiens; identical to SEQ ID NO: 14890
  chr6:157638386-157638416
  hypo

SEQ ID NO: 24255 - DNA, 30 bp, Homo sapiens; identical to SEQ ID NO: 14891
  chr6:158119028-158119058
  hypo

SEQ ID NO: 24256 - DNA, 82 bp, Homo sapiens; identical to SEQ ID NO: 14892
  chr6:159049801-159049883
  hypo

SEQ ID NO: 24257 - DNA, 30 bp, Homo sapiens; identical to SEQ ID NO: 14893
  chr6:159569380-159569410
  hypo

SEQ ID NO: 24258 - DNA, 55 bp, Homo sapiens; identical to SEQ ID NO: 14894
  chr6:160511899-160511954
  hypo

SEQ ID NO: 24259 - DNA, 39 bp, Homo sapiens; identical to SEQ ID NO: 14895
  chr6:161672733-161672772
  hypo

SEQ ID NO: 24260 - DNA, 32 bp, Homo sapiens; identical to SEQ ID NO: 14896
  chr6:161690517-161690549
  hypo

SEQ ID NO: 24261 - DNA, 80 bp, Homo sapiens
  chr6:161780139-161780219
  hypo
ataggtgcatgccaatcccttcattttctaggagcactgctgcatgcaatggagtaataaggacacgctgggtaaattat

SEQ ID NO: 24262 - DNA, 41 bp, Homo sapiens; identical to SEQ ID NO: 14898
  chr6:162257990-162258031
  hypo

SEQ ID NO: 24263 - DNA, 18 bp, Homo sapiens
  chr6:164114295-164114313
  hypo
ttatttttttgagaccga

SEQ ID NO: 24264 - DNA, 44 bp, Homo sapiens; identical to SEQ ID NO: 14900
  chr6:164183729-164183773
  hypo

SEQ ID NO: 24265 - DNA, 15 bp, Homo sapiens
  chr6:164197003-164197018
  hypo
cgtcttctgacaaac

SEQ ID NO: 24266 - DNA, 18 bp, Homo sapiens
  chr6:164215474-164215492
  hypo
gggcctggtggctcacgc

SEQ ID NO: 24267 - DNA, 64 bp, Homo sapiens
  chr6:164228363-164228427
  hypo
aacagagggaccctccctgctgttctgttcacacggaagcgtgtctcagcgtctgggggcttgg

SEQ ID NO: 24268 - DNA, 20 bp, Homo sapiens
  chr6:164283234-164283254
  hypo
gaagcatgtccccagcgtgg

SEQ ID NO: 24269 - DNA, 30 bp, Homo sapiens; identical to SEQ ID NO: 14906
  chr6:164288079-164288109
  hypo

SEQ ID NO: 24270 - DNA, 36 bp, Homo sapiens; identical to SEQ ID NO: 14907
  chr6:164322607-164322643
  hypo

SEQ ID NO: 24271 - DNA, 30 bp, Homo sapiens; identical to SEQ ID NO: 14908
  chr6:164323901-164323931
  hypo

SEQ ID NO: 24272 - DNA, 30 bp, Homo sapiens; identical to SEQ ID NO: 14909
  chr6:166891687-166891717
  hypo

SEQ ID NO: 24273 - DNA, 109 bp, Homo sapiens
  chr6:166944403-166944512
  hypo
aggccccatccagcccaacagcctgctcgcagcctgctgctctgctttcccaatgccgctccacggcagaacatatgtgggagaatggtatttacgcaatacagctctt

SEQ ID NO: 24274 - DNA, 32 bp, Homo sapiens; identical to SEQ ID NO: 14911
  chr6:167835094-167835126
  hypo

SEQ ID NO: 24275 - DNA, 30 bp, Homo sapiens; identical to SEQ ID NO: 14912
  chr6:168453452-168453482
  hypo

SEQ ID NO: 24276 - DNA, 30 bp, Homo sapiens; identical to SEQ ID NO: 14914
  chr6:169562411-169562441
  hypo

SEQ ID NO: 24277 - DNA, 77 bp, Homo sapiens
  chr6:170475028-170475105
  hypo
ttcttgggtgacaatcgaggggtcctgacccagcacccgtgggcacacccttatttggaaattgggcctagcccgga

SEQ ID NO: 24278 - DNA, 217 bp, Homo sapiens
  chr6:170475267-170475484
  hypo
ggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacg

SEQ ID NO: 24279 - DNA, 24 bp, Homo sapiens
  chr7:328544-328568
  hypo
gattacaggcgtgagtcaccgtgc

SEQ ID NO: 24280 - DNA, 30 bp, Homo sapiens; identical to SEQ ID NO: 14918
  chr7:409617-409647
  hypo

SEQ ID NO: 24281 - DNA, 208 bp, Homo sapiens
  chr7:431492-431700
  hypo
agggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcag

SEQ ID NO: 24282 - DNA, 30 bp, Homo sapiens; identical to SEQ ID NO: 14921
  chr7:502957-502987
  hypo

SEQ ID NO: 24283 - DNA, 30 bp, Homo sapiens; identical to SEQ ID NO: 14924
  chr7:819668-819698
  hypo

SEQ ID NO: 24284 - DNA, 404 bp, Homo sapiens; identical to SEQ ID NO: 14925
  chr7:834330-834734
  hypo

SEQ ID NO: 24285 - DNA, 83 bp, Homo sapiens; identical to SEQ ID NO: 14926
  chr7:1027233-1027316
  hypo

SEQ ID NO: 24286 - DNA, 55 bp, Homo sapiens
  chr7:1054524-1054579
  hypo
gccccttcctgcctgcgggccctccctgccctgcagggacggtgcagtgagcaca

SEQ ID NO: 24287 - DNA, 38 bp, Homo sapiens
  chr7:1308497-1308535
  hypo
cccggcctgttccgcgtgcaacgcgctgttctcccatc

SEQ ID NO: 24288 - DNA, 106 bp, Homo sapiens
  chr7:1325704-1325810
  hypo
ccccgcggcgtggcacggcctgggcgttggatgcagcagtgaacgggacccacgcggggactcagggtatgacgggcagaggggtaggtggggtgggggcaggtga

SEQ ID NO: 24289 - DNA, 32 bp, Homo sapiens; identical to SEQ ID NO: 14932
  chr7:1351574-1351606
  hypo

SEQ ID NO: 24290 - DNA, 43 bp, Homo sapiens; identical to SEQ ID NO: 14933
  chr7:1384833-1384876
  hypo

SEQ ID NO: 24291 - DNA, 57 bp, Homo sapiens; identical to SEQ ID NO: 14934
  chr7:1395730-1395787
  hypo

SEQ ID NO: 24292 - DNA, 22 bp, Homo sapiens
  chr7:1459019-1459041
  hypo
ccacttccacctgcccgggcct

SEQ ID NO: 24293 - DNA, 30 bp, Homo sapiens; identical to SEQ ID NO: 14936
  chr7:1460840-1460870
  hypo

SEQ ID NO: 24294 - DNA, 30 bp, Homo sapiens; identical to SEQ ID NO: 14938
  chr7:1598982-1599012
  hypo

SEQ ID NO: 24295 - DNA, 13 bp, Homo sapiens
  chr7:1641923-1641936
  hypo
tgccttccaggtg

SEQ ID NO: 24296 - DNA, 30 bp, Homo sapiens; identical to SEQ ID NO: 14942
  chr7:1694042-1694072
  hypo

SEQ ID NO: 24297 - DNA, 30 bp, Homo sapiens; identical to SEQ ID NO: 14944
  chr7:1734737-1734767
  hypo

SEQ ID NO: 24298 - DNA, 59 bp, Homo sapiens; identical to SEQ ID NO: 14945
  chr7:1783243-1783302
  hypo

SEQ ID NO: 24299 - DNA, 47 bp, Homo sapiens; identical to SEQ ID NO: 14947
  chr7:2110154-2110201
  hypo

SEQ ID NO: 24300 - DNA, 33 bp, Homo sapiens
  chr7:2232930-2232963
  hypo
ctccgacagccaccacgtcctggagagaaagcg

SEQ ID NO: 24301 - DNA, 160 bp, Homo sapiens; identical to SEQ ID NO: 14951
  chr7:2564711-2564871
  hypo

SEQ ID NO: 24302 - DNA, 28 bp, Homo sapiens
  chr7:2566630-2566658
  hypo
gggtctctctaagcggcatgactctaca

SEQ ID NO: 24303 - DNA, 210 bp, Homo sapiens; identical to SEQ ID NO: 14953
  chr7:2686448-2686658
  hypo

SEQ ID NO: 24304 - DNA, 28 bp, Homo sapiens
  chr7:2731870-2731898
  hypo
gggttgaaagaggaccgagcttggccgg

SEQ ID NO: 24305 - DNA, 35 bp, Homo sapiens; identical to SEQ ID NO: 14955
  chr7:2798456-2798491
  hypo

SEQ ID NO: 24306 - DNA, 30 bp, Homo sapiens; identical to SEQ ID NO: 14956
  chr7:3033477-3033507
  hypo

SEQ ID NO: 24307 - DNA, 61 bp, Homo sapiens; identical to SEQ ID NO: 14958
  chr7:4214953-4215014
  hypo

SEQ ID NO: 24308 - DNA, 30 bp, Homo sapiens; identical to SEQ ID NO: 14959
  chr7:4751426-4751456
  hypo

SEQ ID NO: 24309 - DNA, 82 bp, Homo sapiens; identical to SEQ ID NO: 14960
  chr7:4781972-4782054
  hypo

SEQ ID NO: 24310 - DNA, 87 bp, Homo sapiens; identical to SEQ ID NO: 14961
  chr7:4813783-4813870
  hypo

SEQ ID NO: 24311 - DNA, 161 bp, Homo sapiens; identical to SEQ ID NO: 14962
  chr7:4840190-4840351
  hypo

SEQ ID NO: 24312 - DNA, 50 bp, Homo sapiens; identical to SEQ ID NO: 14963
  chr7:4841057-4841107
  hypo

SEQ ID NO: 24313 - DNA, 113 bp, Homo sapiens
  chr7:4856871-4856984
  hypo
tggagacatagtagacgcactgctggaaggcgtacagcaccacctcctccagcaccgccatggcctcctcgctggccgtcagcgtgcaggagaacagcgattccttcgagcct

SEQ ID NO: 24314 - DNA, 30 bp, Homo sapiens; identical to SEQ ID NO: 14965
  chr7:5316401-5316431
  hypo

SEQ ID NO: 24315 - DNA, 23 bp, Homo sapiens
  chr7:5589502-5589525
  hypo
agtaagtgaagaggccgggcgcg

SEQ ID NO: 24316 - DNA, 35 bp, Homo sapiens; identical to SEQ ID NO: 14967
  chr7:5647869-5647904
  hypo

SEQ ID NO: 24317 - DNA, 26 bp, Homo sapiens
  chr7:5648393-5648419
  hypo
accccataccccgagggtggctcctc

SEQ ID NO: 24318 - DNA, 37 bp, Homo sapiens; identical to SEQ ID NO: 14970
  chr7:6143252-6143289
  hypo

SEQ ID NO: 24319 - DNA, 60 bp, Homo sapiens
  chr7:6443376-6443436
  hypo
tgttcctttgggtctgtgaggttctgtaaactgtgctagtgctgacgatgttctgtacaa

SEQ ID NO: 24320 - DNA, 86 bp, Homo sapiens; identical to SEQ ID NO: 14972
  chr7:6499253-6499339
  hypo

SEQ ID NO: 24321 - DNA, 70 bp, Homo sapiens
  chr7:6524907-6524977
  hypo
aaacttgaatatttctacgggatggggacgtcacaagaaattgcaaacaaaaaaagctgacaaacaggat

SEQ ID NO: 24322 - DNA, 75 bp, Homo sapiens
  chr7:6525012-6525087
  hypo
aaacgcacagttcgcagttcaaaaagcagggcgggggcgaggacctggtgcggtggctcatgcctgtagtcccaa

SEQ ID NO: 24323 - DNA, 23 bp, Homo sapiens
  chr7:6560212-6560235
  hypo
gctggaagaagctctcgagggcc

SEQ ID NO: 24324 - DNA, 56 bp, Homo sapiens
  chr7:6560345-6560401
  hypo
ggaggtgagcgccgacgacgggttgggtgagtccagagaatcggagtctgctggga

SEQ ID NO: 24325 - DNA, 30 bp, Homo sapiens; identical to SEQ ID NO: 14975
  chr7:7102938-7102968
  hypo

SEQ ID NO: 24326 - DNA, 273 bp, Homo sapiens; identical to SEQ ID NO: 1572
  chr7:7605157-7605430
  hypo

SEQ ID NO: 24327 - DNA, 24 bp, Homo sapiens
  chr7:20710238-20710262
  hypo
aagaagcaagctggccgggtgcgg

SEQ ID NO: 24328 - DNA, 186 bp, Homo sapiens; identical to SEQ ID NO: 14980
  chr7:25495487-25495673
  hypo

SEQ ID NO: 24329 - DNA, 29 bp, Homo sapiens
  chr7:25530898-25530927
  hypo
aatttgtattaaaggcggggcgcagtgac

SEQ ID NO: 24330 - DNA, 30 bp, Homo sapiens; identical to SEQ ID NO: 14982
  chr7:31116621-31116651
  hypo

SEQ ID NO: 24331 - DNA, 84 bp, Homo sapiens; identical to SEQ ID NO: 5064
  chr7:36428640-36428724
  hypo

SEQ ID NO: 24332 - DNA, 30 bp, Homo sapiens; identical to SEQ ID NO: 14984
  chr7:37264509-37264539
  hypo

SEQ ID NO: 24333 - DNA, 181 bp, Homo sapiens; identical to SEQ ID NO: 14985
  chr7:37279183-37279364
  hypo

SEQ ID NO: 24334 - DNA, 39 bp, Homo sapiens; identical to SEQ ID NO: 14986
  chr7:37770953-37770992
  hypo

SEQ ID NO: 24335 - DNA, 30 bp, Homo sapiens; identical to SEQ ID NO: 14987
  chr7:38740329-38740359
  hypo

SEQ ID NO: 24336 - DNA, 17 bp, Homo sapiens
  chr7:43767864-43767881
  hypo
tacgttttaaatggtga

SEQ ID NO: 24337 - DNA, 33 bp, Homo sapiens; identical to SEQ ID NO: 14989
  chr7:43865061-43865094
  hypo

SEQ ID NO: 24338 - DNA, 93 bp, Homo sapiens; identical to SEQ ID NO: 14990
  chr7:43865154-43865247
  hypo

SEQ ID NO: 24339 - DNA, 28 bp, Homo sapiens
  chr7:44083432-44083460
  hypo
gagccaccgtgcccggcaggatttatat

SEQ ID NO: 24340 - DNA, 30 bp, Homo sapiens; identical to SEQ ID NO: 14992
  chr7:44151353-44151383
  hypo

SEQ ID NO: 24341 - DNA, 41 bp, Homo sapiens; identical to SEQ ID NO: 5065
  chr7:44151615-44151656
  hypo

SEQ ID NO: 24342 - DNA, 30 bp, Homo sapiens; identical to SEQ ID NO: 14994
  chr7:44152191-44152221
  hypo

SEQ ID NO: 24343 - DNA, 20 bp, Homo sapiens
  chr7:45027140-45027160
  hypo
cagagcgagactctgtctca

SEQ ID NO: 24344 - DNA, 128 bp, Homo sapiens
  chr7:50438648-50438776
  hypo
ggagtgagcgatttaggaactcacagaagggcacggccaggcaactcgggccctggcaaatgttccatagagacagcatccatggggttgaaccaagcacaatgcctgcaaatcgggcaggcgggttc

SEQ ID NO: 24345 - DNA, 30 bp, Homo sapiens; identical to SEQ ID NO: 15000
  chr7:54794762-54794792
  hypo

SEQ ID NO: 24346 - DNA, 37 bp, Homo sapiens; identical to SEQ ID NO: 15001
  chr7:55145943-55145980
  hypo

SEQ ID NO: 24347 - DNA, 91 bp, Homo sapiens; identical to SEQ ID NO: 15003
  chr7:65880043-65880134
  hypo

SEQ ID NO: 24348 - DNA, 42 bp, Homo sapiens; identical to SEQ ID NO: 15004
  chr7:69036110-69036152
  hypo

SEQ ID NO: 24349 - DNA, 179 bp, Homo sapiens; identical to SEQ ID NO: 15005
  chr7:69313694-69313873
  hypo

SEQ ID NO: 24350 - DNA, 41 bp, Homo sapiens; identical to SEQ ID NO: 15007
  chr7:97797757-97797798
  hypo

SEQ ID NO: 24351 - DNA, 198 bp, Homo sapiens; identical to SEQ ID NO: 15009
  chr7:98183080-98183278
  hypo

SEQ ID NO: 24352 - DNA, 30 bp, Homo sapiens; identical to SEQ ID NO: 15011
  chr7:98991702-98991732
  hypo

SEQ ID NO: 24353 - DNA, 273 bp, Homo sapiens; identical to SEQ ID NO: 15012
  chr7:99020719-99020992
  hypo

SEQ ID NO: 24354 - DNA, 37 bp, Homo sapiens; identical to SEQ ID NO: 15013
  chr7:99700198-99700235
  hypo

SEQ ID NO: 24355 - DNA, 49 bp, Homo sapiens
  chr7:100088134-100088183
  hypo
agcagaggtcgaggacggtgcccgggcctggaatggcagtgccgagggt

SEQ ID NO: 24356 - DNA, 30 bp, Homo sapiens; identical to SEQ ID NO: 15015
  chr7:100179772-100179802
  hypo

SEQ ID NO: 24357 - DNA, 30 bp, Homo sapiens; identical to SEQ ID NO: 15016
  chr7:100799119-100799149
  hypo

SEQ ID NO: 24358 - DNA, 67 bp, Homo sapiens; identical to SEQ ID NO: 5069
  chr7:101652623-101652690
  hypo

SEQ ID NO: 24359 - DNA, 78 bp, Homo sapiens; identical to SEQ ID NO: 15018
  chr7:101656381-101656459
  hypo

SEQ ID NO: 24360 - DNA, 24 bp, Homo sapiens
  chr7:102782042-102782066
  hypo
atcttcttagattcacggtatctt

SEQ ID NO: 24361 - DNA, 30 bp, Homo sapiens; identical to SEQ ID NO: 1575
  chr7:128097589-128097619
  hypo

SEQ ID NO: 24362 - DNA, 30 bp, Homo sapiens; identical to SEQ ID NO: 15024
  chr7:128493200-128493230
  hypo

SEQ ID NO: 24363 - DNA, 30 bp, Homo sapiens; identical to SEQ ID NO: 15025
  chr7:128528857-128528887
  hypo

SEQ ID NO: 24364 - DNA, 30 bp, Homo sapiens; identical to SEQ ID NO: 15026
  chr7:128529102-128529132
  hypo

SEQ ID NO: 24365 - DNA, 18 bp, Homo sapiens
  chr7:129794721-129794739
  hypo
gtgcgcccatcagggtgt

SEQ ID NO: 24366 - DNA, 30 bp, Homo sapiens; identical to SEQ ID NO: 15029
  chr7:131231034-131231064
  hypo

SEQ ID NO: 24367 - DNA, 20 bp, Homo sapiens
  chr7:135196094-135196114
  hypo
tttttttttttgagacggag

SEQ ID NO: 24368 - DNA, 135 bp, Homo sapiens; identical to SEQ ID NO: 15032
  chr7:135401363-135401498
  hypo

SEQ ID NO: 24369 - DNA, 30 bp, Homo sapiens; identical to SEQ ID NO: 15033
  chr7:137664095-137664125
  hypo

SEQ ID NO: 24370 - DNA, 41 bp, Homo sapiens; identical to SEQ ID NO: 15034
  chr7:139650651-139650692
  hypo

SEQ ID NO: 24371 - DNA, 21 bp, Homo sapiens
  chr7:140026923-140026944
  hypo
acggagcgagattctgtctca

SEQ ID NO: 24372 - DNA, 16 bp, Homo sapiens
  chr7:140097283-140097299
  hypo
gcgcccaacccgaagc

SEQ ID NO: 24373 - DNA, 30 bp, Homo sapiens; identical to SEQ ID NO: 15037
  chr7:140156648-140156678
  hypo

SEQ ID NO: 24374 - DNA, 86 bp, Homo sapiens
  chr7:148640250-148640336
  hypo
ttcaatgtgctaaatgtgataggcacttcaatatccacttcaggtgacaaataattagaaatgaggtccaccgtgaaggaaatgga

SEQ ID NO: 24375 - DNA, 63 bp, Homo sapiens
  chr7:148846075-148846138
  hypo
cttaaattctctaggcgtcacgtttaaaaagtaaaaagccaggcgctgtgttgtgcacgcctg

SEQ ID NO: 24376 - DNA, 71 bp, Homo sapiens
  chr7:150049533-150049604
  hypo
accagaatgtcttatcgttgaaattattttttacttccttttgaaatgcttgagtttttttgtttgttttg

SEQ ID NO: 24377 - DNA, 30 bp, Homo sapiens; identical to SEQ ID NO: 15041
  chr7:150070259-150070289
  hypo

SEQ ID NO: 24378 - DNA, 76 bp, Homo sapiens; identical to SEQ ID NO: 15042
  chr7:150746248-150746324
  hypo

SEQ ID NO: 24379 - DNA, 99 bp, Homo sapiens; identical to SEQ ID NO: 15043
  chr7:150774704-150774803
  hypo

SEQ ID NO: 24380 - DNA, 30 bp, Homo sapiens; identical to SEQ ID NO: 15044
  chr7:150823844-150823874
  hypo

SEQ ID NO: 24381 - DNA, 19 bp, Homo sapiens
  chr7:150870889-150870908
  hypo
tccccgtgccaagggccac

SEQ ID NO: 24382 - DNA, 57 bp, Homo sapiens; identical to SEQ ID NO: 15046
  chr7:150871142-150871199
  hypo

SEQ ID NO: 24383 - DNA, 18 bp, Homo sapiens
  chr7:151591649-151591667
  hypo
ggctcaagccctccccga

SEQ ID NO: 24384 - DNA, 43 bp, Homo sapiens; identical to SEQ ID NO: 15048
  chr7:152337501-152337544
  hypo

SEQ ID NO: 24385 - DNA, 175 bp, Homo sapiens; identical to SEQ ID NO: 15049
  chr7:152693809-152693984
  hypo

SEQ ID NO: 24386 - DNA, 30 bp, Homo sapiens; identical to SEQ ID NO: 15051
  chr7:154670104-154670134
  hypo

SEQ ID NO: 24387 - DNA, 32 bp, Homo sapiens; identical to SEQ ID NO: 15052
  chr7:155202839-155202871
  hypo

SEQ ID NO: 24388 - DNA, 43 bp, Homo sapiens; identical to SEQ ID NO: 15053
  chr7:155363419-155363462
  hypo

SEQ ID NO: 24389 - DNA, 14 bp, Homo sapiens
  chr7:155580876-155580890
  hypo
atcgacagctaaaa

SEQ ID NO: 24390 - DNA, 100 bp, Homo sapiens; identical to SEQ ID NO: 15058
  chr7:155753587-155753687
  hypo

SEQ ID NO: 24391 - DNA, 131 bp, Homo sapiens; identical to SEQ ID NO: 15059
  chr7:155899015-155899146
  hypo

SEQ ID NO: 24392 - DNA, 86 bp, Homo sapiens
  chr7:156744713-156744799
  hypo
tcatataaacttagatattacttttaaacaagtttgaaattgtttttaggacactttccctccaaaattagcggtttgtttaattt

SEQ ID NO: 24393 - DNA, 25 bp, Homo sapiens
  chr7:156832823-156832848
  hypo
aagcggacttgggagcgacggggtt

SEQ ID NO: 24394 - DNA, 28 bp, Homo sapiens
  chr7:156880561-156880589
  hypo
gcacggccctcggcgtggatatccggaa

SEQ ID NO: 24395 - DNA, 63 bp, Homo sapiens; identical to SEQ ID NO: 15064
  chr7:157084534-157084597
  hypo

SEQ ID NO: 24396 - DNA, 30 bp, Homo sapiens
  chr7:157085343-157085373
  hypo
gggggaggccaggaccgtggagttctagag

SEQ ID NO: 24397 - DNA, 17 bp, Homo sapiens
  chr7:157085946-157085963
  hypo
gagcctctgctcccacg

SEQ ID NO: 24398 - DNA, 33 bp, Homo sapiens
  chr7:157086082-157086115
  hypo
gttctccggatctccagacgtttaggctgaaag

SEQ ID NO: 24399 - DNA, 239 bp, Homo sapiens; identical to SEQ ID NO: 15067
  chr7:157255083-157255322
  hypo

SEQ ID NO: 24400 - DNA, 236 bp, Homo sapiens
  chr7:157262579-157262815
  hypo
actccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaa

SEQ ID NO: 24401 - DNA, 276 bp, Homo sapiens
  chr7:157263018-157263294
  hypo
ggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcc

SEQ ID NO: 24402 - DNA, 30 bp, Homo sapiens; identical to SEQ ID NO: 15069
  chr7:157294288-157294318
  hypo

SEQ ID NO: 24403 - DNA, 57 bp, Homo sapiens; identical to SEQ ID NO: 15070
  chr7:157337964-157338021
  hypo

SEQ ID NO: 24404 - DNA, 43 bp, Homo sapiens; identical to SEQ ID NO: 15071
  chr7:157353030-157353073
  hypo

SEQ ID NO: 24405 - DNA, 65 bp, Homo sapiens; identical to SEQ ID NO: 15072
  chr7:157396449-157396514
  hypo

SEQ ID NO: 24406 - DNA, 167 bp, Homo sapiens; identical to SEQ ID NO: 15073
  chr7:157403604-157403771
  hypo

SEQ ID NO: 24407 - DNA, 32 bp, Homo sapiens; identical to SEQ ID NO: 15074
  chr7:157448480-157448512
  hypo

SEQ ID NO: 24408 - DNA, 48 bp, Homo sapiens; identical to SEQ ID NO: 15075
  chr7:157565500-157565548
  hypo

SEQ ID NO: 24409 - DNA, 30 bp, Homo sapiens; identical to SEQ ID NO: 15076
  chr7:157568187-157568217
  hypo

SEQ ID NO: 24410 - DNA, 33 bp, Homo sapiens
  chr7:157584208-157584241
  hypo
cctccctgcacccgcccccgctccctgcaccca

SEQ ID NO: 24411 - DNA, 30 bp, Homo sapiens; identical to SEQ ID NO: 15079
  chr7:157588963-157588993
  hypo

SEQ ID NO: 24412 - DNA, 16 bp, Homo sapiens
  chr7:157606736-157606752
  hypo
gcgaggcagtggtcgc

SEQ ID NO: 24413 - DNA, 30 bp, Homo sapiens; identical to SEQ ID NO: 15081
  chr7:157633412-157633442
  hypo

SEQ ID NO: 24414 - DNA, 192 bp, Homo sapiens; identical to SEQ ID NO: 15082
  chr7:157659256-157659448
  hypo

SEQ ID NO: 24415 - DNA, 161 bp, Homo sapiens; identical to SEQ ID NO: 15083
  chr7:157776781-157776942
  hypo

SEQ ID NO: 24416 - DNA, 30 bp, Homo sapiens; identical to SEQ ID NO: 15084
  chr7:157793858-157793888
  hypo

SEQ ID NO: 24417 - DNA, 30 bp, Homo sapiens; identical to SEQ ID NO: 15085
  chr7:157877477-157877507
  hypo

SEQ ID NO: 24418 - DNA, 30 bp, Homo sapiens; identical to SEQ ID NO: 15086
  chr7:157958638-157958668
  hypo

SEQ ID NO: 24419 - DNA, 34 bp, Homo sapiens; identical to SEQ ID NO: 15087
  chr7:158301521-158301555
  hypo

SEQ ID NO: 24420 - DNA, 140 bp, Homo sapiens; identical to SEQ ID NO: 15088
  chr8:972710-972850
  hypo

SEQ ID NO: 24421 - DNA, 30 bp, Homo sapiens; identical to SEQ ID NO: 15089
  chr8:1048584-1048614
  hypo

SEQ ID NO: 24422 - DNA, 88 bp, Homo sapiens; identical to SEQ ID NO: 15090
  chr8:1137245-1137333
  hypo

SEQ ID NO: 24423 - DNA, 99 bp, Homo sapiens; identical to SEQ ID NO: 15091
  chr8:1246701-1246800
  hypo

SEQ ID NO: 24424 - DNA, 102 bp, Homo sapiens; identical to SEQ ID NO: 15092
  chr8:1302692-1302794
  hypo

SEQ ID NO: 24425 - DNA, 37 bp, Homo sapiens; identical to SEQ ID NO: 15093
  chr8:1471545-1471582
  hypo

SEQ ID NO: 24426 - DNA, 30 bp, Homo sapiens; identical to SEQ ID NO: 15094
  chr8:2652772-2652802
  hypo

SEQ ID NO: 24427 - DNA, 28 bp, Homo sapiens
  chr8:8639463-8639491
  hypo
agcgggatgcagccgtagggccagccac

SEQ ID NO: 24428 - DNA, 30 bp, Homo sapiens; identical to SEQ ID NO: 15096
  chr8:8639731-8639761
  hypo

SEQ ID NO: 24429 - DNA, 117 bp, Homo sapiens; identical to SEQ ID NO: 15099
  chr8:10529008-10529125
  hypo

SEQ ID NO: 24430 - DNA, 8 bp, Homo sapiens
  chr8:11706136-11706144
  hypo
aaggcgag

SEQ ID NO: 24431 - DNA, 27 bp, Homo sapiens
  chr8:13654937-13654964
  hypo
gttatgggccgggtgcggtggctcaca

SEQ ID NO: 24432 - DNA, 30 bp, Homo sapiens; identical to SEQ ID NO: 15102
  chr8:23290404-23290434
  hypo

SEQ ID NO: 24433 - DNA, 38 bp, Homo sapiens; identical to SEQ ID NO: 15103
  chr8:23399594-23399632
  hypo

SEQ ID NO: 24434 - DNA, 5 bp, Homo sapiens
  chr8:23423918-23423923
  hypo
tccct

SEQ ID NO: 24435 - DNA, 96 bp, Homo sapiens
  chr8:23423974-23424070
  hypo
gagttgtgtgtgcaatgcacacccagacacacgcacgcacacacacgcgcgcgcacacacatgcttttttctgttcccctccgctttctgaagcct

SEQ ID NO: 24436 - DNA, 117 bp, Homo sapiens; identical to SEQ ID NO: 15105
  chr8:25397086-25397203
  hypo

SEQ ID NO: 24437 - DNA, 58 bp, Homo sapiens; identical to SEQ ID NO: 15107
  chr8:42144632-42144690
  hypo

SEQ ID NO: 24438 - DNA, 30 bp, Homo sapiens; identical to SEQ ID NO: 15108
  chr8:42699267-42699297
  hypo

SEQ ID NO: 24439 - DNA, 115 bp, Homo sapiens; identical to SEQ ID NO: 15110
  chr8:47093290-47093405
  hypo

SEQ ID NO: 24440 - DNA, 92 bp, Homo sapiens; identical to SEQ ID NO: 15111
  chr8:47334506-47334598
  hypo

SEQ ID NO: 24441 - DNA, 30 bp, Homo sapiens; identical to SEQ ID NO: 15112
  chr8:48045032-48045062
  hypo

SEQ ID NO: 24442 - DNA, 168 bp, Homo sapiens; identical to SEQ ID NO: 15113
  chr8:48294168-48294336
  hypo

SEQ ID NO: 24443 - DNA, 180 bp, Homo sapiens; identical to SEQ ID NO: 15114
  chr8:49335062-49335242
  hypo

SEQ ID NO: 24444 - DNA, 30 bp, Homo sapiens; identical to SEQ ID NO: 15115
  chr8:49572124-49572154
  hypo

SEQ ID NO: 24445 - DNA, 41 bp, Homo sapiens; identical to SEQ ID NO: 15116
  chr8:49609162-49609203
  hypo

SEQ ID NO: 24446 - DNA, 28 bp, Homo sapiens
  chr8:50015582-50015610
  hypo
ctatgggaccgggcgtcttggagcaggg

SEQ ID NO: 24447 - DNA, 41 bp, Homo sapiens; identical to SEQ ID NO: 15118
  chr8:50377787-50377828
  hypo

SEQ ID NO: 24448 - DNA, 34 bp, Homo sapiens; identical to SEQ ID NO: 15119
  chr8:52432891-52432925
  hypo

SEQ ID NO: 24449 - DNA, 30 bp, Homo sapiens; identical to SEQ ID NO: 15120
  chr8:55689465-55689495
  hypo

SEQ ID NO: 24450 - DNA, 30 bp, Homo sapiens; identical to SEQ ID NO: 15121
  chr8:56929748-56929778
  hypo

SEQ ID NO: 24451 - DNA, 8 bp, Homo sapiens
  chr8:58106115-58106123
  hypo
gggcagct

SEQ ID NO: 24452 - DNA, 54 bp, Homo sapiens
  chr8:58116950-58117004
  hypo
cagaaacgttgcagccgatggcacggcagtggggaggaaaacgtaggaagcatg

SEQ ID NO: 24453 - DNA, 63 bp, Homo sapiens
  chr8:58130301-58130364
  hypo
ggaagacacatctgacgagatcgaatgttttgcagaagagccatgtgaccagatccctggttt

SEQ ID NO: 24454 - DNA, 89 bp, Homo sapiens
  chr8:61789885-61789974
  hypo
ataatgacgacgaggcggatggcggcggggaggctagagcccatttcagaagcctgcagtgaggattccaccagttcacatgcatcggg

SEQ ID NO: 24455 - DNA, 23 bp, Homo sapiens
  chr8:64023521-64023544
  hypo
accgcgcccggccttaagtgttt

SEQ ID NO: 24456 - DNA, 90 bp, Homo sapiens; identical to SEQ ID NO: 15127
  chr8:65749819-65749909
  hypo

SEQ ID NO: 24457 - DNA, 30 bp, Homo sapiens; identical to SEQ ID NO: 15129
  chr8:71368455-71368485
  hypo

SEQ ID NO: 24458 - DNA, 32 bp, Homo sapiens; identical to SEQ ID NO: 15130
  chr8:74332813-74332845
  hypo

SEQ ID NO: 24459 - DNA, 16 bp, Homo sapiens
  chr8:74889431-74889447
  hypo
ttggaggtgaagtctc

SEQ ID NO: 24460 - DNA, 30 bp, Homo sapiens; identical to SEQ ID NO: 15135
  chr8:91130098-91130128
  hypo

SEQ ID NO: 24461 - DNA, 77 bp, Homo sapiens; identical to SEQ ID NO: 15137
  chr8:95416054-95416131
  hypo

SEQ ID NO: 24462 - DNA, 30 bp, Homo sapiens; identical to SEQ ID NO: 15138
  chr8:96208663-96208693
  hypo

SEQ ID NO: 24463 - DNA, 7 bp, Homo sapiens
  chr8:97340195-97340202
  hypo
gggacaa

SEQ ID NO: 24464 - DNA, 30 bp, Homo sapiens; identical to SEQ ID NO: 15140
  chr8:98738336-98738366
  hypo

SEQ ID NO: 24465 - DNA, 41 bp, Homo sapiens; identical to SEQ ID NO: 15141
  chr8:100026614-100026655
  hypo

SEQ ID NO: 24466 - DNA, 25 bp, Homo sapiens
  chr8:101156861-101156886
  hypo
aaaaaaaaaaagcagcggccgggcg

SEQ ID NO: 24467 - DNA, 30 bp, Homo sapiens; identical to SEQ ID NO: 15144
  chr8:104382635-104382665
  hypo

SEQ ID NO: 24468 - DNA, 30 bp, Homo sapiens; identical to SEQ ID NO: 15145
  chr8:106500552-106500582
  hypo

SEQ ID NO: 24469 - DNA, 16 bp, Homo sapiens
  chr8:110274990-110275006
  hypo
aaacctgaatgtggcc

SEQ ID NO: 24470 - DNA, 30 bp, Homo sapiens; identical to SEQ ID NO: 15147
  chr8:110275321-110275351
  hypo

SEQ ID NO: 24471 - DNA, 171 bp, Homo sapiens; identical to SEQ ID NO: 15148
  chr8:110548417-110548588
  hypo

SEQ ID NO: 24472 - DNA, 30 bp, Homo sapiens; identical to SEQ ID NO: 15149
  chr8:110961977-110962007
  hypo

SEQ ID NO: 24473 - DNA, 30 bp, Homo sapiens; identical to SEQ ID NO: 15150
  chr8:117824014-117824044
  hypo

SEQ ID NO: 24474 - DNA, 38 bp, Homo sapiens; identical to SEQ ID NO: 15151
  chr8:121206396-121206434
  hypo

SEQ ID NO: 24475 - DNA, 16 bp, Homo sapiens
  chr8:123695516-123695532
  hypo
gcaggccagttgcgcc

SEQ ID NO: 24476 - DNA, 248 bp, Homo sapiens; identical to SEQ ID NO: 15153
  chr8:123966089-123966337
  hypo

SEQ ID NO: 24477 - DNA, 97 bp, Homo sapiens; identical to SEQ ID NO: 15154
  chr8:127305217-127305314
  hypo

SEQ ID NO: 24478 - DNA, 41 bp, Homo sapiens; identical to SEQ ID NO: 15157
  chr8:128889207-128889248
  hypo

SEQ ID NO: 24479 - DNA, 154 bp, Homo sapiens; identical to SEQ ID NO: 15158
  chr8:129069828-129069982
  hypo

SEQ ID NO: 24480 - DNA, 30 bp, Homo sapiens; identical to SEQ ID NO: 15159
  chr8:130116433-130116463
  hypo

SEQ ID NO: 24481 - DNA, 23 bp, Homo sapiens
  chr8:131922190-131922213
  hypo
tttttttttttgagacggagttt

SEQ ID NO: 24482 - DNA, 30 bp, Homo sapiens; identical to SEQ ID NO: 15161
  chr8:133062835-133062865
  hypo

SEQ ID NO: 24483 - DNA, 132 bp, Homo sapiens; identical to SEQ ID NO: 15163
  chr8:133811037-133811169
  hypo

SEQ ID NO: 24484 - DNA, 17 bp, Homo sapiens
  chr8:135301235-135301252
  hypo
gccggccagatcccaca

SEQ ID NO: 24485 - DNA, 89 bp, Homo sapiens
  chr8:140834148-140834237
  hypo
tcgtagtgccatgctcggctattggctgggcctaaattgttccttactctgagaattcgttaagtggctgagcaataaagaagagagat

SEQ ID NO: 24486 - DNA, 141 bp, Homo sapiens; identical to SEQ ID NO: 15167
  chr8:141202568-141202709
  hypo

SEQ ID NO: 24487 - DNA, 30 bp, Homo sapiens; identical to SEQ ID NO: 15168
  chr8:141466682-141466712
  hypo

SEQ ID NO: 24488 - DNA, 8 bp, Homo sapiens
  chr8:141588132-141588140
  hypo
cagacaat

SEQ ID NO: 24489 - DNA, 30 bp, Homo sapiens; identical to SEQ ID NO: 15170
  chr8:141597034-141597064
  hypo

SEQ ID NO: 24490 - DNA, 11 bp, Homo sapiens
  chr8:142535496-142535507
  hypo
gacctgcctgc

SEQ ID NO: 24491 - DNA, 30 bp, Homo sapiens; identical to SEQ ID NO: 15172
  chr8:142553829-142553859
  hypo

SEQ ID NO: 24492 - DNA, 30 bp, Homo sapiens; identical to SEQ ID NO: 15173
  chr8:142560172-142560202
  hypo

SEQ ID NO: 24493 - DNA, 30 bp, Homo sapiens; identical to SEQ ID NO: 15174
  chr8:142694812-142694842
  hypo

SEQ ID NO: 24494 - DNA, 170 bp, Homo sapiens; identical to SEQ ID NO: 15175
  chr8:142706692-142706862
  hypo

SEQ ID NO: 24495 - DNA, 88 bp, Homo sapiens; identical to SEQ ID NO: 15176
  chr8:143054995-143055083
  hypo

SEQ ID NO: 24496 - DNA, 16 bp, Homo sapiens
  chr8:143089014-143089030
  hypo
cgagcgcctcagggtc

SEQ ID NO: 24497 - DNA, 33 bp, Homo sapiens; identical to SEQ ID NO: 15178
  chr8:143097424-143097457
  hypo

SEQ ID NO: 24498 - DNA, 13 bp, Homo sapiens
  chr8:143105231-143105244
  hypo
gtctcaggcaggc

SEQ ID NO: 24499 - DNA, 30 bp, Homo sapiens; identical to SEQ ID NO: 15180
  chr8:143333589-143333619
  hypo

SEQ ID NO: 24500 - DNA, 155 bp, Homo sapiens; identical to SEQ ID NO: 15181
  chr8:143405792-143405947
  hypo

SEQ ID NO: 24501 - DNA, 53 bp, Homo sapiens; identical to SEQ ID NO: 15182
  chr8:143437078-143437131
  hypo

SEQ ID NO: 24502 - DNA, 30 bp, Homo sapiens; identical to SEQ ID NO: 15183
  chr8:143463651-143463681
  hypo

SEQ ID NO: 24503 - DNA, 35 bp, Homo sapiens
  chr8:143509422-143509457
  hypo
gaccgtgggtaatggcgtcaccccatccgccgtct

SEQ ID NO: 24504 - DNA, 30 bp, Homo sapiens; identical to SEQ ID NO: 15185
  chr8:143538458-143538488
  hypo

SEQ ID NO: 24505 - DNA, 30 bp, Homo sapiens; identical to SEQ ID NO: 15186
  chr8:143557725-143557755
  hypo

SEQ ID NO: 24506 - DNA, 36 bp, Homo sapiens; identical to SEQ ID NO: 15187
  chr8:143587455-143587491
  hypo

SEQ ID NO: 24507 - DNA, 162 bp, Homo sapiens; identical to SEQ ID NO: 15188
  chr8:143595620-143595782
  hypo

SEQ ID NO: 24508 - DNA, 24 bp, Homo sapiens
  chr8:143621956-143621980
  hypo
caaggtgggtacatgcgagggagg

SEQ ID NO: 24509 - DNA, 21 bp, Homo sapiens
  chr8:143622096-143622117
  hypo
gcgtcccgagagtgctgtggc

SEQ ID NO: 24510 - DNA, 6 bp, Homo sapiens
  chr8:143876958-143876964
  hypo
agtggc

SEQ ID NO: 24511 - DNA, 7 bp, Homo sapiens
  chr8:143993967-143993974
  hypo
tctgcct

SEQ ID NO: 24512 - DNA, 36 bp, Homo sapiens; identical to SEQ ID NO: 15192
  chr8:144070623-144070659
  hypo

SEQ ID NO: 24513 - DNA, 72 bp, Homo sapiens; identical to SEQ ID NO: 15193
  chr8:144203849-144203921
  hypo

SEQ ID NO: 24514 - DNA, 30 bp, Homo sapiens; identical to SEQ ID NO: 15194
  chr8:144208784-144208814
  hypo

SEQ ID NO: 24515 - DNA, 16 bp, Homo sapiens
  chr8:144238806-144238822
  hypo
agacatgggcatgcac

SEQ ID NO: 24516 - DNA, 85 bp, Homo sapiens
  chr8:144238901-144238986
  hypo
cctggggtgtgtgtgtgtgaaggagcagggcgggcacgggtgtgtgtgcacatgctggctgcgtgggcaccgtttgtatgcttgt

SEQ ID NO: 24517 - DNA, 30 bp, Homo sapiens; identical to SEQ ID NO: 15196
  chr8:144293809-144293839
  hypo

SEQ ID NO: 24518 - DNA, 41 bp, Homo sapiens; identical to SEQ ID NO: 15197
  chr8:144326894-144326935
  hypo

SEQ ID NO: 24519 - DNA, 57 bp, Homo sapiens; identical to SEQ ID NO: 15199
  chr8:144343530-144343587
  hypo

SEQ ID NO: 24520 - DNA, 39 bp, Homo sapiens
  chr8:144344254-144344293
  hypo
tcccacgcccctctccggcagcccctgcccacacccgca

SEQ ID NO: 24521 - DNA, 101 bp, Homo sapiens
  chr8:144344442-144344543
  hypo
tggtgaggctggatgcctggcatgtctgaacactcacattccccaggcatgcatgtgcagccgccgccgccacccatgtactgtggcgctgacccctcctg

SEQ ID NO: 24522 - DNA, 83 bp, Homo sapiens
  chr8:144360311-144360394
  hypo
caccagcgctctggacgccccactctgccaggtgagaacgagtttaggggtgcgggctggaggtcagtgtgtctgtccgaagt

SEQ ID NO: 24523 - DNA, 48 bp, Homo sapiens
  chr8:144360453-144360501
  hypo
tcagactgtctgcctgaaaggtaagggtgaggacgcctgcattctcct

SEQ ID NO: 24524 - DNA, 57 bp, Homo sapiens; identical to SEQ ID NO: 15204
  chr8:144383350-144383407
  hypo

SEQ ID NO: 24525 - DNA, 179 bp, Homo sapiens; identical to SEQ ID NO: 15205
  chr8:144471637-144471816
  hypo

SEQ ID NO: 24526 - DNA, 83 bp, Homo sapiens; identical to SEQ ID NO: 15206
  chr8:144589999-144590082
  hypo

SEQ ID NO: 24527 - DNA, 115 bp, Homo sapiens; identical to SEQ ID NO: 15207
  chr8:144656797-144656912
  hypo

SEQ ID NO: 24528 - DNA, 55 bp, Homo sapiens
  chr8:144668854-144668909
  hypo
gtcgggcagcagagccgcccagccgccccacgtgcagctctcacctggcgggagg

SEQ ID NO: 24529 - DNA, 30 bp, Homo sapiens; identical to SEQ ID NO: 15209
  chr8:144676006-144676036
  hypo

SEQ ID NO: 24530 - DNA, 30 bp, Homo sapiens; identical to SEQ ID NO: 15210
  chr8:144677984-144678014
  hypo

SEQ ID NO: 24531 - DNA, 27 bp, Homo sapiens
  chr8:145753490-145753517
  hypo
gcgtgcaggtgggggcggggaagctca

SEQ ID NO: 24532 - DNA, 30 bp, Homo sapiens; identical to SEQ ID NO: 15213
  chr8:146013567-146013597
  hypo

SEQ ID NO: 24533 - DNA, 30 bp, Homo sapiens; identical to SEQ ID NO: 15216
  chr9:7164747-7164777
  hypo

SEQ ID NO: 24534 - DNA, 18 bp, Homo sapiens
  chr9:15533133-15533151
  hypo
agacgtgtttactacaaa

SEQ ID NO: 24535 - DNA, 99 bp, Homo sapiens; identical to SEQ ID NO: 15218
  chr9:32999960-33000059
  hypo

SEQ ID NO: 24536 - DNA, 24 bp, Homo sapiens
  chr9:33647199-33647223
  hypo
gcgagactgcgtctcaaaaaaaaa

SEQ ID NO: 24537 - DNA, 75 bp, Homo sapiens; identical to SEQ ID NO: 15220
  chr9:35816231-35816306
  hypo

SEQ ID NO: 24538 - DNA, 33 bp, Homo sapiens; identical to SEQ ID NO: 15221
  chr9:36257376-36257409
  hypo

SEQ ID NO: 24539 - DNA, 30 bp, Homo sapiens; identical to SEQ ID NO: 5090
  chr9:37467940-37467970
  hypo

SEQ ID NO: 24540 - DNA, 30 bp, Homo sapiens; identical to SEQ ID NO: 15224
  chr9:79231349-79231379
  hypo

SEQ ID NO: 24541 - DNA, 41 bp, Homo sapiens; identical to SEQ ID NO: 15225
  chr9:90322123-90322164
  hypo

SEQ ID NO: 24542 - DNA, 30 bp, Homo sapiens; identical to SEQ ID NO: 15226
  chr9:90421661-90421691
  hypo

SEQ ID NO: 24543 - DNA, 39 bp, Homo sapiens; identical to SEQ ID NO: 15227
  chr9:91914149-91914188
  hypo

SEQ ID NO: 24544 - DNA, 30 bp, Homo sapiens; identical to SEQ ID NO: 15228
  chr9:92897186-92897216
  hypo

SEQ ID NO: 24545 - DNA, 77 bp, Homo sapiens; identical to SEQ ID NO: 15229
  chr9:92980516-92980593
  hypo

SEQ ID NO: 24546 - DNA, 30 bp, Homo sapiens; identical to SEQ ID NO: 15231
  chr9:96362025-96362055
  hypo

SEQ ID NO: 24547 - DNA, 90 bp, Homo sapiens; identical to SEQ ID NO: 5091
  chr9:100397609-100397699
  hypo

SEQ ID NO: 24548 - DNA, 24 bp, Homo sapiens
  chr9:103174730-103174754
  hypo
aaatgtccccgtataaatgataaa

SEQ ID NO: 24549 - DNA, 30 bp, Homo sapiens; identical to SEQ ID NO: 15234
  chr9:107712165-107712195
  hypo

SEQ ID NO: 24550 - DNA, 6 bp, Homo sapiens
  chr9:115067926-115067932
  hypo
ataaga

SEQ ID NO: 24551 - DNA, 18 bp, Homo sapiens
  chr9:115087597-115087615
  hypo
gcccgtctgcacactggg

SEQ ID NO: 24552 - DNA, 30 bp, Homo sapiens; identical to SEQ ID NO: 15237
  chr9:116331277-116331307
  hypo

SEQ ID NO: 24553 - DNA, 19 bp, Homo sapiens
  chr9:116633864-116633883
  hypo
aattccacctgccgacgtg

SEQ ID NO: 24554 - DNA, 30 bp, Homo sapiens; identical to SEQ ID NO: 15239
  chr9:123287840-123287870
  hypo

SEQ ID NO: 24555 - DNA, 30 bp, Homo sapiens; identical to SEQ ID NO: 15240
  chr9:126125543-126125573
  hypo

SEQ ID NO: 24556 - DNA, 50 bp, Homo sapiens
  chr9:126154254-126154304
  hypo
ccccacggctgctcccgcctctgcccaccttgtctccgcgtggagttccc

SEQ ID NO: 24557 - DNA, 34 bp, Homo sapiens; identical to SEQ ID NO: 15243
  chr9:126158010-126158044
  hypo

SEQ ID NO: 24558 - DNA, 44 bp, Homo sapiens; identical to SEQ ID NO: 15244
  chr9:126169447-126169491
  hypo

SEQ ID NO: 24559 - DNA, 20 bp, Homo sapiens
  chr9:128759954-128759974
  hypo
aggatcggaaggaatcacac

SEQ ID NO: 24560 - DNA, 30 bp, Homo sapiens; identical to SEQ ID NO: 15246
  chr9:130180052-130180082
  hypo

SEQ ID NO: 24561 - DNA, 42 bp, Homo sapiens; identical to SEQ ID NO: 15247
  chr9:131060925-131060967
  hypo

SEQ ID NO: 24562 - DNA, 218 bp, Homo sapiens; identical to SEQ ID NO: 15248
  chr9:131504930-131505148
  hypo

SEQ ID NO: 24563 - DNA, 124 bp, Homo sapiens
  chr9:131854328-131854452
  hypo
cacactcacctgcttaccctgaccccgctccaacctgcccaaggtgcggtgctgggcagaagcccaactcttcaagccctcagaagcctctttgaaatatccacttttcgcggctgggcgcggt

SEQ ID NO: 24564 - DNA, 43 bp, Homo sapiens
  chr9:132402797-132402840
  hypo
cacccccggggctctcgctgaccttcaaagttgagattggccc

SEQ ID NO: 24565 - DNA, 30 bp, Homo sapiens; identical to SEQ ID NO: 15253
  chr9:133518455-133518485
  hypo

SEQ ID NO: 24566 - DNA, 59 bp, Homo sapiens; identical to SEQ ID NO: 15255
  chr9:133779518-133779577
  hypo

SEQ ID NO: 24567 - DNA, 85 bp, Homo sapiens; identical to SEQ ID NO: 15256
  chr9:133865386-133865471
  hypo

SEQ ID NO: 24568 - DNA, 44 bp, Homo sapiens
  chr9:134717269-134717313
  hypo
gggaagagaaaaagccgagaaaaaagcggtttgaacggggggtg

SEQ ID NO: 24569 - DNA, 52 bp, Homo sapiens; identical to SEQ ID NO: 15261
  chr9:135768018-135768070
  hypo

SEQ ID NO: 24570 - DNA, 36 bp, Homo sapiens
  chr9:135865054-135865090
  hypo
ttccgcaggggatcccggccgggtccagtcctgagc

SEQ ID NO: 24571 - DNA, 103 bp, Homo sapiens; identical to SEQ ID NO: 15264
  chr9:136375630-136375733
  hypo

SEQ ID NO: 24572 - DNA, 30 bp, Homo sapiens; identical to SEQ ID NO: 15265
  chr9:136999528-136999558
  hypo

SEQ ID NO: 24573 - DNA, 59 bp, Homo sapiens; identical to SEQ ID NO: 15267
  chr9:137710245-137710304
  hypo

SEQ ID NO: 24574 - DNA, 29 bp, Homo sapiens
  chr9:137718872-137718901
  hypo
ctgcatcagcttgaacggcctctccttca

SEQ ID NO: 24575 - DNA, 89 bp, Homo sapiens
  chr9:137719001-137719090
  hypo
tgcttcctaacaacctcagtgccccagaagcagtttcctgccaggggaagagcagctacgttctccccagggaccgccatccccttacc

SEQ ID NO: 24576 - DNA, 34 bp, Homo sapiens; identical to SEQ ID NO: 15269
  chr9:138289547-138289581
  hypo

SEQ ID NO: 24577 - DNA, 44 bp, Homo sapiens; identical to SEQ ID NO: 15270
  chr9:138562752-138562796
  hypo

SEQ ID NO: 24578 - DNA, 30 bp, Homo sapiens; identical to SEQ ID NO: 15273
  chr9:138634173-138634203
  hypo

SEQ ID NO: 24579 - DNA, 35 bp, Homo sapiens; identical to SEQ ID NO: 5098
  chr9:138650129-138650164
  hypo

SEQ ID NO: 24580 - DNA, 30 bp, Homo sapiens; identical to SEQ ID NO: 15275
  chr9:138659727-138659757
  hypo

SEQ ID NO: 24581 - DNA, 119 bp, Homo sapiens
  chr9:138660824-138660943
  hypo
gggcacgtgtgcacacgtgggtgatggtgcatctggggcagggcgcatgtgcacatgtgtgacggtgcgtctggggcaggacgcgtgtgcacacgtgggtgacggtgcgtctggggcag

SEQ ID NO: 24582 - DNA, 134 bp, Homo sapiens
  chr9:138661012-138661146
  hypo
gtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggc

SEQ ID NO: 24583 - DNA, 63 bp, Homo sapiens
  chr9:138661870-138661933
  hypo
tcaccctgctggtgcacacgtcccgcggccagtgagtgccccgtgccccgggggaccgacctc

SEQ ID NO: 24584 - DNA, 40 bp, Homo sapiens; identical to SEQ ID NO: 15278
  chr9:138743731-138743771
  hypo

SEQ ID NO: 24585 - DNA, 30 bp, Homo sapiens; identical to SEQ ID NO: 15279
  chr9:138780600-138780630
  hypo

SEQ ID NO: 24586 - DNA, 45 bp, Homo sapiens; identical to SEQ ID NO: 15280
  chr9:138994395-138994440
  hypo

SEQ ID NO: 24587 - DNA, 30 bp, Homo sapiens; identical to SEQ ID NO: 15282
  chr9:139100397-139100427
  hypo

SEQ ID NO: 24588 - DNA, 23 bp, Homo sapiens
  chr9:139421932-139421955
  hypo
cttccatgagtgacccgcacccc

SEQ ID NO: 24589 - DNA, 91 bp, Homo sapiens
  chr9:139421985-139422076
  hypo
caggggcggtggggagacccctctggggctaaaaagtgaggcttgagatagggaacgccagtctcccccgactggacgagagagctgccct

SEQ ID NO: 24590 - DNA, 40 bp, Homo sapiens; identical to SEQ ID NO: 15284
  chr9:139472499-139472539
  hypo

SEQ ID NO: 24591 - DNA, 39 bp, Homo sapiens; identical to SEQ ID NO: 15285
  chr9:139506449-139506488
  hypo

SEQ ID NO: 24592 - DNA, 51 bp, Homo sapiens; identical to SEQ ID NO: 15286
  chr9:139634047-139634098
  hypo

SEQ ID NO: 24593 - DNA, 40 bp, Homo sapiens
  chr9:139699051-139699091
  hypo
gaaggagaccagcgagaagtaccgccgggtaagccccagg

SEQ ID NO: 24594 - DNA, 17 bp, Homo sapiens
  chr9:139703929-139703946
  hypo
atgaaagttggtgtccg

SEQ ID NO: 24595 - DNA, 30 bp, Homo sapiens; identical to SEQ ID NO: 15290
  chr9:139714130-139714160
  hypo

SEQ ID NO: 24596 - DNA, 30 bp, Homo sapiens; identical to SEQ ID NO: 15291
  chr9:139717804-139717834
  hypo

SEQ ID NO: 24597 - DNA, 72 bp, Homo sapiens; identical to SEQ ID NO: 15292
  chr9:139809893-139809965
  hypo

SEQ ID NO: 24598 - DNA, 55 bp, Homo sapiens; identical to SEQ ID NO: 15293
  chr9:139818567-139818622
  hypo

SEQ ID NO: 24599 - DNA, 50 bp, Homo sapiens
  chr9:139888895-139888945
  hypo
gatccctgaggccaccggttgcaggaggcctggagtctgcgccttcttag

SEQ ID NO: 24600 - DNA, 30 bp, Homo sapiens; identical to SEQ ID NO: 15296
  chr9:139978966-139978996
  hypo

SEQ ID NO: 24601 - DNA, 11 bp, Homo sapiens
  chr9:140030528-140030539
  hypo
aggtgctcagt

SEQ ID NO: 24602 - DNA, 113 bp, Homo sapiens; identical to SEQ ID NO: 15298
  chr9:140107128-140107241
  hypo

SEQ ID NO: 24603 - DNA, 30 bp, Homo sapiens; identical to SEQ ID NO: 15299
  chr9:140108225-140108255
  hypo

SEQ ID NO: 24604 - DNA, 71 bp, Homo sapiens
  chr9:140127812-140127883
  hypo
tcctcaaggtgctgacgaagccgctcacacacctcatcgtgcaggtgaggacggccaccgcccccgcccag

SEQ ID NO: 24605 - DNA, 180 bp, Homo sapiens; identical to SEQ ID NO: 15301
  chr9:140137562-140137742
  hypo

SEQ ID NO: 24606 - DNA, 12 bp, Homo sapiens
  chr9:140245865-140245877
  hypo
cgtccagaagga

SEQ ID NO: 24607 - DNA, 30 bp, Homo sapiens; identical to SEQ ID NO: 15303
  chr9:140265779-140265809
  hypo

SEQ ID NO: 24608 - DNA, 61 bp, Homo sapiens; identical to SEQ ID NO: 15304
  chr9:140267262-140267323
  hypo

SEQ ID NO: 24609 - DNA, 78 bp, Homo sapiens; identical to SEQ ID NO: 15305
  chr9:140274184-140274262
  hypo

SEQ ID NO: 24610 - DNA, 97 bp, Homo sapiens
  chr9:140333018-140333115
  hypo
ctcccgtggccatagaggcatccccggggctcagacggcctcccgtggccatagaggcatccccggggctcagacggtctcccgtggccatagaggc

SEQ ID NO: 24611 - DNA, 9 bp, Homo sapiens
  chr9:140382596-140382605
  hypo
ctgatgtct

SEQ ID NO: 24612 - DNA, 142 bp, Homo sapiens; identical to SEQ ID NO: 15308
  chr9:140389345-140389487
  hypo

SEQ ID NO: 24613 - DNA, 77 bp, Homo sapiens
  chr9:140392377-140392454
  hypo
aaatccaggaggccacgaagtgtgtttccgagctaagctggggtggggctggggaaatccagccttccatgtgtggt

SEQ ID NO: 24614 - DNA, 153 bp, Homo sapiens
  chr9:140392484-140392637
  hypo
cggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgac

SEQ ID NO: 24615 - DNA, 167 bp, Homo sapiens; identical to SEQ ID NO: 15310
  chr9:140396560-140396727
  hypo

SEQ ID NO: 24616 - DNA, 71 bp, Homo sapiens; identical to SEQ ID NO: 15312
  chr9:140400208-140400279
  hypo

SEQ ID NO: 24617 - DNA, 45 bp, Homo sapiens; identical to SEQ ID NO: 15313
  chr9:140680320-140680365
  hypo

SEQ ID NO: 24618 - DNA, 30 bp, Homo sapiens; identical to SEQ ID NO: 15314
  chr9:140727555-140727585
  hypo

SEQ ID NO: 24619 - DNA, 32 bp, Homo sapiens; identical to SEQ ID NO: 15315
  chr9:140969282-140969314
  hypo

SEQ ID NO: 24620 - DNA, 145 bp, Homo sapiens; identical to SEQ ID NO: 15316
  chr9:141022582-141022727
  hypo

SEQ ID NO: 24621 - DNA, 35 bp, Homo sapiens; identical to SEQ ID NO: 15318
  chr10:851432-851467
  hypo

SEQ ID NO: 24622 - DNA, 21 bp, Homo sapiens
  chr10:978857-978878
  hypo
gggaccaaaaggccccggccc

SEQ ID NO: 24623 - DNA, 62 bp, Homo sapiens; identical to SEQ ID NO: 15320
  chr10:1156723-1156785
  hypo

SEQ ID NO: 24624 - DNA, 30 bp, Homo sapiens; identical to SEQ ID NO: 15321
  chr10:1259979-1260009
  hypo

SEQ ID NO: 24625 - DNA, 30 bp, Homo sapiens; identical to SEQ ID NO: 15322
  chr10:2283030-2283060
  hypo

SEQ ID NO: 24626 - DNA, 78 bp, Homo sapiens; identical to SEQ ID NO: 15323
  chr10:3161042-3161120
  hypo

SEQ ID NO: 24627 - DNA, 30 bp, Homo sapiens; identical to SEQ ID NO: 15324
  chr10:3329710-3329740
  hypo

SEQ ID NO: 24628 - DNA, 35 bp, Homo sapiens
  chr10:3330464-3330499
  hypo
aggtgagggctcccccgcgccgccctggcgtccag

SEQ ID NO: 24629 - DNA, 15 bp, Homo sapiens
  chr10:3895395-3895410
  hypo
ggtttccagctgtgt

SEQ ID NO: 24630 - DNA, 30 bp, Homo sapiens; identical to SEQ ID NO: 15327
  chr10:5531069-5531099
  hypo

SEQ ID NO: 24631 - DNA, 30 bp, Homo sapiens; identical to SEQ ID NO: 15328
  chr10:5538908-5538938
  hypo

SEQ ID NO: 24632 - DNA, 112 bp, Homo sapiens; identical to SEQ ID NO: 15329
  chr10:5540808-5540920
  hypo

SEQ ID NO: 24633 - DNA, 312 bp, Homo sapiens; identical to SEQ ID NO: 15330
  chr10:5541199-5541511
  hypo

SEQ ID NO: 24634 - DNA, 30 bp, Homo sapiens; identical to SEQ ID NO: 15331
  chr10:5553298-5553328
  hypo

SEQ ID NO: 24635 - DNA, 30 bp, Homo sapiens; identical to SEQ ID NO: 15332
  chr10:5567180-5567210
  hypo

SEQ ID NO: 24636 - DNA, 30 bp, Homo sapiens; identical to SEQ ID NO: 15333
  chr10:5875038-5875068
  hypo

SEQ ID NO: 24637 - DNA, 30 bp, Homo sapiens; identical to SEQ ID NO: 15337
  chr10:6159901-6159931
  hypo

SEQ ID NO: 24638 - DNA, 24 bp, Homo sapiens
  chr10:6199196-6199220
  hypo
tttttttttttgagacggagtctc

SEQ ID NO: 24639 - DNA, 15 bp, Homo sapiens
  chr10:6564170-6564185
  hypo
cgggattacaagagt

SEQ ID NO: 24640 - DNA, 47 bp, Homo sapiens; identical to SEQ ID NO: 15340
  chr10:6577682-6577729
  hypo

SEQ ID NO: 24641 - DNA, 42 bp, Homo sapiens; identical to SEQ ID NO: 15341
  chr10:7203062-7203104
  hypo

SEQ ID NO: 24642 - DNA, 28 bp, Homo sapiens
  chr10:7205705-7205733
  hypo
taatgggccacctcccgagggcagactc

SEQ ID NO: 24643 - DNA, 30 bp, Homo sapiens; identical to SEQ ID NO: 15344
  chr10:7213658-7213688
  hypo

SEQ ID NO: 24644 - DNA, 30 bp, Homo sapiens; identical to SEQ ID NO: 15345
  chr10:7214234-7214264
  hypo

SEQ ID NO: 24645 - DNA, 30 bp, Homo sapiens
  chr10:7236181-7236211
  hypo
tcccctacctcccctcgctgcaccccctcg

SEQ ID NO: 24646 - DNA, 30 bp, Homo sapiens; identical to SEQ ID NO: 15347
  chr10:7340032-7340062
  hypo

SEQ ID NO: 24647 - DNA, 21 bp, Homo sapiens
  chr10:7414164-7414185
  hypo
ccgccacgcccggccttcttg

SEQ ID NO: 24648 - DNA, 128 bp, Homo sapiens; identical to SEQ ID NO: 15350
  chr10:11472865-11472993
  hypo

SEQ ID NO: 24649 - DNA, 30 bp, Homo sapiens; identical to SEQ ID NO: 15351
  chr10:13137625-13137655
  hypo

SEQ ID NO: 24650 - DNA, 126 bp, Homo sapiens; identical to SEQ ID NO: 15352
  chr10:13355078-13355204
  hypo

SEQ ID NO: 24651 - DNA, 32 bp, Homo sapiens; identical to SEQ ID NO: 15353
  chr10:15000601-15000633
  hypo

SEQ ID NO: 24652 - DNA, 30 bp, Homo sapiens; identical to SEQ ID NO: 15355
  chr10:16715583-16715613
  hypo

SEQ ID NO: 24653 - DNA, 35 bp, Homo sapiens
  chr10:17429622-17429657
  hypo
ggactggactgctgtcacatcgattaacccaaatc

SEQ ID NO: 24654 - DNA, 30 bp, Homo sapiens; identical to SEQ ID NO: 15358
  chr10:24841823-24841853
  hypo

SEQ ID NO: 24655 - DNA, 22 bp, Homo sapiens
  chr10:26128001-26128023
  hypo
acttccacggcctggcgcggtg

SEQ ID NO: 24656 - DNA, 30 bp, Homo sapiens; identical to SEQ ID NO: 15360
  chr10:26638451-26638481
  hypo

SEQ ID NO: 24657 - DNA, 30 bp, Homo sapiens; identical to SEQ ID NO: 15361
  chr10:26733386-26733416
  hypo

SEQ ID NO: 24658 - DNA, 30 bp, Homo sapiens; identical to SEQ ID NO: 15362
  chr10:26739045-26739075
  hypo

SEQ ID NO: 24659 - DNA, 30 bp, Homo sapiens; identical to SEQ ID NO: 15363
  chr10:26877730-26877760
  hypo

SEQ ID NO: 24660 - DNA, 30 bp, Homo sapiens; identical to SEQ ID NO: 15364
  chr10:26926812-26926842
  hypo

SEQ ID NO: 24661 - DNA, 28 bp, Homo sapiens
  chr10:31892894-31892922
  hypo
cccgtggccagcacccgaggcctgctgg

SEQ ID NO: 24662 - DNA, 19 bp, Homo sapiens
  chr10:32499025-32499044
  hypo
caaattctccagtcccgcc

SEQ ID NO: 24663 - DNA, 31 bp, Homo sapiens; identical to SEQ ID NO: 15367
  chr10:38078895-38078926
  hypo

SEQ ID NO: 24664 - DNA, 39 bp, Homo sapiens; identical to SEQ ID NO: 15368
  chr10:43906055-43906094
  hypo

SEQ ID NO: 24665 - DNA, 38 bp, Homo sapiens; identical to SEQ ID NO: 15369
  chr10:46221018-46221056
  hypo

SEQ ID NO: 24666 - DNA, 30 bp, Homo sapiens; identical to SEQ ID NO: 15370
  chr10:49929928-49929958
  hypo

SEQ ID NO: 24667 - DNA, 42 bp, Homo sapiens
  chr10:50507515-50507557
  hypo
tgtctggctccttagcgtgggcagggaggctcaagttcatgg

SEQ ID NO: 24668 - DNA, 88 bp, Homo sapiens
  chr10:50507619-50507707
  hypo
gtgcagggtggtatgtgtgtgccgggagcccattggtgttggggctaaggttcttggtgtgctggatgggcctcggggaccacgtacc

SEQ ID NO: 24669 - DNA, 21 bp, Homo sapiens
  chr10:50748373-50748394
  hypo
cacgcccggcttgtaacttgc

SEQ ID NO: 24670 - DNA, 80 bp, Homo sapiens; identical to SEQ ID NO: 15373
  chr10:70288112-70288192
  hypo

SEQ ID NO: 24671 - DNA, 96 bp, Homo sapiens; identical to SEQ ID NO: 15374
  chr10:70476540-70476636
  hypo

SEQ ID NO: 24672 - DNA, 18 bp, Homo sapiens
  chr10:70483311-70483329
  hypo
taaaagtaaatgggccgg

SEQ ID NO: 24673 - DNA, 30 bp, Homo sapiens; identical to SEQ ID NO: 15376
  chr10:73466313-73466343
  hypo

SEQ ID NO: 24674 - DNA, 30 bp, Homo sapiens; identical to SEQ ID NO: 15377
  chr10:77022299-77022329
  hypo

SEQ ID NO: 24675 - DNA, 30 bp, Homo sapiens; identical to SEQ ID NO: 15378
  chr10:89605951-89605981
  hypo

SEQ ID NO: 24676 - DNA, 21 bp, Homo sapiens
  chr10:94603316-94603337
  hypo
atgcatttggccgggcgcggt

SEQ ID NO: 24677 - DNA, 41 bp, Homo sapiens
  chr10:98129781-98129822
  hypo
catcacactctgccccggccccagcgtctccgggacttacc

SEQ ID NO: 24678 - DNA, 22 bp, Homo sapiens
  chr10:98528164-98528186
  hypo
cagaccacggactgatacaggt

SEQ ID NO: 24679 - DNA, 55 bp, Homo sapiens; identical to SEQ ID NO: 15384
  chr10:104823193-104823248
  hypo

SEQ ID NO: 24680 - DNA, 21 bp, Homo sapiens
  chr10:108522437-108522458
  hypo
agccaccgtgcccagcctatt

SEQ ID NO: 24681 - DNA, 83 bp, Homo sapiens; identical to SEQ ID NO: 15387
  chr10:113623006-113623089
  hypo

SEQ ID NO: 24682 - DNA, 34 bp, Homo sapiens; identical to SEQ ID NO: 15388
  chr10:115844821-115844855
  hypo

SEQ ID NO: 24683 - DNA, 21 bp, Homo sapiens
  chr10:116331156-116331177
  hypo
aacgggcgcctggaggcagaa

SEQ ID NO: 24684 - DNA, 30 bp, Homo sapiens; identical to SEQ ID NO: 15390
  chr10:120791248-120791278
  hypo

SEQ ID NO: 24685 - DNA, 17 bp, Homo sapiens
  chr10:121354427-121354444
  hypo
cccggcctgaaggacaa

SEQ ID NO: 24686 - DNA, 30 bp, Homo sapiens; identical to SEQ ID NO: 15392
  chr10:121651072-121651102
  hypo

SEQ ID NO: 24687 - DNA, 120 bp, Homo sapiens; identical to SEQ ID NO: 15393
  chr10:122492432-122492552
  hypo

SEQ ID NO: 24688 - DNA, 20 bp, Homo sapiens
  chr10:123688618-123688638
  hypo
agcactttgggaggccgagg

SEQ ID NO: 24689 - DNA, 58 bp, Homo sapiens
  chr10:126199077-126199135
  hypo
agaactcttcctccaagagaccacgttcctctggtcctgtctccgtgggccacatcca

SEQ ID NO: 24690 - DNA, 23 bp, Homo sapiens
  chr10:126479341-126479364
  hypo
cttctttttttgagacggagtca

SEQ ID NO: 24691 - DNA, 44 bp, Homo sapiens; identical to SEQ ID NO: 15397
  chr10:126809890-126809934
  hypo

SEQ ID NO: 24692 - DNA, 39 bp, Homo sapiens; identical to SEQ ID NO: 15398
  chr10:127463306-127463345
  hypo

SEQ ID NO: 24693 - DNA, 39 bp, Homo sapiens
  chr10:130203480-130203519
  hypo
aatggacaacagggaaaatggaggcgcaggtgagaaagg

SEQ ID NO: 24694 - DNA, 38 bp, Homo sapiens; identical to SEQ ID NO: 15400
  chr10:131641111-131641149
  hypo

SEQ ID NO: 24695 - DNA, 156 bp, Homo sapiens
  chr10:131647747-131647903
  hypo
caggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcac

SEQ ID NO: 24696 - DNA, 4 bp, Homo sapiens
  chr10:131647933-131647937
  hypo
gacc

SEQ ID NO: 24697 - DNA, 131 bp, Homo sapiens; identical to SEQ ID NO: 15402
  chr10:131844101-131844232
  hypo

SEQ ID NO: 24698 - DNA, 65 bp, Homo sapiens; identical to SEQ ID NO: 15403
  chr10:131844627-131844692
  hypo

SEQ ID NO: 24699 - DNA, 172 bp, Homo sapiens; identical to SEQ ID NO: 15404
  chr10:131845044-131845216
  hypo

SEQ ID NO: 24700 - DNA, 132 bp, Homo sapiens; identical to SEQ ID NO: 15407
  chr10:132365736-132365868
  hypo

SEQ ID NO: 24701 - DNA, 119 bp, Homo sapiens; identical to SEQ ID NO: 15408
  chr10:132976493-132976612
  hypo

SEQ ID NO: 24702 - DNA, 141 bp, Homo sapiens; identical to SEQ ID NO: 15409
  chr10:133913916-133914057
  hypo

SEQ ID NO: 24703 - DNA, 57 bp, Homo sapiens; identical to SEQ ID NO: 15410
  chr10:133949378-133949435
  hypo

SEQ ID NO: 24704 - DNA, 100 bp, Homo sapiens
  chr10:133951502-133951602
  hypo
agccagcccagacaccgtcttccctgtcatccaaatgatggcacacgggcagtaaaccgtggactgaaaccggtggagctgctctaccacttacacaacc

SEQ ID NO: 24705 - DNA, 119 bp, Homo sapiens; identical to SEQ ID NO: 15412
  chr10:133962676-133962795
  hypo

SEQ ID NO: 24706 - DNA, 46 bp, Homo sapiens; identical to SEQ ID NO: 15413
  chr10:133984135-133984181
  hypo

SEQ ID NO: 24707 - DNA, 112 bp, Homo sapiens; identical to SEQ ID NO: 15414
  chr10:134012352-134012464
  hypo

SEQ ID NO: 24708 - DNA, 30 bp, Homo sapiens; identical to SEQ ID NO: 15415
  chr10:134014429-134014459
  hypo

SEQ ID NO: 24709 - DNA, 21 bp, Homo sapiens
  chr10:134016388-134016409
  hypo
ccagaacgcacccctggtcaa

SEQ ID NO: 24710 - DNA, 37 bp, Homo sapiens
  chr10:134022875-134022912
  hypo
accaggcagaagctgttctctgcgggactttgctgga

SEQ ID NO: 24711 - DNA, 47 bp, Homo sapiens; identical to SEQ ID NO: 15418
  chr10:134093662-134093709
  hypo

SEQ ID NO: 24712 - DNA, 14 bp, Homo sapiens
  chr10:134095580-134095594
  hypo
ctccgggggtgggg

SEQ ID NO: 24713 - DNA, 20 bp, Homo sapiens
  chr10:134301075-134301095
  hypo
cttgggaagctgtgccgcaa

SEQ ID NO: 24714 - DNA, 104 bp, Homo sapiens
  chr10:134301212-134301316
  hypo
tgcctccacctccagggttccacatccttccagtaggacacaggcagacatcgccttgggaggctgaatttgctcaaacggcaaacacacgatgagagcctggg

SEQ ID NO: 24715 - DNA, 180 bp, Homo sapiens; identical to SEQ ID NO: 15421
  chr10:134481125-134481305
  hypo

SEQ ID NO: 24716 - DNA, 48 bp, Homo sapiens
  chr10:134607922-134607970
  hypo
tctgagctctcagggcgttgcttctttgcccatttatcccgggtcttg

SEQ ID NO: 24717 - DNA, 13 bp, Homo sapiens
  chr10:134608183-134608196
  hypo
aaagaggggagga

SEQ ID NO: 24718 - DNA, 38 bp, Homo sapiens; identical to SEQ ID NO: 15423
  chr10:134610885-134610923
  hypo

SEQ ID NO: 24719 - DNA, 66 bp, Homo sapiens
  chr10:134665081-134665147
  hypo
ggcattttccagaaccgtacctaagtggaggcgcacagagtgctgtctttccgtctggttcatttt

SEQ ID NO: 24720 - DNA, 30 bp, Homo sapiens; identical to SEQ ID NO: 15425
  chr10:134671588-134671618
  hypo

SEQ ID NO: 24721 - DNA, 77 bp, Homo sapiens; identical to SEQ ID NO: 15426
  chr10:134682737-134682814
  hypo

SEQ ID NO: 24722 - DNA, 21 bp, Homo sapiens
  chr10:134683679-134683700
  hypo
atgagacggtgaactgagtcg

SEQ ID NO: 24723 - DNA, 38 bp, Homo sapiens; identical to SEQ ID NO: 15428
  chr10:134690510-134690548
  hypo

SEQ ID NO: 24724 - DNA, 144 bp, Homo sapiens
  chr10:134699728-134699872
  hypo
ccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtc

SEQ ID NO: 24725 - DNA, 74 bp, Homo sapiens; identical to SEQ ID NO: 15430
  chr10:134731905-134731979
  hypo

SEQ ID NO: 24726 - DNA, 41 bp, Homo sapiens; identical to SEQ ID NO: 15431
  chr10:134732884-134732925
  hypo

SEQ ID NO: 24727 - DNA, 222 bp, Homo sapiens
  chr10:134733275-134733497
  hypo
gcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacact

SEQ ID NO: 24728 - DNA, 75 bp, Homo sapiens
  chr10:134733617-134733692
  hypo
cgctgacggtgtggtgccacgccttcgcacagaggtaggtgaaccggcccctgttcttcccggtggagactgagg

SEQ ID NO: 24729 - DNA, 30 bp, Homo sapiens; identical to SEQ ID NO: 15433
  chr10:134734085-134734115
  hypo

SEQ ID NO: 24730 - DNA, 82 bp, Homo sapiens
  chr10:134738296-134738378
  hypo
gcgtggcgcacaccacgtggatgacccgggggtcgcccaggcgcacggctcgctgcagcgcgacgtctagcctctgtatgat

SEQ ID NO: 24731 - DNA, 26 bp, Homo sapiens
  chr10:134738642-134738668
  hypo
gactcagcgggcgctgctcccttcct

SEQ ID NO: 24732 - DNA, 224 bp, Homo sapiens; identical to SEQ ID NO: 15436
  chr10:134834692-134834916
  hypo

SEQ ID NO: 24733 - DNA, 30 bp, Homo sapiens; identical to SEQ ID NO: 15437
  chr10:134855649-134855679
  hypo

SEQ ID NO: 24734 - DNA, 37 bp, Homo sapiens; identical to SEQ ID NO: 15438
  chr10:134875820-134875857
  hypo

SEQ ID NO: 24735 - DNA, 49 bp, Homo sapiens; identical to SEQ ID NO: 15439
  chr10:134895296-134895345
  hypo

SEQ ID NO: 24736 - DNA, 39 bp, Homo sapiens; identical to SEQ ID NO: 15440
  chr10:134898411-134898450
  hypo

SEQ ID NO: 24737 - DNA, 149 bp, Homo sapiens; identical to SEQ ID NO: 15441
  chr10:134913803-134913952
  hypo

SEQ ID NO: 24738 - DNA, 195 bp, Homo sapiens
  chr10:134940950-134941145
  hypo
ggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaac

SEQ ID NO: 24739 - DNA, 96 bp, Homo sapiens
  chr10:134941178-134941274
  hypo
tgcccagagccagcctggaacctctcattcagggccctcagttccttctgcggccccaggatggcccgcccgtctgccctccgccttgccccgccc

SEQ ID NO: 24740 - DNA, 30 bp, Homo sapiens; identical to SEQ ID NO: 15443
  chr10:134941647-134941677
  hypo

SEQ ID NO: 24741 - DNA, 309 bp, Homo sapiens
  chr10:134942531-134942840
  hypo
cctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcaggga

SEQ ID NO: 24742 - DNA, 11 bp, Homo sapiens
  chr10:134943114-134943125
  hypo
tttcagaagcc

SEQ ID NO: 24743 - DNA, 510 bp, Homo sapiens; identical to SEQ ID NO: 15445
  chr10:134996387-134996897
  hypo

SEQ ID NO: 24744 - DNA, 56 bp, Homo sapiens
  chr10:135002007-135002063
  hypo
tgtccacactgacctcgccgctctcctgcccacagtgggtgtccctgcaggacctc

SEQ ID NO: 24745 - DNA, 24 bp, Homo sapiens
  chr10:135002156-135002180
  hypo
ggtgacgcacgcaccatcccatcc

SEQ ID NO: 24746 - DNA, 205 bp, Homo sapiens; identical to SEQ ID NO: 15447
  chr10:135011834-135012039
  hypo

SEQ ID NO: 24747 - DNA, 195 bp, Homo sapiens; identical to SEQ ID NO: 15448
  chr10:135015152-135015347
  hypo

SEQ ID NO: 24748 - DNA, 32 bp, Homo sapiens; identical to SEQ ID NO: 15449
  chr10:135017129-135017161
  hypo

SEQ ID NO: 24749 - DNA, 30 bp, Homo sapiens; identical to SEQ ID NO: 15450
  chr10:135017385-135017415
  hypo

SEQ ID NO: 24750 - DNA, 34 bp, Homo sapiens
  chr10:135020767-135020801
  hypo
acgtcaacaagcacccgggcggccggcagaaggc

SEQ ID NO: 24751 - DNA, 30 bp, Homo sapiens; identical to SEQ ID NO: 15452
  chr10:135023111-135023141
  hypo

SEQ ID NO: 24752 - DNA, 36 bp, Homo sapiens
  chr10:135023434-135023470
  hypo
gtctcctgagggtggcgcggtttcacccagtgaaga

SEQ ID NO: 24753 - DNA, 30 bp, Homo sapiens; identical to SEQ ID NO: 15454
  chr10:135035009-135035039
  hypo

SEQ ID NO: 24754 - DNA, 49 bp, Homo sapiens; identical to SEQ ID NO: 15455
  chr10:135069848-135069897
  hypo

SEQ ID NO: 24755 - DNA, 14 bp, Homo sapiens
  chr11:394801-394815
  hypo
ttggcacatggcag

SEQ ID NO: 24756 - DNA, 139 bp, Homo sapiens; identical to SEQ ID NO: 15457
  chr11:445925-446064
  hypo

SEQ ID NO: 24757 - DNA, 18 bp, Homo sapiens
  chr11:447613-447631
  hypo
gcccggccttctctgcca

SEQ ID NO: 24758 - DNA, 78 bp, Homo sapiens; identical to SEQ ID NO: 15459
  chr11:449595-449673
  hypo

SEQ ID NO: 24759 - DNA, 470 bp, Homo sapiens; identical to SEQ ID NO: 15460
  chr11:562246-562716
  hypo

SEQ ID NO: 24760 - DNA, 30 bp, Homo sapiens; identical to SEQ ID NO: 15461
  chr11:762939-762969
  hypo

SEQ ID NO: 24761 - DNA, 5 bp, Homo sapiens
  chr11:763318-763323
  hypo
gccct

SEQ ID NO: 24762 - DNA, 80 bp, Homo sapiens; identical to SEQ ID NO: 15465
  chr11:859292-859372
  hypo

SEQ ID NO: 24763 - DNA, 180 bp, Homo sapiens; identical to SEQ ID NO: 15466
  chr11:862671-862851
  hypo

SEQ ID NO: 24764 - DNA, 68 bp, Homo sapiens; identical to SEQ ID NO: 15467
  chr11:864749-864817
  hypo

SEQ ID NO: 24765 - DNA, 123 bp, Homo sapiens; identical to SEQ ID NO: 15468
  chr11:865692-865815
  hypo

SEQ ID NO: 24766 - DNA, 30 bp, Homo sapiens; identical to SEQ ID NO: 15469
  chr11:866956-866986
  hypo

SEQ ID NO: 24767 - DNA, 30 bp, Homo sapiens; identical to SEQ ID NO: 15470
  chr11:875487-875517
  hypo

SEQ ID NO: 24768 - DNA, 61 bp, Homo sapiens; identical to SEQ ID NO: 15471
  chr11:985399-985460
  hypo

SEQ ID NO: 24769 - DNA, 30 bp, Homo sapiens; identical to SEQ ID NO: 15472
  chr11:986983-987013
  hypo

SEQ ID NO: 24770 - DNA, 48 bp, Homo sapiens
  chr11:1029190-1029238
  hypo
gagcgcccctccccacgggccacagggctcgtcctacctggaggagga

SEQ ID NO: 24771 - DNA, 18 bp, Homo sapiens
  chr11:1029403-1029421
  hypo
ggccgctggagccagaca

SEQ ID NO: 24772 - DNA, 31 bp, Homo sapiens
  chr11:1030184-1030215
  hypo
gagagagagtgcctgcgactgccctcacctt

SEQ ID NO: 24773 - DNA, 59 bp, Homo sapiens; identical to SEQ ID NO: 15475
  chr11:1075796-1075855
  hypo

SEQ ID NO: 24774 - DNA, 35 bp, Homo sapiens; identical to SEQ ID NO: 15476
  chr11:1077652-1077687
  hypo

SEQ ID NO: 24775 - DNA, 57 bp, Homo sapiens; identical to SEQ ID NO: 15477
  chr11:1095083-1095140
  hypo

SEQ ID NO: 24776 - DNA, 30 bp, Homo sapiens; identical to SEQ ID NO: 15478
  chr11:1104124-1104154
  hypo

SEQ ID NO: 24777 - DNA, 30 bp, Homo sapiens; identical to SEQ ID NO: 15479
  chr11:1142462-1142492
  hypo

SEQ ID NO: 24778 - DNA, 30 bp, Homo sapiens; identical to SEQ ID NO: 15480
  chr11:1151771-1151801
  hypo

SEQ ID NO: 24779 - DNA, 16 bp, Homo sapiens
  chr11:1214917-1214933
  hypo
ccggggcagccactcc

SEQ ID NO: 24780 - DNA, 32 bp, Homo sapiens
  chr11:1215867-1215899
  hypo
gtttgccaacaacaccgagggccagtgcggtg

SEQ ID NO: 24781 - DNA, 27 bp, Homo sapiens
  chr11:1244354-1244381
  hypo
tgggtgccccgagcgcgtgccggacgc

SEQ ID NO: 24782 - DNA, 66 bp, Homo sapiens
  chr11:1244465-1244531
  hypo
ggcgggggtctctgcaggtcgcttgcctgggagcttctcctgcagagtgcacgggcagatccccct

SEQ ID NO: 24783 - DNA, 67 bp, Homo sapiens; identical to SEQ ID NO: 15484
  chr11:1247815-1247882
  hypo

SEQ ID NO: 24784 - DNA, 94 bp, Homo sapiens
  chr11:1250924-1251018
  hypo
gtgctggatgacatcacgcactctggctgcctgcccctcgggcagtgcccctgcacccacggcggccgcacctacagcccgggcacctccttca

SEQ ID NO: 24785 - DNA, 105 bp, Homo sapiens; identical to SEQ ID NO: 15486
  chr11:1252902-1253007
  hypo

SEQ ID NO: 24786 - DNA, 279 bp, Homo sapiens; identical to SEQ ID NO: 15487
  chr11:1255015-1255294
  hypo

SEQ ID NO: 24787 - DNA, 30 bp, Homo sapiens; identical to SEQ ID NO: 15488
  chr11:1256469-1256499
  hypo

SEQ ID NO: 24788 - DNA, 106 bp, Homo sapiens; identical to SEQ ID NO: 15489
  chr11:1257713-1257819
  hypo

SEQ ID NO: 24789 - DNA, 30 bp, Homo sapiens; identical to SEQ ID NO: 15491
  chr11:1276708-1276738
  hypo

SEQ ID NO: 24790 - DNA, 161 bp, Homo sapiens; identical to SEQ ID NO: 15492
  chr11:1382237-1382398
  hypo

SEQ ID NO: 24791 - DNA, 76 bp, Homo sapiens; identical to SEQ ID NO: 15493
  chr11:1430992-1431068
  hypo

SEQ ID NO: 24792 - DNA, 30 bp, Homo sapiens; identical to SEQ ID NO: 15494
  chr11:1444922-1444952
  hypo

SEQ ID NO: 24793 - DNA, 30 bp, Homo sapiens; identical to SEQ ID NO: 15495
  chr11:1455198-1455228
  hypo

SEQ ID NO: 24794 - DNA, 30 bp, Homo sapiens; identical to SEQ ID NO: 15496
  chr11:1461990-1462020
  hypo

SEQ ID NO: 24795 - DNA, 76 bp, Homo sapiens
  chr11:1464204-1464280
  hypo
cagggaatgtgggggcgtctggcaccacagccctggaggcctccttgagggccctgcggtgcaccatcaccctggg

SEQ ID NO: 24796 - DNA, 33 bp, Homo sapiens
  chr11:1464428-1464461
  hypo
ggtgggaccccagcctgccgcacccccaggtgc

SEQ ID NO: 24797 - DNA, 243 bp, Homo sapiens; identical to SEQ ID NO: 15498
  chr11:1464674-1464917
  hypo

SEQ ID NO: 24798 - DNA, 127 bp, Homo sapiens; identical to SEQ ID NO: 15499
  chr11:1466979-1467106
  hypo

SEQ ID NO: 24799 - DNA, 71 bp, Homo sapiens
  chr11:1469157-1469228
  hypo
gggcaggcacatgggcgggtctggtggcgggctgggctgcagggctcctgctgcggtgaagccagccagca

SEQ ID NO: 24800 - DNA, 40 bp, Homo sapiens
  chr11:1471880-1471920
  hypo
cgccaaaggagagcccggctggcacgcccaaccccacgcc

SEQ ID NO: 24801 - DNA, 33 bp, Homo sapiens; identical to SEQ ID NO: 15502
  chr11:1477820-1477853
  hypo

SEQ ID NO: 24802 - DNA, 62 bp, Homo sapiens; identical to SEQ ID NO: 15503
  chr11:1669565-1669627
  hypo

SEQ ID NO: 24803 - DNA, 33 bp, Homo sapiens; identical to SEQ ID NO: 15504
  chr11:1856532-1856565
  hypo

SEQ ID NO: 24804 - DNA, 33 bp, Homo sapiens; identical to SEQ ID NO: 15506
  chr11:1955358-1955391
  hypo

SEQ ID NO: 24805 - DNA, 19 bp, Homo sapiens
  chr11:1957372-1957391
  hypo
aagctagcccacagccggg

SEQ ID NO: 24806 - DNA, 120 bp, Homo sapiens; identical to SEQ ID NO: 15508
  chr11:1958184-1958304
  hypo

SEQ ID NO: 24807 - DNA, 45 bp, Homo sapiens
  chr11:1959032-1959077
  hypo
ctgagggtgggcagtcggcgtggtgtgcatgtgcctgcgtgtgtg

SEQ ID NO: 24808 - DNA, 35 bp, Homo sapiens
  chr11:1959187-1959222
  hypo
aagcactcctgtcctccacccgccttcacccctca

SEQ ID NO: 24809 - DNA, 41 bp, Homo sapiens; identical to SEQ ID NO: 15510
  chr11:1981275-1981316
  hypo

SEQ ID NO: 24810 - DNA, 30 bp, Homo sapiens; identical to SEQ ID NO: 15511
  chr11:2037043-2037073
  hypo

SEQ ID NO: 24811 - DNA, 2 bp, Homo sapiens
  chr11:2040105-2040107
  hypo
ca

SEQ ID NO: 24812 - DNA, 40 bp, Homo sapiens; identical to SEQ ID NO: 15514
  chr11:2278423-2278463
  hypo

SEQ ID NO: 24813 - DNA, 45 bp, Homo sapiens
  chr11:2438144-2438189
  hypo
atgaagcatggaatggcatacgcttcaacacggaggaaccgtcaa

SEQ ID NO: 24814 - DNA, 30 bp, Homo sapiens; identical to SEQ ID NO: 15517
  chr11:2543418-2543448
  hypo

SEQ ID NO: 24815 - DNA, 76 bp, Homo sapiens; identical to SEQ ID NO: 15518
  chr11:2596517-2596593
  hypo

SEQ ID NO: 24816 - DNA, 30 bp, Homo sapiens; identical to SEQ ID NO: 15519
  chr11:2818227-2818257
  hypo

SEQ ID NO: 24817 - DNA, 30 bp, Homo sapiens; identical to SEQ ID NO: 15520
  chr11:2829204-2829234
  hypo

SEQ ID NO: 24818 - DNA, 30 bp, Homo sapiens; identical to SEQ ID NO: 15522
  chr11:3828932-3828962
  hypo

SEQ ID NO: 24819 - DNA, 26 bp, Homo sapiens
  chr11:5169023-5169049
  hypo
tttttttttttttttcggagacagag

SEQ ID NO: 24820 - DNA, 159 bp, Homo sapiens; identical to SEQ ID NO: 15524
  chr11:5192016-5192175
  hypo

SEQ ID NO: 24821 - DNA, 80 bp, Homo sapiens; identical to SEQ ID NO: 15525
  chr11:6497229-6497309
  hypo

SEQ ID NO: 24822 - DNA, 30 bp, Homo sapiens; identical to SEQ ID NO: 15526
  chr11:6731043-6731073
  hypo

SEQ ID NO: 24823 - DNA, 101 bp, Homo sapiens; identical to SEQ ID NO: 15529
  chr11:10865201-10865302
  hypo

SEQ ID NO: 24824 - DNA, 87 bp, Homo sapiens; identical to SEQ ID NO: 15530
  chr11:14564357-14564444
  hypo

SEQ ID NO: 24825 - DNA, 88 bp, Homo sapiens; identical to SEQ ID NO: 15531
  chr11:17100697-17100785
  hypo

SEQ ID NO: 24826 - DNA, 37 bp, Homo sapiens; identical to SEQ ID NO: 15532
  chr11:19137271-19137308
  hypo

SEQ ID NO: 24827 - DNA, 139 bp, Homo sapiens; identical to SEQ ID NO: 15533
  chr11:27495284-27495423
  hypo

SEQ ID NO: 24828 - DNA, 17 bp, Homo sapiens
  chr11:33181188-33181205
  hypo
cgcgcctgtactcccag

SEQ ID NO: 24829 - DNA, 29 bp, Homo sapiens
  chr11:33202774-33202803
  hypo
acacctgtaattagccgggtgtggtggtg

SEQ ID NO: 24830 - DNA, 30 bp, Homo sapiens; identical to SEQ ID NO: 15536
  chr11:33270025-33270055
  hypo

SEQ ID NO: 24831 - DNA, 19 bp, Homo sapiens
  chr11:33277689-33277708
  hypo
ccaccgcgcccggcctcct

SEQ ID NO: 24832 - DNA, 30 bp, Homo sapiens; identical to SEQ ID NO: 15538
  chr11:34534277-34534307
  hypo

SEQ ID NO: 24833 - DNA, 24 bp, Homo sapiens
  chr11:34535069-34535093
  hypo
gtgtcaaacagctcccggaggccc

SEQ ID NO: 24834 - DNA, 80 bp, Homo sapiens
  chr11:34535123-34535203
  hypo
tggagctggagatggacgagcagacccaggccccaggccgagcctctgagccctgacaccccttacgattcatccaaaaa

SEQ ID NO: 24835 - DNA, 30 bp, Homo sapiens; identical to SEQ ID NO: 15540
  chr11:35134309-35134339
  hypo

SEQ ID NO: 24836 - DNA, 83 bp, Homo sapiens; identical to SEQ ID NO: 15542
  chr11:44922891-44922974
  hypo

SEQ ID NO: 24837 - DNA, 32 bp, Homo sapiens; identical to SEQ ID NO: 15543
  chr11:46298483-46298515
  hypo

SEQ ID NO: 24838 - DNA, 30 bp, Homo sapiens; identical to SEQ ID NO: 15545
  chr11:57150498-57150528
  hypo

SEQ ID NO: 24839 - DNA, 76 bp, Homo sapiens
  chr11:57235330-57235406
  hypo
tctccaccatctacccgggcactttccgccacttgcaagccctggaggagctggacctcggtgacaaccggcacct

SEQ ID NO: 24840 - DNA, 30 bp, Homo sapiens; identical to SEQ ID NO: 15547
  chr11:59312651-59312681
  hypo

SEQ ID NO: 24841 - DNA, 30 bp, Homo sapiens; identical to SEQ ID NO: 15548
  chr11:59609810-59609840
  hypo

SEQ ID NO: 24842 - DNA, 30 bp, Homo sapiens; identical to SEQ ID NO: 15550
  chr11:60897879-60897909
  hypo

SEQ ID NO: 24843 - DNA, 171 bp, Homo sapiens; identical to SEQ ID NO: 5117
  chr11:60941596-60941767
  hypo

SEQ ID NO: 24844 - DNA, 30 bp, Homo sapiens; identical to SEQ ID NO: 15552
  chr11:61039084-61039114
  hypo

SEQ ID NO: 24845 - DNA, 37 bp, Homo sapiens; identical to SEQ ID NO: 15553
  chr11:61049497-61049534
  hypo

SEQ ID NO: 24846 - DNA, 42 bp, Homo sapiens
  chr11:61664613-61664655
  hypo
agtaagtggtgatggcggaggtggggtggcttcaggatttgg

SEQ ID NO: 24847 - DNA, 41 bp, Homo sapiens; identical to SEQ ID NO: 15556
  chr11:61669905-61669946
  hypo

SEQ ID NO: 24848 - DNA, 30 bp, Homo sapiens; identical to SEQ ID NO: 15557
  chr11:61736670-61736700
  hypo

SEQ ID NO: 24849 - DNA, 30 bp, Homo sapiens; identical to SEQ ID NO: 15559
  chr11:62445455-62445485
  hypo

SEQ ID NO: 24850 - DNA, 30 bp, Homo sapiens; identical to SEQ ID NO: 15560
  chr11:63783752-63783782
  hypo

SEQ ID NO: 24851 - DNA, 7 bp, Homo sapiens
  chr11:63849387-63849394
  hypo
tggactc

SEQ ID NO: 24852 - DNA, 77 bp, Homo sapiens; identical to SEQ ID NO: 15562
  chr11:63955145-63955222
  hypo

SEQ ID NO: 24853 - DNA, 30 bp, Homo sapiens; identical to SEQ ID NO: 15564
  chr11:64668004-64668034
  hypo

SEQ ID NO: 24854 - DNA, 30 bp, Homo sapiens; identical to SEQ ID NO: 15565
  chr11:64977482-64977512
  hypo

SEQ ID NO: 24855 - DNA, 30 bp, Homo sapiens; identical to SEQ ID NO: 15566
  chr11:65091387-65091417
  hypo

SEQ ID NO: 24856 - DNA, 30 bp, Homo sapiens; identical to SEQ ID NO: 15567
  chr11:65127486-65127516
  hypo

SEQ ID NO: 24857 - DNA, 95 bp, Homo sapiens; identical to SEQ ID NO: 15569
  chr11:65551629-65551724
  hypo

SEQ ID NO: 24858 - DNA, 35 bp, Homo sapiens; identical to SEQ ID NO: 15570
  chr11:65722789-65722824
  hypo

SEQ ID NO: 24859 - DNA, 30 bp, Homo sapiens; identical to SEQ ID NO: 15571
  chr11:66048072-66048102
  hypo

SEQ ID NO: 24860 - DNA, 104 bp, Homo sapiens; identical to SEQ ID NO: 15572
  chr11:66325272-66325376
  hypo

SEQ ID NO: 24861 - DNA, 93 bp, Homo sapiens; identical to SEQ ID NO: 15573
  chr11:66411368-66411461
  hypo

SEQ ID NO: 24862 - DNA, 35 bp, Homo sapiens
  chr11:66513182-66513217
  hypo
ggctagaacccagggcgctgactcataggccagtg

SEQ ID NO: 24863 - DNA, 16 bp, Homo sapiens
  chr11:66515380-66515396
  hypo
gcgcagggcagcatta

SEQ ID NO: 24864 - DNA, 59 bp, Homo sapiens
  chr11:66625148-66625207
  hypo
ccaagtgggcacctgcgccagccccacctgtgcctgggctgtggccccttcctacaggg

SEQ ID NO: 24865 - DNA, 98 bp, Homo sapiens
  chr11:66625240-66625338
  hypo
tgctggccagtggagcggccgcctgcccgctgccctgcgtctgccagaacctgtccgagtcgctcagcaccctctgtgcccaccgaggcctgctgttt

SEQ ID NO: 24866 - DNA, 343 bp, Homo sapiens; identical to SEQ ID NO: 15579
  chr11:66625538-66625881
  hypo

SEQ ID NO: 24867 - DNA, 207 bp, Homo sapiens; identical to SEQ ID NO: 15580
  chr11:66631300-66631507
  hypo

SEQ ID NO: 24868 - DNA, 5 bp, Homo sapiens
  chr11:67764182-67764187
  hypo
tgttg

SEQ ID NO: 24869 - DNA, 45 bp, Homo sapiens
  chr11:67781564-67781609
  hypo
atcattagctggcaggtgccatcattacaccggtaacatgagagg

SEQ ID NO: 24870 - DNA, 154 bp, Homo sapiens; identical to SEQ ID NO: 15587
  chr11:68111091-68111245
  hypo

SEQ ID NO: 24871 - DNA, 142 bp, Homo sapiens; identical to SEQ ID NO: 15588
  chr11:68133031-68133173
  hypo

SEQ ID NO: 24872 - DNA, 30 bp, Homo sapiens; identical to SEQ ID NO: 15591
  chr11:69339953-69339983
  hypo

SEQ ID NO: 24873 - DNA, 30 bp, Homo sapiens; identical to SEQ ID NO: 15592
  chr11:69970448-69970478
  hypo

SEQ ID NO: 24874 - DNA, 30 bp, Homo sapiens; identical to SEQ ID NO: 15593
  chr11:70051066-70051096
  hypo

SEQ ID NO: 24875 - DNA, 34 bp, Homo sapiens; identical to SEQ ID NO: 15594
  chr11:71117681-71117715
  hypo

SEQ ID NO: 24876 - DNA, 30 bp, Homo sapiens; identical to SEQ ID NO: 15596
  chr11:72532300-72532330
  hypo

SEQ ID NO: 24877 - DNA, 30 bp, Homo sapiens; identical to SEQ ID NO: 15597
  chr11:72905832-72905862
  hypo

SEQ ID NO: 24878 - DNA, 62 bp, Homo sapiens; identical to SEQ ID NO: 15598
  chr11:73073174-73073236
  hypo

SEQ ID NO: 24879 - DNA, 16 bp, Homo sapiens
  chr11:73310441-73310457
  hypo
cctctgcctcccgggt

SEQ ID NO: 24880 - DNA, 24 bp, Homo sapiens
  chr11:74246632-74246656
  hypo
tatgagccacggcacccagcccaa

SEQ ID NO: 24881 - DNA, 13 bp, Homo sapiens
  chr11:75459473-75459486
  hypo
cagataaacaaaa

SEQ ID NO: 24882 - DNA, 9 bp, Homo sapiens
  chr11:76372077-76372086
  hypo
ccatcagca

SEQ ID NO: 24883 - DNA, 30 bp, Homo sapiens; identical to SEQ ID NO: 15603
  chr11:95488699-95488729
  hypo

SEQ ID NO: 24884 - DNA, 30 bp, Homo sapiens; identical to SEQ ID NO: 15604
  chr11:95658721-95658751
  hypo

SEQ ID NO: 24885 - DNA, 185 bp, Homo sapiens; identical to SEQ ID NO: 15606
  chr11:113552799-113552984
  hypo

SEQ ID NO: 24886 - DNA, 32 bp, Homo sapiens; identical to SEQ ID NO: 15607
  chr11:116890012-116890044
  hypo

SEQ ID NO: 24887 - DNA, 16 bp, Homo sapiens
  chr11:116952332-116952348
  hypo
ccgtctcaaaataaat

SEQ ID NO: 24888 - DNA, 7 bp, Homo sapiens
  chr11:120008098-120008105
  hypo
agcagct

SEQ ID NO: 24889 - DNA, 30 bp, Homo sapiens; identical to SEQ ID NO: 15610
  chr11:120367603-120367633
  hypo

SEQ ID NO: 24890 - DNA, 30 bp, Homo sapiens; identical to SEQ ID NO: 15611
  chr11:121023674-121023704
  hypo

SEQ ID NO: 24891 - DNA, 43 bp, Homo sapiens
  chr11:125755569-125755612
  hypo
ccaacccccaggccacggacaggcacctaggaaccaggccgca

SEQ ID NO: 24892 - DNA, 22 bp, Homo sapiens
  chr11:126083949-126083971
  hypo
aagaatttatgtggccgggcgc

SEQ ID NO: 24893 - DNA, 37 bp, Homo sapiens; identical to SEQ ID NO: 15614
  chr11:126273042-126273079
  hypo

SEQ ID NO: 24894 - DNA, 30 bp, Homo sapiens; identical to SEQ ID NO: 15615
  chr11:129867029-129867059
  hypo

SEQ ID NO: 24895 - DNA, 30 bp, Homo sapiens; identical to SEQ ID NO: 15616
  chr11:130717573-130717603
  hypo

SEQ ID NO: 24896 - DNA, 11 bp, Homo sapiens
  chr11:133231728-133231739
  hypo
aatgagctcag

SEQ ID NO: 24897 - DNA, 125 bp, Homo sapiens; identical to SEQ ID NO: 15620
  chr11:134011075-134011200
  hypo

SEQ ID NO: 24898 - DNA, 30 bp, Homo sapiens; identical to SEQ ID NO: 15621
  chr12:1948142-1948172
  hypo

SEQ ID NO: 24899 - DNA, 52 bp, Homo sapiens; identical to SEQ ID NO: 15622
  chr12:1948496-1948548
  hypo

SEQ ID NO: 24900 - DNA, 30 bp, Homo sapiens; identical to SEQ ID NO: 15624
  chr12:2590465-2590495
  hypo

SEQ ID NO: 24901 - DNA, 217 bp, Homo sapiens
  chr12:2964577-2964794
  hypo
tgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctg

SEQ ID NO: 24902 - DNA, 55 bp, Homo sapiens; identical to SEQ ID NO: 15626
  chr12:4405652-4405707
  hypo

SEQ ID NO: 24903 - DNA, 103 bp, Homo sapiens; identical to SEQ ID NO: 15628
  chr12:5335946-5336049
  hypo

SEQ ID NO: 24904 - DNA, 47 bp, Homo sapiens
  chr12:6483568-6483615
  hypo
gaagacgagcttgtccgagttgaggttgatgttgaggctgacggggt

SEQ ID NO: 24905 - DNA, 30 bp, Homo sapiens; identical to SEQ ID NO: 15630
  chr12:8060661-8060691
  hypo

SEQ ID NO: 24906 - DNA, 30 bp, Homo sapiens; identical to SEQ ID NO: 15631
  chr12:8117682-8117712
  hypo

SEQ ID NO: 24907 - DNA, 118 bp, Homo sapiens; identical to SEQ ID NO: 15633
  chr12:8790007-8790125
  hypo

SEQ ID NO: 24908 - DNA, 30 bp, Homo sapiens; identical to SEQ ID NO: 15634
  chr12:8799975-8800005
  hypo

SEQ ID NO: 24909 - DNA, 40 bp, Homo sapiens
  chr12:8808559-8808599
  hypo
tacaataatgacaaacgattgatgacttctttgcaatact

SEQ ID NO: 24910 - DNA, 181 bp, Homo sapiens; identical to SEQ ID NO: 15638
  chr12:13079830-13080011
  hypo

SEQ ID NO: 24911 - DNA, 94 bp, Homo sapiens; identical to SEQ ID NO: 15639
  chr12:13215216-13215310
  hypo

SEQ ID NO: 24912 - DNA, 65 bp, Homo sapiens; identical to SEQ ID NO: 15640
  chr12:17629461-17629526
  hypo

SEQ ID NO: 24913 - DNA, 83 bp, Homo sapiens; identical to SEQ ID NO: 15642
  chr12:22698113-22698196
  hypo

SEQ ID NO: 24914 - DNA, 77 bp, Homo sapiens; identical to SEQ ID NO: 15643
  chr12:25081492-25081569
  hypo

SEQ ID NO: 24915 - DNA, 16 bp, Homo sapiens
  chr12:27489593-27489609
  hypo
ttaaacctggctgggc

SEQ ID NO: 24916 - DNA, 20 bp, Homo sapiens
  chr12:30859424-30859444
  hypo
acaagcgtaagccactgtac

SEQ ID NO: 24917 - DNA, 151 bp, Homo sapiens; identical to SEQ ID NO: 15647
  chr12:32597645-32597796
  hypo

SEQ ID NO: 24918 - DNA, 33 bp, Homo sapiens; identical to SEQ ID NO: 15648
  chr12:32831140-32831173
  hypo

SEQ ID NO: 24919 - DNA, 92 bp, Homo sapiens; identical to SEQ ID NO: 15649
  chr12:32831293-32831385
  hypo

SEQ ID NO: 24920 - DNA, 38 bp, Homo sapiens
  chr12:34494918-34494956
  hypo
gtcccgggtttgcactccccgagcggctggacactgcg

SEQ ID NO: 24921 - DNA, 60 bp, Homo sapiens
  chr12:34502803-34502863
  hypo
gcggctgtgggcggctaccccaggggaccagctgctccgagggcgcgagcctaggaccct

SEQ ID NO: 24922 - DNA, 40 bp, Homo sapiens; identical to SEQ ID NO: 15652
  chr12:34520176-34520216
  hypo

SEQ ID NO: 24923 - DNA, 94 bp, Homo sapiens; identical to SEQ ID NO: 15653
  chr12:38550728-38550822
  hypo

SEQ ID NO: 24924 - DNA, 98 bp, Homo sapiens
  chr12:49657607-49657705
  hypo
aagggtttaattcctcggagctctactttcctcatctgtaaactagggataataattcatagagtttgtcatatggatgaaatgtgatcatgtgatat

SEQ ID NO: 24925 - DNA, 205 bp, Homo sapiens
  chr12:51421351-51421556
  hypo
gcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaatt

SEQ ID NO: 24926 - DNA, 144 bp, Homo sapiens; identical to SEQ ID NO: 15658
  chr12:53189513-53189657
  hypo

SEQ ID NO: 24927 - DNA, 198 bp, Homo sapiens; identical to SEQ ID NO: 15659
  chr12:53663026-53663224
  hypo

SEQ ID NO: 24928 - DNA, 71 bp, Homo sapiens
  chr12:54720232-54720303
  hypo
tattgtatgatctaggatgctaatttctccctctctggttacatgagaattgtggtcgctaaagggctgta

SEQ ID NO: 24929 - DNA, 43 bp, Homo sapiens; identical to SEQ ID NO: 15661
  chr12:56441277-56441320
  hypo

SEQ ID NO: 24930 - DNA, 30 bp, Homo sapiens; identical to SEQ ID NO: 15662
  chr12:57559766-57559796
  hypo

SEQ ID NO: 24931 - DNA, 15 bp, Homo sapiens
  chr12:57881112-57881127
  hypo
ctttgtcactaattc

SEQ ID NO: 24932 - DNA, 75 bp, Homo sapiens; identical to SEQ ID NO: 5137
  chr12:58241524-58241599
  hypo

SEQ ID NO: 24933 - DNA, 19 bp, Homo sapiens
  chr12:62539074-62539093
  hypo
cctcctgtcagttggcggt

SEQ ID NO: 24934 - DNA, 22 bp, Homo sapiens
  chr12:62563354-62563376
  hypo
gggcacagtggctcacgcctgt

SEQ ID NO: 24935 - DNA, 26 bp, Homo sapiens
  chr12:64783308-64783334
  hypo
tctgtagctcaggctggagtgcaggt

SEQ ID NO: 24936 - DNA, 23 bp, Homo sapiens
  chr12:64797450-64797473
  hypo
aaataaattttggaccggacacc

SEQ ID NO: 24937 - DNA, 75 bp, Homo sapiens
  chr12:65516455-65516530
  hypo
gcataacctatccacctggcccagcagaaagaactgatttttgcctcctgcctaattcctcggatgcacaaagaa

SEQ ID NO: 24938 - DNA, 38 bp, Homo sapiens; identical to SEQ ID NO: 15671
  chr12:66208320-66208358
  hypo

SEQ ID NO: 24939 - DNA, 29 bp, Homo sapiens
  chr12:68978592-68978621
  hypo
aaaagctttttttccgttttcactagaaa

SEQ ID NO: 24940 - DNA, 26 bp, Homo sapiens
  chr12:69964264-69964290
  hypo
ttgaaagtggtcgaaggtgtcaaact

SEQ ID NO: 24941 - DNA, 106 bp, Homo sapiens
  chr12:70087568-70087674
  hypo
gcgcccgtgctcgtcgcttccgtgaacactgctagagatgaggaacattagcctgtctggccagggcaaattcacaaactggttccaccatcggttcactaccaga

SEQ ID NO: 24942 - DNA, 25 bp, Homo sapiens
  chr12:74930406-74930431
  hypo
catgtaaggcactgtcgcaagattt

SEQ ID NO: 24943 - DNA, 30 bp, Homo sapiens; identical to SEQ ID NO: 15677
  chr12:77150018-77150048
  hypo

SEQ ID NO: 24944 - DNA, 30 bp, Homo sapiens; identical to SEQ ID NO: 15678
  chr12:94641622-94641652
  hypo

SEQ ID NO: 24945 - DNA, 81 bp, Homo sapiens; identical to SEQ ID NO: 15679
  chr12:95465839-95465920
  hypo

SEQ ID NO: 24946 - DNA, 9 bp, Homo sapiens
  chr12:96881029-96881038
  hypo
ccagccaat

SEQ ID NO: 24947 - DNA, 42 bp, Homo sapiens; identical to SEQ ID NO: 15681
  chr12:98948376-98948418
  hypo

SEQ ID NO: 24948 - DNA, 30 bp, Homo sapiens; identical to SEQ ID NO: 15682
  chr12:104690709-104690739
  hypo

SEQ ID NO: 24949 - DNA, 36 bp, Homo sapiens
  chr12:110717710-110717746
  hypo
taattttttgtttgtttgtttcgtgtagggttttgt

SEQ ID NO: 24950 - DNA, 30 bp, Homo sapiens; identical to SEQ ID NO: 15684
  chr12:110782730-110782760
  hypo

SEQ ID NO: 24951 - DNA, 41 bp, Homo sapiens; identical to SEQ ID NO: 15685
  chr12:110908130-110908171
  hypo

SEQ ID NO: 24952 - DNA, 30 bp, Homo sapiens; identical to SEQ ID NO: 15686
  chr12:111296630-111296660
  hypo

SEQ ID NO: 24953 - DNA, 30 bp, Homo sapiens; identical to SEQ ID NO: 15687
  chr12:111369069-111369099
  hypo

SEQ ID NO: 24954 - DNA, 30 bp, Homo sapiens; identical to SEQ ID NO: 15688
  chr12:112628549-112628579
  hypo

SEQ ID NO: 24955 - DNA, 16 bp, Homo sapiens
  chr12:112826001-112826017
  hypo
acgagtccatctcaaa

SEQ ID NO: 24956 - DNA, 30 bp, Homo sapiens; identical to SEQ ID NO: 15690
  chr12:112919571-112919601
  hypo

SEQ ID NO: 24957 - DNA, 30 bp, Homo sapiens; identical to SEQ ID NO: 15691
  chr12:114240315-114240345
  hypo

SEQ ID NO: 24958 - DNA, 30 bp, Homo sapiens; identical to SEQ ID NO: 15692
  chr12:117474645-117474675
  hypo

SEQ ID NO: 24959 - DNA, 108 bp, Homo sapiens; identical to SEQ ID NO: 15693
  chr12:117530039-117530147
  hypo

SEQ ID NO: 24960 - DNA, 39 bp, Homo sapiens; identical to SEQ ID NO: 15694
  chr12:117531034-117531073
  hypo

SEQ ID NO: 24961 - DNA, 25 bp, Homo sapiens
  chr12:117532499-117532524
  hypo
acaataatgagcattcgtttcataa

SEQ ID NO: 24962 - DNA, 30 bp, Homo sapiens; identical to SEQ ID NO: 15696
  chr12:118198752-118198782
  hypo

SEQ ID NO: 24963 - DNA, 30 bp, Homo sapiens; identical to SEQ ID NO: 15698
  chr12:120148366-120148396
  hypo

SEQ ID NO: 24964 - DNA, 30 bp, Homo sapiens; identical to SEQ ID NO: 15699
  chr12:120574326-120574356
  hypo

SEQ ID NO: 24965 - DNA, 46 bp, Homo sapiens; identical to SEQ ID NO: 15700
  chr12:122141060-122141106
  hypo

SEQ ID NO: 24966 - DNA, 40 bp, Homo sapiens
  chr12:122285027-122285067
  hypo
gccaccacaatggatcgcagagagctatattccgtgtgca

SEQ ID NO: 24967 - DNA, 30 bp, Homo sapiens; identical to SEQ ID NO: 15703
  chr12:122292767-122292797
  hypo

SEQ ID NO: 24968 - DNA, 45 bp, Homo sapiens; identical to SEQ ID NO: 15704
  chr12:122439448-122439493
  hypo

SEQ ID NO: 24969 - DNA, 30 bp, Homo sapiens; identical to SEQ ID NO: 15705
  chr12:122458643-122458673
  hypo

SEQ ID NO: 24970 - DNA, 30 bp, Homo sapiens; identical to SEQ ID NO: 15706
  chr12:122602863-122602893
  hypo

SEQ ID NO: 24971 - DNA, 30 bp, Homo sapiens; identical to SEQ ID NO: 15707
  chr12:122622042-122622072
  hypo

SEQ ID NO: 24972 - DNA, 30 bp, Homo sapiens; identical to SEQ ID NO: 15708
  chr12:122622344-122622374
  hypo

SEQ ID NO: 24973 - DNA, 30 bp, Homo sapiens; identical to SEQ ID NO: 15710
  chr12:124404180-124404210
  hypo

SEQ ID NO: 24974 - DNA, 173 bp, Homo sapiens; identical to SEQ ID NO: 15711
  chr12:124778198-124778371
  hypo

SEQ ID NO: 24975 - DNA, 30 bp, Homo sapiens; identical to SEQ ID NO: 15712
  chr12:124843833-124843863
  hypo

SEQ ID NO: 24976 - DNA, 46 bp, Homo sapiens; identical to SEQ ID NO: 15713
  chr12:124893479-124893525
  hypo

SEQ ID NO: 24977 - DNA, 54 bp, Homo sapiens; identical to SEQ ID NO: 15714
  chr12:125009346-125009400
  hypo

SEQ ID NO: 24978 - DNA, 41 bp, Homo sapiens; identical to SEQ ID NO: 15715
  chr12:125092426-125092467
  hypo

SEQ ID NO: 24979 - DNA, 33 bp, Homo sapiens; identical to SEQ ID NO: 15716
  chr12:125102143-125102176
  hypo

SEQ ID NO: 24980 - DNA, 30 bp, Homo sapiens; identical to SEQ ID NO: 15717
  chr12:125119323-125119353
  hypo

SEQ ID NO: 24981 - DNA, 59 bp, Homo sapiens; identical to SEQ ID NO: 15718
  chr12:125152108-125152167
  hypo

SEQ ID NO: 24982 - DNA, 30 bp, Homo sapiens; identical to SEQ ID NO: 15719
  chr12:125167715-125167745
  hypo

SEQ ID NO: 24983 - DNA, 27 bp, Homo sapiens
  chr12:126243097-126243124
  hypo
catgagccaccgcgcccggctgatgat

SEQ ID NO: 24984 - DNA, 35 bp, Homo sapiens; identical to SEQ ID NO: 15721
  chr12:128311016-128311051
  hypo

SEQ ID NO: 24985 - DNA, 122 bp, Homo sapiens; identical to SEQ ID NO: 15722
  chr12:128899719-128899841
  hypo

SEQ ID NO: 24986 - DNA, 51 bp, Homo sapiens
  chr12:130821621-130821672
  hypo
aaggcacaagtcattgaaagctaaatttccaggtaacggcctcctggcacc

SEQ ID NO: 24987 - DNA, 30 bp, Homo sapiens; identical to SEQ ID NO: 15724
  chr12:130920621-130920651
  hypo

SEQ ID NO: 24988 - DNA, 36 bp, Homo sapiens; identical to SEQ ID NO: 15725
  chr12:131268446-131268482
  hypo

SEQ ID NO: 24989 - DNA, 30 bp, Homo sapiens; identical to SEQ ID NO: 15726
  chr12:131433415-131433445
  hypo

SEQ ID NO: 24990 - DNA, 27 bp, Homo sapiens
  chr12:131547329-131547356
  hypo
atacaagggtcacgtggtaaatatatt

SEQ ID NO: 24991 - DNA, 177 bp, Homo sapiens; identical to SEQ ID NO: 15728
  chr12:132044061-132044238
  hypo

SEQ ID NO: 24992 - DNA, 30 bp, Homo sapiens; identical to SEQ ID NO: 15729
  chr12:132168275-132168305
  hypo

SEQ ID NO: 24993 - DNA, 87 bp, Homo sapiens
  chr12:132221602-132221689
  hypo
agcaaaagactgaggcgacgcacatcctcggtggaggactaatggagtccctctggtgtgctctcgcggtgggctgcagagctctgg

SEQ ID NO: 24994 - DNA, 48 bp, Homo sapiens
  chr12:132222076-132222124
  hypo
ttgtttcatcagctcagtgtgtttttgtttaggcggaagtggcccccg

SEQ ID NO: 24995 - DNA, 30 bp, Homo sapiens; identical to SEQ ID NO: 15731
  chr12:132240239-132240269
  hypo

SEQ ID NO: 24996 - DNA, 133 bp, Homo sapiens; identical to SEQ ID NO: 15732
  chr12:132280877-132281010
  hypo

SEQ ID NO: 24997 - DNA, 30 bp, Homo sapiens; identical to SEQ ID NO: 15733
  chr12:132284463-132284493
  hypo

SEQ ID NO: 24998 - DNA, 118 bp, Homo sapiens; identical to SEQ ID NO: 15734
  chr12:132329877-132329995
  hypo

SEQ ID NO: 24999 - DNA, 22 bp, Homo sapiens
  chr12:132333412-132333434
  hypo
gcgtgagtgtgcaaacgtctct

SEQ ID NO: 25000 - DNA, 52 bp, Homo sapiens; identical to SEQ ID NO: 15736
  chr12:132377978-132378030
  hypo

SEQ ID NO: 25001 - DNA, 130 bp, Homo sapiens; identical to SEQ ID NO: 15738
  chr12:132617233-132617363
  hypo

SEQ ID NO: 25002 - DNA, 67 bp, Homo sapiens; identical to SEQ ID NO: 15739
  chr12:132643941-132644008
  hypo

SEQ ID NO: 25003 - DNA, 48 bp, Homo sapiens; identical to SEQ ID NO: 15740
  chr12:132682618-132682666
  hypo

SEQ ID NO: 25004 - DNA, 30 bp, Homo sapiens; identical to SEQ ID NO: 15741
  chr12:132688204-132688234
  hypo

SEQ ID NO: 25005 - DNA, 30 bp, Homo sapiens
  chr12:132986465-132986495
  hypo
ccgtcctgtgggtgacggcagaacatctgg

SEQ ID NO: 25006 - DNA, 58 bp, Homo sapiens
  chr12:132986581-132986639
  hypo
agggagcggagccgggaaggccacggacatctgtgtggtgtcacgaacaaggtccggc

SEQ ID NO: 25007 - DNA, 30 bp, Homo sapiens; identical to SEQ ID NO: 15744
  chr12:133100990-133101020
  hypo

SEQ ID NO: 25008 - DNA, 30 bp, Homo sapiens; identical to SEQ ID NO: 15745
  chr12:133122176-133122206
  hypo

SEQ ID NO: 25009 - DNA, 30 bp, Homo sapiens; identical to SEQ ID NO: 15746
  chr12:133169847-133169877
  hypo

SEQ ID NO: 25010 - DNA, 102 bp, Homo sapiens; identical to SEQ ID NO: 15747
  chr12:133188357-133188459
  hypo

SEQ ID NO: 25011 - DNA, 30 bp, Homo sapiens; identical to SEQ ID NO: 15748
  chr12:133200007-133200037
  hypo

SEQ ID NO: 25012 - DNA, 30 bp, Homo sapiens; identical to SEQ ID NO: 15749
  chr12:133705743-133705773
  hypo

SEQ ID NO: 25013 - DNA, 82 bp, Homo sapiens; identical to SEQ ID NO: 15750
  chr13:19517769-19517851
  hypo

SEQ ID NO: 25014 - DNA, 81 bp, Homo sapiens; identical to SEQ ID NO: 15751
  chr13:20078191-20078272
  hypo

SEQ ID NO: 25015 - DNA, 15 bp, Homo sapiens
  chr13:20692250-20692265
  hypo
cgtgagccactgcgc

SEQ ID NO: 25016 - DNA, 71 bp, Homo sapiens; identical to SEQ ID NO: 15753
  chr13:25670585-25670656
  hypo

SEQ ID NO: 25017 - DNA, 23 bp, Homo sapiens
  chr13:30149065-30149088
  hypo
ccaccgtgcgtggccagagcagc

SEQ ID NO: 25018 - DNA, 94 bp, Homo sapiens; identical to SEQ ID NO: 15756
  chr13:30707267-30707361
  hypo

SEQ ID NO: 25019 - DNA, 30 bp, Homo sapiens; identical to SEQ ID NO: 15757
  chr13:30761001-30761031
  hypo

SEQ ID NO: 25020 - DNA, 33 bp, Homo sapiens; identical to SEQ ID NO: 15758
  chr13:31742917-31742950
  hypo

SEQ ID NO: 25021 - DNA, 203 bp, Homo sapiens
  chr13:37643739-37643942
  hypo
acccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctat

SEQ ID NO: 25022 - DNA, 53 bp, Homo sapiens; identical to SEQ ID NO: 15760
  chr13:41681520-41681573
  hypo

SEQ ID NO: 25023 - DNA, 30 bp, Homo sapiens; identical to SEQ ID NO: 15761
  chr13:45564773-45564803
  hypo

SEQ ID NO: 25024 - DNA, 30 bp, Homo sapiens; identical to SEQ ID NO: 15763
  chr13:46659310-46659340
  hypo

SEQ ID NO: 25025 - DNA, 30 bp, Homo sapiens; identical to SEQ ID NO: 15764
  chr13:46661314-46661344
  hypo

SEQ ID NO: 25026 - DNA, 172 bp, Homo sapiens; identical to SEQ ID NO: 15765
  chr13:46920144-46920316
  hypo

SEQ ID NO: 25027 - DNA, 35 bp, Homo sapiens; identical to SEQ ID NO: 15767
  chr13:49923030-49923065
  hypo

SEQ ID NO: 25028 - DNA, 24 bp, Homo sapiens
  chr13:50367862-50367886
  hypo
gggtgtggtggctcacgcctgtaa

SEQ ID NO: 25029 - DNA, 81 bp, Homo sapiens; identical to SEQ ID NO: 15770
  chr13:100356871-100356952
  hypo

SEQ ID NO: 25030 - DNA, 23 bp, Homo sapiens
  chr13:103569159-103569182
  hypo
accgcgcccggccgtcccccgtt

SEQ ID NO: 25031 - DNA, 27 bp, Homo sapiens
  chr13:110434424-110434451
  hypo
agaagtcaatgctggcgtaggtgttgg

SEQ ID NO: 25032 - DNA, 293 bp, Homo sapiens
  chr13:110434593-110434886
  hypo
ctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgt

SEQ ID NO: 25033 - DNA, 251 bp, Homo sapiens; identical to SEQ ID NO: 15773
  chr13:110435933-110436184
  hypo

SEQ ID NO: 25034 - DNA, 34 bp, Homo sapiens; identical to SEQ ID NO: 15774
  chr13:110436410-110436444
  hypo

SEQ ID NO: 25035 - DNA, 40 bp, Homo sapiens; identical to SEQ ID NO: 15775
  chr13:111277585-111277625
  hypo

SEQ ID NO: 25036 - DNA, 56 bp, Homo sapiens; identical to SEQ ID NO: 15777
  chr13:111289222-111289278
  hypo

SEQ ID NO: 25037 - DNA, 30 bp, Homo sapiens; identical to SEQ ID NO: 15778
  chr13:111978886-111978916
  hypo

SEQ ID NO: 25038 - DNA, 45 bp, Homo sapiens; identical to SEQ ID NO: 15779
  chr13:113107030-113107075
  hypo

SEQ ID NO: 25039 - DNA, 30 bp, Homo sapiens; identical to SEQ ID NO: 15780
  chr13:113400400-113400430
  hypo

SEQ ID NO: 25040 - DNA, 55 bp, Homo sapiens
  chr13:113598563-113598618
  hypo
atgaagggagggtcccgggtgaagagcaagctcatgaccctcatttactgggaat

SEQ ID NO: 25041 - DNA, 30 bp, Homo sapiens; identical to SEQ ID NO: 15782
  chr13:113776004-113776034
  hypo

SEQ ID NO: 25042 - DNA, 25 bp, Homo sapiens
  chr13:114055958-114055983
  hypo
gggagctgtggggaccggcccccca

SEQ ID NO: 25043 - DNA, 194 bp, Homo sapiens
  chr13:114074574-114074768
  hypo
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggaga

SEQ ID NO: 25044 - DNA, 296 bp, Homo sapiens
  chr13:114074853-114075149
  hypo
gggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccct

SEQ ID NO: 25045 - DNA, 43 bp, Homo sapiens; identical to SEQ ID NO: 15787
  chr13:114122929-114122972
  hypo

SEQ ID NO: 25046 - DNA, 86 bp, Homo sapiens; identical to SEQ ID NO: 15788
  chr13:114188403-114188489
  hypo

SEQ ID NO: 25047 - DNA, 7 bp, Homo sapiens
  chr13:114221652-114221659
  hypo
aacatgt

SEQ ID NO: 25048 - DNA, 30 bp, Homo sapiens; identical to SEQ ID NO: 15790
  chr13:114271940-114271970
  hypo

SEQ ID NO: 25049 - DNA, 158 bp, Homo sapiens
  chr13:114497859-114498017
  hypo
cgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagtt

SEQ ID NO: 25050 - DNA, 106 bp, Homo sapiens; identical to SEQ ID NO: 15793
  chr13:114526504-114526610
  hypo

SEQ ID NO: 25051 - DNA, 30 bp, Homo sapiens; identical to SEQ ID NO: 15794
  chr13:114746822-114746852
  hypo

SEQ ID NO: 25052 - DNA, 26 bp, Homo sapiens
  chr13:114748638-114748664
  hypo
ggccgggacggcgtgcatctcacttt

SEQ ID NO: 25053 - DNA, 30 bp, Homo sapiens; identical to SEQ ID NO: 15796
  chr13:114749034-114749064
  hypo

SEQ ID NO: 25054 - DNA, 44 bp, Homo sapiens; identical to SEQ ID NO: 15797
  chr13:114760951-114760995
  hypo

SEQ ID NO: 25055 - DNA, 38 bp, Homo sapiens; identical to SEQ ID NO: 15798
  chr13:114765164-114765202
  hypo

SEQ ID NO: 25056 - DNA, 184 bp, Homo sapiens; identical to SEQ ID NO: 15799
  chr13:114769986-114770170
  hypo

SEQ ID NO: 25057 - DNA, 30 bp, Homo sapiens; identical to SEQ ID NO: 15800
  chr13:114771035-114771065
  hypo

SEQ ID NO: 25058 - DNA, 6 bp, Homo sapiens
  chr13:114780555-114780561
  hypo
cggaac

SEQ ID NO: 25059 - DNA, 22 bp, Homo sapiens
  chr13:114781061-114781083
  hypo
gaatggacgttcactagaatgt

SEQ ID NO: 25060 - DNA, 32 bp, Homo sapiens
  chr13:114807815-114807847
  hypo
ctctgttgaccgatgcacgtgaactcctaggg

SEQ ID NO: 25061 - DNA, 18 bp, Homo sapiens
  chr13:114812180-114812198
  hypo
gtccgagccctgccttca

SEQ ID NO: 25062 - DNA, 152 bp, Homo sapiens
  chr13:114855483-114855635
  hypo
atgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattattt

SEQ ID NO: 25063 - DNA, 50 bp, Homo sapiens
  chr13:114961773-114961823
  hypo
gaatccctggtgccacgaaagaccccagagcagcacaatctgagctcact

SEQ ID NO: 25064 - DNA, 18 bp, Homo sapiens
  chr14:21289138-21289156
  hypo
agcactttgagaggccga

SEQ ID NO: 25065 - DNA, 121 bp, Homo sapiens; identical to SEQ ID NO: 15807
  chr14:23707517-23707638
  hypo

SEQ ID NO: 25066 - DNA, 198 bp, Homo sapiens; identical to SEQ ID NO: 5150
  chr14:23776958-23777156
  hypo

SEQ ID NO: 25067 - DNA, 153 bp, Homo sapiens; identical to SEQ ID NO: 15809
  chr14:24862082-24862235
  hypo

SEQ ID NO: 25068 - DNA, 37 bp, Homo sapiens; identical to SEQ ID NO: 5151
  chr14:31027390-31027427
  hypo

SEQ ID NO: 25069 - DNA, 38 bp, Homo sapiens; identical to SEQ ID NO: 15811
  chr14:32597741-32597779
  hypo

SEQ ID NO: 25070 - DNA, 45 bp, Homo sapiens; identical to SEQ ID NO: 15812
  chr14:34921211-34921256
  hypo

SEQ ID NO: 25071 - DNA, 35 bp, Homo sapiens; identical to SEQ ID NO: 15814
  chr14:35507705-35507740
  hypo

SEQ ID NO: 25072 - DNA, 30 bp, Homo sapiens; identical to SEQ ID NO: 15815
  chr14:35866882-35866912
  hypo

SEQ ID NO: 25073 - DNA, 30 bp, Homo sapiens; identical to SEQ ID NO: 15816
  chr14:50098049-50098079
  hypo

SEQ ID NO: 25074 - DNA, 93 bp, Homo sapiens
  chr14:50333994-50334087
  hypo
ttgcttttttaacagtgcaaaaaacaaggccgtgtctggctatatggggctttgcttgttcaaaatgtaacctctatacggccgcgcgcagtg

SEQ ID NO: 25075 - DNA, 37 bp, Homo sapiens; identical to SEQ ID NO: 15819
  chr14:50433979-50434016
  hypo

SEQ ID NO: 25076 - DNA, 15 bp, Homo sapiens
  chr14:54956536-54956551
  hypo
cgctgggatcacagg

SEQ ID NO: 25077 - DNA, 30 bp, Homo sapiens; identical to SEQ ID NO: 15822
  chr14:55664068-55664098
  hypo

SEQ ID NO: 25078 - DNA, 30 bp, Homo sapiens; identical to SEQ ID NO: 15824
  chr14:57045757-57045787
  hypo

SEQ ID NO: 25079 - DNA, 23 bp, Homo sapiens
  chr14:58599589-58599612
  hypo
actgcgcccggccaacccttgtc

SEQ ID NO: 25080 - DNA, 24 bp, Homo sapiens
  chr14:58893204-58893228
  hypo
gagccaccgcgctcagactttaaa

SEQ ID NO: 25081 - DNA, 21 bp, Homo sapiens
  chr14:65233318-65233339
  hypo
ggggaggatggagggcggggc

SEQ ID NO: 25082 - DNA, 96 bp, Homo sapiens; identical to SEQ ID NO: 15828
  chr14:65239506-65239602
  hypo

SEQ ID NO: 25083 - DNA, 64 bp, Homo sapiens; identical to SEQ ID NO: 15829
  chr14:65406323-65406387
  hypo

SEQ ID NO: 25084 - DNA, 39 bp, Homo sapiens
  chr14:67886606-67886645
  hypo
cagtgggtctgcatctccccagagcgggtgcttttttct

SEQ ID NO: 25085 - DNA, 91 bp, Homo sapiens; identical to SEQ ID NO: 15831
  chr14:68067690-68067781
  hypo

SEQ ID NO: 25086 - DNA, 30 bp, Homo sapiens; identical to SEQ ID NO: 15833
  chr14:72892242-72892272
  hypo

SEQ ID NO: 25087 - DNA, 74 bp, Homo sapiens; identical to SEQ ID NO: 15834
  chr14:73140612-73140686
  hypo

SEQ ID NO: 25088 - DNA, 50 bp, Homo sapiens; identical to SEQ ID NO: 15835
  chr14:73147450-73147500
  hypo

SEQ ID NO: 25089 - DNA, 30 bp, Homo sapiens; identical to SEQ ID NO: 15837
  chr14:73172944-73172974
  hypo

SEQ ID NO: 25090 - DNA, 24 bp, Homo sapiens
  chr14:73178865-73178889
  hypo
aaagcctgccgtcaggcctcccag

SEQ ID NO: 25091 - DNA, 18 bp, Homo sapiens
  chr14:73180190-73180208
  hypo
acccagagggagacccgt

SEQ ID NO: 25092 - DNA, 166 bp, Homo sapiens; identical to SEQ ID NO: 15840
  chr14:73195193-73195359
  hypo

SEQ ID NO: 25093 - DNA, 34 bp, Homo sapiens; identical to SEQ ID NO: 15841
  chr14:73195668-73195702
  hypo

SEQ ID NO: 25094 - DNA, 174 bp, Homo sapiens; identical to SEQ ID NO: 15842
  chr14:73209874-73210048
  hypo

SEQ ID NO: 25095 - DNA, 23 bp, Homo sapiens
  chr14:73226884-73226907
  hypo
aaatacaatgatggccgggcgcg

SEQ ID NO: 25096 - DNA, 30 bp, Homo sapiens; identical to SEQ ID NO: 15844
  chr14:73275087-73275117
  hypo

SEQ ID NO: 25097 - DNA, 32 bp, Homo sapiens; identical to SEQ ID NO: 15845
  chr14:73313912-73313944
  hypo

SEQ ID NO: 25098 - DNA, 18 bp, Homo sapiens
  chr14:73318453-73318471
  hypo
tacaaaatgtccactcga

SEQ ID NO: 25099 - DNA, 30 bp, Homo sapiens; identical to SEQ ID NO: 15848
  chr14:73958845-73958875
  hypo

SEQ ID NO: 25100 - DNA, 30 bp, Homo sapiens; identical to SEQ ID NO: 15849
  chr14:73959199-73959229
  hypo

SEQ ID NO: 25101 - DNA, 30 bp, Homo sapiens; identical to SEQ ID NO: 15850
  chr14:75389373-75389403
  hypo

SEQ ID NO: 25102 - DNA, 30 bp, Homo sapiens; identical to SEQ ID NO: 15851
  chr14:78247790-78247820
  hypo

SEQ ID NO: 25103 - DNA, 30 bp, Homo sapiens; identical to SEQ ID NO: 15852
  chr14:90983280-90983310
  hypo

SEQ ID NO: 25104 - DNA, 30 bp, Homo sapiens; identical to SEQ ID NO: 15853
  chr14:91849705-91849735
  hypo

SEQ ID NO: 25105 - DNA, 124 bp, Homo sapiens
  chr14:93154937-93155061
  hypo
cacccaccccatcctcggtctttgcaaagaagggcccgagcttagtttccccaggactggcctaggaaggagcaccggccacagctgctccccgtgccactcagggtggacccagcatctcagg

SEQ ID NO: 25106 - DNA, 37 bp, Homo sapiens; identical to SEQ ID NO: 15855
  chr14:93697020-93697057
  hypo

SEQ ID NO: 25107 - DNA, 18 bp, Homo sapiens
  chr14:96967299-96967317
  hypo
gcccggcttacattttct

SEQ ID NO: 25108 - DNA, 30 bp, Homo sapiens; identical to SEQ ID NO: 15857
  chr14:97188235-97188265
  hypo

SEQ ID NO: 25109 - DNA, 18 bp, Homo sapiens
  chr14:97262855-97262873
  hypo
taaacacaatgcggccgg

SEQ ID NO: 25110 - DNA, 144 bp, Homo sapiens; identical to SEQ ID NO: 15859
  chr14:99849909-99850053
  hypo

SEQ ID NO: 25111 - DNA, 30 bp, Homo sapiens; identical to SEQ ID NO: 15860
  chr14:100611919-100611949
  hypo

SEQ ID NO: 25112 - DNA, 79 bp, Homo sapiens; identical to SEQ ID NO: 15862
  chr14:100644399-100644478
  hypo

SEQ ID NO: 25113 - DNA, 30 bp, Homo sapiens; identical to SEQ ID NO: 15863
  chr14:101200688-101200718
  hypo

SEQ ID NO: 25114 - DNA, 22 bp, Homo sapiens
  chr14:101250272-101250294
  hypo
ggtgcaccggggctttgttcag

SEQ ID NO: 25115 - DNA, 51 bp, Homo sapiens; identical to SEQ ID NO: 15865
  chr14:102335848-102335899
  hypo

SEQ ID NO: 25116 - DNA, 67 bp, Homo sapiens
  chr14:102418540-102418607
  hypo
tcgcatgagccaccacgcccagtgtattcagattttcttcgtgtttcttttctcttccgggatccca

SEQ ID NO: 25117 - DNA, 41 bp, Homo sapiens
  chr14:102418637-102418678
  hypo
accacggtttttttgtttgtttgtttttttccgagacggag

SEQ ID NO: 25118 - DNA, 21 bp, Homo sapiens
  chr14:102530479-102530500
  hypo
gctccttctccccagcgtggt

SEQ ID NO: 25119 - DNA, 101 bp, Homo sapiens; identical to SEQ ID NO: 15868
  chr14:103007139-103007240
  hypo

SEQ ID NO: 25120 - DNA, 89 bp, Homo sapiens; identical to SEQ ID NO: 15869
  chr14:103820833-103820922
  hypo

SEQ ID NO: 25121 - DNA, 30 bp, Homo sapiens; identical to SEQ ID NO: 15870
  chr14:103996414-103996444
  hypo

SEQ ID NO: 25122 - DNA, 30 bp, Homo sapiens; identical to SEQ ID NO: 15871
  chr14:104061854-104061884
  hypo

SEQ ID NO: 25123 - DNA, 30 bp, Homo sapiens; identical to SEQ ID NO: 15872
  chr14:104202811-104202841
  hypo

SEQ ID NO: 25124 - DNA, 22 bp, Homo sapiens
  chr14:104355166-104355188
  hypo
tttttttttccatgacggagtc

SEQ ID NO: 25125 - DNA, 414 bp, Homo sapiens; identical to SEQ ID NO: 15874
  chr14:104617714-104618128
  hypo

SEQ ID NO: 25126 - DNA, 41 bp, Homo sapiens
  chr14:104620554-104620595
  hypo
caaggcaaacactgatctggggccagcgggtgggacggggg

SEQ ID NO: 25127 - DNA, 34 bp, Homo sapiens; identical to SEQ ID NO: 15876
  chr14:104628653-104628687
  hypo

SEQ ID NO: 25128 - DNA, 64 bp, Homo sapiens; identical to SEQ ID NO: 15877
  chr14:104630091-104630155
  hypo

SEQ ID NO: 25129 - DNA, 16 bp, Homo sapiens
  chr14:104631077-104631093
  hypo
gcgtgtctgtgtgtgt

SEQ ID NO: 25130 - DNA, 617 bp, Homo sapiens; identical to SEQ ID NO: 15879
  chr14:104639155-104639772
  hypo

SEQ ID NO: 25131 - DNA, 30 bp, Homo sapiens; identical to SEQ ID NO: 15880
  chr14:104641364-104641394
  hypo

SEQ ID NO: 25132 - DNA, 74 bp, Homo sapiens; identical to SEQ ID NO: 15881
  chr14:104641701-104641775
  hypo

SEQ ID NO: 25133 - DNA, 88 bp, Homo sapiens; identical to SEQ ID NO: 15883
  chr14:104645975-104646063
  hypo

SEQ ID NO: 25134 - DNA, 49 bp, Homo sapiens; identical to SEQ ID NO: 15884
  chr14:104647208-104647257
  hypo

SEQ ID NO: 25135 - DNA, 38 bp, Homo sapiens; identical to SEQ ID NO: 15885
  chr14:104897616-104897654
  hypo

SEQ ID NO: 25136 - DNA, 112 bp, Homo sapiens; identical to SEQ ID NO: 15886
  chr14:105196425-105196537
  hypo

SEQ ID NO: 25137 - DNA, 26 bp, Homo sapiens
  chr14:105714232-105714258
  hypo
ggattagccccaggccgggaggctag

SEQ ID NO: 25138 - DNA, 62 bp, Homo sapiens; identical to SEQ ID NO: 22002
  chr14:105714334-105714396
  hypo

SEQ ID NO: 25139 - DNA, 21 bp, Homo sapiens
  chr15:20499486-20499507
  hypo
gagcgcgctgactcacgcctg

SEQ ID NO: 25140 - DNA, 30 bp, Homo sapiens; identical to SEQ ID NO: 15890
  chr15:22515506-22515536
  hypo

SEQ ID NO: 25141 - DNA, 255 bp, Homo sapiens; identical to SEQ ID NO: 15891
  chr15:29133539-29133794
  hypo

SEQ ID NO: 25142 - DNA, 30 bp, Homo sapiens; identical to SEQ ID NO: 15892
  chr15:29449033-29449063
  hypo

SEQ ID NO: 25143 - DNA, 43 bp, Homo sapiens; identical to SEQ ID NO: 15893
  chr15:33632093-33632136
  hypo

SEQ ID NO: 25144 - DNA, 30 bp, Homo sapiens; identical to SEQ ID NO: 15894
  chr15:40228636-40228666
  hypo

SEQ ID NO: 25145 - DNA, 40 bp, Homo sapiens; identical to SEQ ID NO: 15896
  chr15:42684673-42684713
  hypo

SEQ ID NO: 25146 - DNA, 30 bp, Homo sapiens; identical to SEQ ID NO: 15897
  chr15:43020330-43020360
  hypo

SEQ ID NO: 25147 - DNA, 30 bp, Homo sapiens; identical to SEQ ID NO: 15898
  chr15:44037474-44037504
  hypo

SEQ ID NO: 25148 - DNA, 20 bp, Homo sapiens
  chr15:52967815-52967835
  hypo
tagtgttaggccgggcgcgg

SEQ ID NO: 25149 - DNA, 145 bp, Homo sapiens; identical to SEQ ID NO: 15900
  chr15:53976280-53976425
  hypo

SEQ ID NO: 25150 - DNA, 9 bp, Homo sapiens
  chr15:55699080-55699089
  hypo
ttttgactg

SEQ ID NO: 25151 - DNA, 6 bp, Homo sapiens
  chr15:55699164-55699170
  hypo
cactct

SEQ ID NO: 25152 - DNA, 40 bp, Homo sapiens; identical to SEQ ID NO: 15903
  chr15:62367703-62367743
  hypo

SEQ ID NO: 25153 - DNA, 45 bp, Homo sapiens; identical to SEQ ID NO: 15904
  chr15:65043594-65043639
  hypo

SEQ ID NO: 25154 - DNA, 30 bp, Homo sapiens; identical to SEQ ID NO: 15905
  chr15:65622974-65623004
  hypo

SEQ ID NO: 25155 - DNA, 70 bp, Homo sapiens
  chr15:66649845-66649915
  hypo
cccagaagttgaaggcggcagtgactaggatcgcactgctggcgatccagctggagatccagtctgggtg

SEQ ID NO: 25156 - DNA, 81 bp, Homo sapiens; identical to SEQ ID NO: 15907
  chr15:67545405-67545486
  hypo

SEQ ID NO: 25157 - DNA, 30 bp, Homo sapiens; identical to SEQ ID NO: 15908
  chr15:70075720-70075750
  hypo

SEQ ID NO: 25158 - DNA, 176 bp, Homo sapiens; identical to SEQ ID NO: 15909
  chr15:72102772-72102948
  hypo

SEQ ID NO: 25159 - DNA, 133 bp, Homo sapiens
  chr15:72412176-72412309
  hypo
aactggtctgggaaatgggagaaggagccactcttgcctttctcttcagcactgttcattcctcagtgtttatcaggtccaaattagttacttgtctctttgctctcccgttcccttccgtccaggattggtc

SEQ ID NO: 25160 - DNA, 187 bp, Homo sapiens; identical to SEQ ID NO: 15911
  chr15:72581494-72581681
  hypo

SEQ ID NO: 25161 - DNA, 39 bp, Homo sapiens; identical to SEQ ID NO: 15912
  chr15:76197482-76197521
  hypo

SEQ ID NO: 25162 - DNA, 30 bp, Homo sapiens; identical to SEQ ID NO: 15913
  chr15:76510088-76510118
  hypo

SEQ ID NO: 25163 - DNA, 30 bp, Homo sapiens; identical to SEQ ID NO: 15914
  chr15:77906968-77906998
  hypo

SEQ ID NO: 25164 - DNA, 139 bp, Homo sapiens; identical to SEQ ID NO: 15917
  chr15:78609750-78609889
  hypo

SEQ ID NO: 25165 - DNA, 95 bp, Homo sapiens; identical to SEQ ID NO: 15918
  chr15:83655934-83656029
  hypo

SEQ ID NO: 25166 - DNA, 30 bp, Homo sapiens; identical to SEQ ID NO: 15919
  chr15:90630578-90630608
  hypo

SEQ ID NO: 25167 - DNA, 20 bp, Homo sapiens
  chr15:90703242-90703262
  hypo
ttgtttgtttttttgcgggg

SEQ ID NO: 25168 - DNA, 104 bp, Homo sapiens; identical to SEQ ID NO: 15921
  chr15:90844295-90844399
  hypo

SEQ ID NO: 25169 - DNA, 116 bp, Homo sapiens; identical to SEQ ID NO: 15922
  chr15:91189343-91189459
  hypo

SEQ ID NO: 25170 - DNA, 30 bp, Homo sapiens; identical to SEQ ID NO: 15923
  chr15:91313685-91313715
  hypo

SEQ ID NO: 25171 - DNA, 30 bp, Homo sapiens; identical to SEQ ID NO: 15924
  chr15:91409404-91409434
  hypo

SEQ ID NO: 25172 - DNA, 39 bp, Homo sapiens; identical to SEQ ID NO: 15925
  chr15:93364629-93364668
  hypo

SEQ ID NO: 25173 - DNA, 30 bp, Homo sapiens; identical to SEQ ID NO: 15926
  chr15:93609848-93609878
  hypo

SEQ ID NO: 25174 - DNA, 24 bp, Homo sapiens
  chr15:94478454-94478478
  hypo
aaagaaggaggaggccgggcgccg

SEQ ID NO: 25175 - DNA, 13 bp, Homo sapiens
  chr15:97006359-97006372
  hypo
tgtgacatccgtg

SEQ ID NO: 25176 - DNA, 31 bp, Homo sapiens; identical to SEQ ID NO: 15930
  chr15:98454964-98454995
  hypo

SEQ ID NO: 25177 - DNA, 20 bp, Homo sapiens
  chr15:99295597-99295617
  hypo
tagagtgtttattaacgaaa

SEQ ID NO: 25178 - DNA, 30 bp, Homo sapiens; identical to SEQ ID NO: 15932
  chr15:99460238-99460268
  hypo

SEQ ID NO: 25179 - DNA, 132 bp, Homo sapiens; identical to SEQ ID NO: 15933
  chr15:99484456-99484588
  hypo

SEQ ID NO: 25180 - DNA, 246 bp, Homo sapiens; identical to SEQ ID NO: 15934
  chr15:102043043-102043289
  hypo

SEQ ID NO: 25181 - DNA, 23 bp, Homo sapiens
  chr16:142626-142649
  hypo
ttctgacaaggagaccggcaagg

SEQ ID NO: 25182 - DNA, 30 bp, Homo sapiens; identical to SEQ ID NO: 15936
  chr16:189535-189565
  hypo

SEQ ID NO: 25183 - DNA, 22 bp, Homo sapiens
  chr16:319924-319946
  hypo
aaacaaggtaggccacgcatgg

SEQ ID NO: 25184 - DNA, 30 bp, Homo sapiens; identical to SEQ ID NO: 15938
  chr16:337748-337778
  hypo

SEQ ID NO: 25185 - DNA, 119 bp, Homo sapiens
  chr16:410258-410377
  hypo
taggaaccctgaggccgcggccaagttctgagcgtgtgactgtgtgtgctgggccccaggcccctttgtcgccgcggcgtctgtcgtggcaaacaaaagtgaaccggattagccacagt

SEQ ID NO: 25186 - DNA, 39 bp, Homo sapiens
  chr16:410407-410446
  hypo
ctaataacctaacaatcgtgtcaacgggagctttgaacc

SEQ ID NO: 25187 - DNA, 419 bp, Homo sapiens; identical to SEQ ID NO: 15940
  chr16:411085-411504
  hypo

SEQ ID NO: 25188 - DNA, 30 bp, Homo sapiens; identical to SEQ ID NO: 15941
  chr16:612290-612320
  hypo

SEQ ID NO: 25189 - DNA, 30 bp, Homo sapiens; identical to SEQ ID NO: 15943
  chr16:613572-613602
  hypo

SEQ ID NO: 25190 - DNA, 411 bp, Homo sapiens; identical to SEQ ID NO: 15944
  chr16:614790-615201
  hypo

SEQ ID NO: 25191 - DNA, 63 bp, Homo sapiens
  chr16:667484-667547
  hypo
cggaaaacctgattccgtggtggctgtgagccccttccctccccttctgtcggcttcacctta

SEQ ID NO: 25192 - DNA, 30 bp, Homo sapiens; identical to SEQ ID NO: 15946
  chr16:677879-677909
  hypo

SEQ ID NO: 25193 - DNA, 42 bp, Homo sapiens; identical to SEQ ID NO: 15947
  chr16:700572-700614
  hypo

SEQ ID NO: 25194 - DNA, 22 bp, Homo sapiens
  chr16:726990-727012
  hypo
cggggcccgcctcaacaagtgg

SEQ ID NO: 25195 - DNA, 76 bp, Homo sapiens
  chr16:731412-731488
  hypo
gtgacgtgaagcccccgttccccagcttacagcctggccaaggagcagcggctgaacttcggggacgacatcccca

SEQ ID NO: 25196 - DNA, 275 bp, Homo sapiens
  chr16:734930-735205
  hypo
cagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcagga

SEQ ID NO: 25197 - DNA, 84 bp, Homo sapiens
  chr16:735594-735678
  hypo
cggctggaaggcagggaccagcggaggctctgagtctgtcctccatccgcctctgaaccccaccctgcccggacccccactcac

SEQ ID NO: 25198 - DNA, 30 bp, Homo sapiens; identical to SEQ ID NO: 15951
  chr16:735921-735951
  hypo

SEQ ID NO: 25199 - DNA, 30 bp, Homo sapiens; identical to SEQ ID NO: 15953
  chr16:809500-809530
  hypo

SEQ ID NO: 25200 - DNA, 180 bp, Homo sapiens; identical to SEQ ID NO: 15954
  chr16:809840-810020
  hypo

SEQ ID NO: 25201 - DNA, 273 bp, Homo sapiens; identical to SEQ ID NO: 15955
  chr16:824939-825212
  hypo

SEQ ID NO: 25202 - DNA, 53 bp, Homo sapiens
  chr16:837308-837361
  hypo
aatcctgagtccccacgccccaccccaggactgaccaggtcttaccaatgcca

SEQ ID NO: 25203 - DNA, 78 bp, Homo sapiens
  chr16:837460-837538
  hypo
ccagctggtggcagaacctggagtgggacagagtccagagtctgagccactttcctccacagacgccaccgtggggct

SEQ ID NO: 25204 - DNA, 175 bp, Homo sapiens
  chr16:845985-846160
  hypo
ctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccagga

SEQ ID NO: 25205 - DNA, 66 bp, Homo sapiens; identical to SEQ ID NO: 15958
  chr16:846426-846492
  hypo

SEQ ID NO: 25206 - DNA, 53 bp, Homo sapiens; identical to SEQ ID NO: 15959
  chr16:858748-858801
  hypo

SEQ ID NO: 25207 - DNA, 30 bp, Homo sapiens; identical to SEQ ID NO: 15960
  chr16:882403-882433
  hypo

SEQ ID NO: 25208 - DNA, 65 bp, Homo sapiens; identical to SEQ ID NO: 15961
  chr16:888904-888969
  hypo

SEQ ID NO: 25209 - DNA, 80 bp, Homo sapiens; identical to SEQ ID NO: 15962
  chr16:924620-924700
  hypo

SEQ ID NO: 25210 - DNA, 22 bp, Homo sapiens
  chr16:943459-943481
  hypo
ggatgagcccaaagtcggaggg

SEQ ID NO: 25211 - DNA, 34 bp, Homo sapiens
  chr16:943553-943587
  hypo
tctcccacacactgcagctcgcctgctgtgagga

SEQ ID NO: 25212 - DNA, 63 bp, Homo sapiens; identical to SEQ ID NO: 15964
  chr16:963320-963383
  hypo

SEQ ID NO: 25213 - DNA, 30 bp, Homo sapiens; identical to SEQ ID NO: 15965
  chr16:981776-981806
  hypo

SEQ ID NO: 25214 - DNA, 94 bp, Homo sapiens
  chr16:1052493-1052587
  hypo
cccgatgtccctccccgggtgaaggaacccacggacgtggctcatccataccgcggaacgtgagccatgaaaaggggcagcctcggctcagcca

SEQ ID NO: 25215 - DNA, 30 bp, Homo sapiens; identical to SEQ ID NO: 15967
  chr16:1077608-1077638
  hypo

SEQ ID NO: 25216 - DNA, 217 bp, Homo sapiens; identical to SEQ ID NO: 15968
  chr16:1081773-1081990
  hypo

SEQ ID NO: 25217 - DNA, 27 bp, Homo sapiens
  chr16:1128984-1129011
  hypo
ggcggtgctggtgcccgtgctgtacct

SEQ ID NO: 25218 - DNA, 30 bp, Homo sapiens; identical to SEQ ID NO: 15970
  chr16:1166711-1166741
  hypo

SEQ ID NO: 25219 - DNA, 30 bp, Homo sapiens; identical to SEQ ID NO: 15971
  chr16:1171222-1171252
  hypo

SEQ ID NO: 25220 - DNA, 118 bp, Homo sapiens; identical to SEQ ID NO: 15972
  chr16:1173263-1173381
  hypo

SEQ ID NO: 25221 - DNA, 95 bp, Homo sapiens; identical to SEQ ID NO: 15973
  chr16:1195687-1195782
  hypo

SEQ ID NO: 25222 - DNA, 24 bp, Homo sapiens
  chr16:1228780-1228804
  hypo
ccaagctccagaagtcggggttgg

SEQ ID NO: 25223 - DNA, 15 bp, Homo sapiens
  chr16:1228916-1228931
  hypo
cggaggaccagatgg

SEQ ID NO: 25224 - DNA, 55 bp, Homo sapiens
  chr16:1230142-1230197
  hypo
gtgccctggctgggtccctgtccctgcacaccgggtcagccggctcctgggtgca

SEQ ID NO: 25225 - DNA, 54 bp, Homo sapiens; identical to SEQ ID NO: 15977
  chr16:1236842-1236896
  hypo

SEQ ID NO: 25226 - DNA, 77 bp, Homo sapiens; identical to SEQ ID NO: 15978
  chr16:1251702-1251779
  hypo

SEQ ID NO: 25227 - DNA, 91 bp, Homo sapiens; identical to SEQ ID NO: 15979
  chr16:1268128-1268219
  hypo

SEQ ID NO: 25228 - DNA, 50 bp, Homo sapiens
  chr16:1312476-1312526
  hypo
ccagcactggtccttcggggtgagctccagcgagaccggggagagcttga

SEQ ID NO: 25229 - DNA, 15 bp, Homo sapiens
  chr16:1324061-1324076
  hypo
cggcagcatatctgc

SEQ ID NO: 25230 - DNA, 144 bp, Homo sapiens; identical to SEQ ID NO: 15982
  chr16:1391751-1391895
  hypo

SEQ ID NO: 25231 - DNA, 62 bp, Homo sapiens; identical to SEQ ID NO: 15983
  chr16:1397548-1397610
  hypo

SEQ ID NO: 25232 - DNA, 190 bp, Homo sapiens; identical to SEQ ID NO: 15985
  chr16:1417148-1417338
  hypo

SEQ ID NO: 25233 - DNA, 243 bp, Homo sapiens; identical to SEQ ID NO: 15986
  chr16:1417675-1417918
  hypo

SEQ ID NO: 25234 - DNA, 30 bp, Homo sapiens; identical to SEQ ID NO: 15987
  chr16:1425654-1425684
  hypo

SEQ ID NO: 25235 - DNA, 43 bp, Homo sapiens; identical to SEQ ID NO: 15988
  chr16:1428212-1428255
  hypo

SEQ ID NO: 25236 - DNA, 30 bp, Homo sapiens; identical to SEQ ID NO: 15990
  chr16:1428877-1428907
  hypo

SEQ ID NO: 25237 - DNA, 30 bp, Homo sapiens; identical to SEQ ID NO: 15991
  chr16:1486627-1486657
  hypo

SEQ ID NO: 25238 - DNA, 37 bp, Homo sapiens; identical to SEQ ID NO: 15992
  chr16:1491115-1491152
  hypo

SEQ ID NO: 25239 - DNA, 77 bp, Homo sapiens; identical to SEQ ID NO: 15993
  chr16:1493574-1493651
  hypo

SEQ ID NO: 25240 - DNA, 36 bp, Homo sapiens
  chr16:1730597-1730633
  hypo
acatttagttttgctgtgaagcgagtcaggtggtgg

SEQ ID NO: 25241 - DNA, 92 bp, Homo sapiens
  chr16:1741761-1741853
  hypo
gtctccaaagcactgcgggggtggggtggggtggggtccggtggacgtctggttgctcagtgttctgtgatcgtttctgcagggggtaaagg

SEQ ID NO: 25242 - DNA, 120 bp, Homo sapiens; identical to SEQ ID NO: 15996
  chr16:1813598-1813718
  hypo

SEQ ID NO: 25243 - DNA, 30 bp, Homo sapiens; identical to SEQ ID NO: 15997
  chr16:2028658-2028688
  hypo

SEQ ID NO: 25244 - DNA, 49 bp, Homo sapiens
  chr16:2029023-2029072
  hypo
ggtccatcccctcatcgggatcctcgcgctcactgctccgtcgtggggt

SEQ ID NO: 25245 - DNA, 33 bp, Homo sapiens
  chr16:2029137-2029170
  hypo
cgtgtgacggtgcagcagcggctctggatggcg

SEQ ID NO: 25246 - DNA, 30 bp, Homo sapiens; identical to SEQ ID NO: 15999
  chr16:2213693-2213723
  hypo

SEQ ID NO: 25247 - DNA, 84 bp, Homo sapiens; identical to SEQ ID NO: 16001
  chr16:2233062-2233146
  hypo

SEQ ID NO: 25248 - DNA, 42 bp, Homo sapiens
  chr16:2234684-2234726
  hypo
ccaggccaggcaggccgtgtaagcacccatcagcccatcggc

SEQ ID NO: 25249 - DNA, 367 bp, Homo sapiens; identical to SEQ ID NO: 16003
  chr16:2278403-2278770
  hypo

SEQ ID NO: 25250 - DNA, 34 bp, Homo sapiens; identical to SEQ ID NO: 16004
  chr16:2466336-2466370
  hypo

SEQ ID NO: 25251 - DNA, 30 bp, Homo sapiens; identical to SEQ ID NO: 16005
  chr16:2531804-2531834
  hypo

SEQ ID NO: 25252 - DNA, 37 bp, Homo sapiens; identical to SEQ ID NO: 16006
  chr16:2540828-2540865
  hypo

SEQ ID NO: 25253 - DNA, 18 bp, Homo sapiens
  chr16:2589100-2589118
  hypo
atggagtctccctctcga

SEQ ID NO: 25254 - DNA, 74 bp, Homo sapiens; identical to SEQ ID NO: 16008
  chr16:2764635-2764709
  hypo

SEQ ID NO: 25255 - DNA, 30 bp, Homo sapiens; identical to SEQ ID NO: 16011
  chr16:2877506-2877536
  hypo

SEQ ID NO: 25256 - DNA, 2 bp, Homo sapiens
  chr16:3211706-3211708
  hypo
aa

SEQ ID NO: 25257 - DNA, 65 bp, Homo sapiens
  chr16:3492675-3492740
  hypo
aaaaaaaaaaaaaaagaacttttaaaagtagccagacactgtggtatgcgcgcctctcagatact

SEQ ID NO: 25258 - DNA, 37 bp, Homo sapiens; identical to SEQ ID NO: 16016
  chr16:3957870-3957907
  hypo

SEQ ID NO: 25259 - DNA, 30 bp, Homo sapiens; identical to SEQ ID NO: 16017
  chr16:4410956-4410986
  hypo

SEQ ID NO: 25260 - DNA, 30 bp, Homo sapiens; identical to SEQ ID NO: 16018
  chr16:4840446-4840476
  hypo

SEQ ID NO: 25261 - DNA, 30 bp, Homo sapiens; identical to SEQ ID NO: 16020
  chr16:5439313-5439343
  hypo

SEQ ID NO: 25262 - DNA, 14 bp, Homo sapiens
  chr16:8781018-8781032
  hypo
acggaaagtgtttg

SEQ ID NO: 25263 - DNA, 76 bp, Homo sapiens; identical to SEQ ID NO: 16023
  chr16:9005728-9005804
  hypo

SEQ ID NO: 25264 - DNA, 30 bp, Homo sapiens; identical to SEQ ID NO: 16024
  chr16:9010029-9010059
  hypo

SEQ ID NO: 25265 - DNA, 30 bp, Homo sapiens; identical to SEQ ID NO: 16025
  chr16:10804588-10804618
  hypo

SEQ ID NO: 25266 - DNA, 71 bp, Homo sapiens
  chr16:14725771-14725842
  hypo
tgaactgggaagcagcgtattaataaatctgtataaataactgtttaatgggggcctggcgccatgactca

SEQ ID NO: 25267 - DNA, 30 bp, Homo sapiens; identical to SEQ ID NO: 16027
  chr16:15762701-15762731
  hypo

SEQ ID NO: 25268 - DNA, 28 bp, Homo sapiens
  chr16:15820865-15820893
  hypo
tctctttctccagcgtctgcttattctt

SEQ ID NO: 25269 - DNA, 30 bp, Homo sapiens; identical to SEQ ID NO: 16031
  chr16:19534836-19534866
  hypo

SEQ ID NO: 25270 - DNA, 30 bp, Homo sapiens; identical to SEQ ID NO: 16032
  chr16:23303315-23303345
  hypo

SEQ ID NO: 25271 - DNA, 42 bp, Homo sapiens; identical to SEQ ID NO: 16034
  chr16:28560194-28560236
  hypo

SEQ ID NO: 25272 - DNA, 78 bp, Homo sapiens; identical to SEQ ID NO: 16035
  chr16:28878714-28878792
  hypo

SEQ ID NO: 25273 - DNA, 34 bp, Homo sapiens; identical to SEQ ID NO: 16036
  chr16:29139111-29139145
  hypo

SEQ ID NO: 25274 - DNA, 55 bp, Homo sapiens; identical to SEQ ID NO: 16037
  chr16:29153203-29153258
  hypo

SEQ ID NO: 25275 - DNA, 45 bp, Homo sapiens
  chr16:29831078-29831123
  hypo
ccactgctcctgcctctagggtgcagtgtccgtacctgctggagc

SEQ ID NO: 25276 - DNA, 40 bp, Homo sapiens
  chr16:30017290-30017330
  hypo
atttgcagggactagcgagtcaggcaggaggtttgcatat

SEQ ID NO: 25277 - DNA, 180 bp, Homo sapiens
  chr16:30017447-30017627
  hypo
tgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgg

SEQ ID NO: 25278 - DNA, 124 bp, Homo sapiens
  chr16:30124567-30124691
  hypo
tcttggtccctgccccgtttctagcatgcccccttggacctacccctctgtgctgtccactttggcacctgttctcacccctacccggctcacctcctcggtgggcccccaggcggatgcggaa

SEQ ID NO: 25279 - DNA, 123 bp, Homo sapiens
  chr16:30907148-30907271
  hypo
acgcagacacacgcaagcgcacacacacacgggcctcctcgtcttcattcacaaaccccattagcttctgttgtctatgggcttcctcgacagaccgcgagcccctcgcgggggccagaaacc

SEQ ID NO: 25280 - DNA, 120 bp, Homo sapiens; identical to SEQ ID NO: 16045
  chr16:31138607-31138727
  hypo

SEQ ID NO: 25281 - DNA, 105 bp, Homo sapiens; identical to SEQ ID NO: 16048
  chr16:33893476-33893581
  hypo

SEQ ID NO: 25282 - DNA, 19 bp, Homo sapiens
  chr16:46721707-46721726
  hypo
taagcgagctgcctaaatt

SEQ ID NO: 25283 - DNA, 91 bp, Homo sapiens; identical to SEQ ID NO: 16050
  chr16:48642042-48642133
  hypo

SEQ ID NO: 25284 - DNA, 34 bp, Homo sapiens; identical to SEQ ID NO: 16051
  chr16:53448517-53448551
  hypo

SEQ ID NO: 25285 - DNA, 30 bp, Homo sapiens; identical to SEQ ID NO: 16053
  chr16:55203930-55203960
  hypo

SEQ ID NO: 25286 - DNA, 30 bp, Homo sapiens; identical to SEQ ID NO: 16054
  chr16:57222226-57222256
  hypo

SEQ ID NO: 25287 - DNA, 30 bp, Homo sapiens; identical to SEQ ID NO: 16055
  chr16:57759922-57759952
  hypo

SEQ ID NO: 25288 - DNA, 38 bp, Homo sapiens; identical to SEQ ID NO: 16056
  chr16:59046529-59046567
  hypo

SEQ ID NO: 25289 - DNA, 63 bp, Homo sapiens
  chr16:67313895-67313958
  hypo
gacccagccctctcccgctggccccgagcaggcccacctttaggagggcgtgatggaaaggcc

SEQ ID NO: 25290 - DNA, 39 bp, Homo sapiens; identical to SEQ ID NO: 16058
  chr16:67578633-67578672
  hypo

SEQ ID NO: 25291 - DNA, 27 bp, Homo sapiens
  chr16:68770701-68770728
  hypo
aaaaaattagcctggcgtggtggtgtg

SEQ ID NO: 25292 - DNA, 29 bp, Homo sapiens
  chr16:71919039-71919068
  hypo
taagccactgtgcccggcctggttggacg

SEQ ID NO: 25293 - DNA, 84 bp, Homo sapiens; identical to SEQ ID NO: 16064
  chr16:72461607-72461691
  hypo

SEQ ID NO: 25294 - DNA, 19 bp, Homo sapiens
  chr16:72957744-72957763
  hypo
tactttgaattgcctcgtc

SEQ ID NO: 25295 - DNA, 19 bp, Homo sapiens
  chr16:75019669-75019688
  hypo
aaaccgaagatacctcttc

SEQ ID NO: 25296 - DNA, 209 bp, Homo sapiens; identical to SEQ ID NO: 16067
  chr16:75148827-75149036
  hypo

SEQ ID NO: 25297 - DNA, 37 bp, Homo sapiens; identical to SEQ ID NO: 16068
  chr16:75469082-75469119
  hypo

SEQ ID NO: 25298 - DNA, 30 bp, Homo sapiens; identical to SEQ ID NO: 16069
  chr16:80654771-80654801
  hypo

SEQ ID NO: 25299 - DNA, 30 bp, Homo sapiens; identical to SEQ ID NO: 16070
  chr16:81533258-81533288
  hypo

SEQ ID NO: 25300 - DNA, 180 bp, Homo sapiens; identical to SEQ ID NO: 16071
  chr16:81632932-81633112
  hypo

SEQ ID NO: 25301 - DNA, 30 bp, Homo sapiens; identical to SEQ ID NO: 16072
  chr16:83968795-83968825
  hypo

SEQ ID NO: 25302 - DNA, 41 bp, Homo sapiens; identical to SEQ ID NO: 16073
  chr16:84075186-84075227
  hypo

SEQ ID NO: 25303 - DNA, 58 bp, Homo sapiens; identical to SEQ ID NO: 16075
  chr16:85007798-85007856
  hypo

SEQ ID NO: 25304 - DNA, 173 bp, Homo sapiens; identical to SEQ ID NO: 16076
  chr16:85028164-85028337
  hypo

SEQ ID NO: 25305 - DNA, 55 bp, Homo sapiens; identical to SEQ ID NO: 16077
  chr16:85033827-85033882
  hypo

SEQ ID NO: 25306 - DNA, 16 bp, Homo sapiens
  chr16:85043890-85043906
  hypo
gcgctgggattacagg

SEQ ID NO: 25307 - DNA, 17 bp, Homo sapiens
  chr16:85075553-85075570
  hypo
tgcgcactcctgtccct

SEQ ID NO: 25308 - DNA, 101 bp, Homo sapiens; identical to SEQ ID NO: 16080
  chr16:85083589-85083690
  hypo

SEQ ID NO: 25309 - DNA, 197 bp, Homo sapiens; identical to SEQ ID NO: 16081
  chr16:85336384-85336581
  hypo

SEQ ID NO: 25310 - DNA, 68 bp, Homo sapiens; identical to SEQ ID NO: 16082
  chr16:85455150-85455218
  hypo

SEQ ID NO: 25311 - DNA, 32 bp, Homo sapiens; identical to SEQ ID NO: 16084
  chr16:85671134-85671166
  hypo

SEQ ID NO: 25312 - DNA, 34 bp, Homo sapiens; identical to SEQ ID NO: 16085
  chr16:85673852-85673886
  hypo

SEQ ID NO: 25313 - DNA, 110 bp, Homo sapiens; identical to SEQ ID NO: 16086
  chr16:85674157-85674267
  hypo

SEQ ID NO: 25314 - DNA, 71 bp, Homo sapiens
  chr16:85684237-85684308
  hypo
ccagcagtgtaccaccgcggcgcttaatggaacacggtgccgccagggaaggcgcggggccggcagctgga

SEQ ID NO: 25315 - DNA, 84 bp, Homo sapiens
  chr16:85684457-85684541
  hypo
gttgccgggccggaggcttctcggccccttctcggggtcacccctctctcccaggtgtagtgggagctgcgagaggagaaatga

SEQ ID NO: 25316 - DNA, 30 bp, Homo sapiens; identical to SEQ ID NO: 16088
  chr16:85721581-85721611
  hypo

SEQ ID NO: 25317 - DNA, 30 bp, Homo sapiens; identical to SEQ ID NO: 16089
  chr16:85731482-85731512
  hypo

SEQ ID NO: 25318 - DNA, 147 bp, Homo sapiens; identical to SEQ ID NO: 16090
  chr16:87296936-87297083
  hypo

SEQ ID NO: 25319 - DNA, 22 bp, Homo sapiens
  chr16:87421399-87421421
  hypo
gcctgggcgacagagagaaaaa

SEQ ID NO: 25320 - DNA, 102 bp, Homo sapiens; identical to SEQ ID NO: 16092
  chr16:87594957-87595059
  hypo

SEQ ID NO: 25321 - DNA, 90 bp, Homo sapiens; identical to SEQ ID NO: 16093
  chr16:87723156-87723246
  hypo

SEQ ID NO: 25322 - DNA, 87 bp, Homo sapiens
  chr16:87723648-87723735
  hypo
gggccgcaagcagcccgggaaccccaagccgcgggagcggcggacggagtcaccccccgtgttcacgtggacttcccaccaccgggc

SEQ ID NO: 25323 - DNA, 15 bp, Homo sapiens
  chr16:87724098-87724113
  hypo
cgaggagaatgggga

SEQ ID NO: 25324 - DNA, 30 bp, Homo sapiens; identical to SEQ ID NO: 16096
  chr16:88503235-88503265
  hypo

SEQ ID NO: 25325 - DNA, 41 bp, Homo sapiens
  chr16:88504017-88504058
  hypo
gctggcacacctgggcggggcgcacgggctgctggagcggc

SEQ ID NO: 25326 - DNA, 15 bp, Homo sapiens
  chr16:88506526-88506541
  hypo
cgcctatttgcaatg

SEQ ID NO: 25327 - DNA, 56 bp, Homo sapiens; identical to SEQ ID NO: 16099
  chr16:88508016-88508072
  hypo

SEQ ID NO: 25328 - DNA, 30 bp, Homo sapiens; identical to SEQ ID NO: 16100
  chr16:88551519-88551549
  hypo

SEQ ID NO: 25329 - DNA, 16 bp, Homo sapiens
  chr16:88603760-88603776
  hypo
tcgaagcttagggcag

SEQ ID NO: 25330 - DNA, 45 bp, Homo sapiens; identical to SEQ ID NO: 16103
  chr16:88624831-88624876
  hypo

SEQ ID NO: 25331 - DNA, 30 bp, Homo sapiens; identical to SEQ ID NO: 16104
  chr16:88683871-88683901
  hypo

SEQ ID NO: 25332 - DNA, 48 bp, Homo sapiens; identical to SEQ ID NO: 16105
  chr16:88757586-88757634
  hypo

SEQ ID NO: 25333 - DNA, 41 bp, Homo sapiens; identical to SEQ ID NO: 16106
  chr16:88832763-88832804
  hypo

SEQ ID NO: 25334 - DNA, 77 bp, Homo sapiens
  chr16:88883377-88883454
  hypo
tgctcggtgggctctgggcacccaggagcgacaccgcagacctgtgtgtggctcgtttttgccgactagagcgaggg

SEQ ID NO: 25335 - DNA, 30 bp, Homo sapiens; identical to SEQ ID NO: 16108
  chr16:88931261-88931291
  hypo

SEQ ID NO: 25336 - DNA, 30 bp, Homo sapiens; identical to SEQ ID NO: 16109
  chr16:88943136-88943166
  hypo

SEQ ID NO: 25337 - DNA, 213 bp, Homo sapiens
  chr16:88945602-88945815
  hypo
tcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacac

SEQ ID NO: 25338 - DNA, 84 bp, Homo sapiens
  chr16:88945995-88946079
  hypo
cacaaaggcacatgttgatggggctgtaggcagctgaacacacgtagcatctgtgcacacacagacacacgttgatggccctca

SEQ ID NO: 25339 - DNA, 138 bp, Homo sapiens; identical to SEQ ID NO: 16112
  chr16:88948551-88948689
  hypo

SEQ ID NO: 25340 - DNA, 186 bp, Homo sapiens; identical to SEQ ID NO: 16113
  chr16:88952219-88952405
  hypo

SEQ ID NO: 25341 - DNA, 30 bp, Homo sapiens; identical to SEQ ID NO: 16114
  chr16:88952665-88952695
  hypo

SEQ ID NO: 25342 - DNA, 41 bp, Homo sapiens
  chr16:88955208-88955249
  hypo
ccccgggtgggggcacgaggtgggctggccctgagctccag

SEQ ID NO: 25343 - DNA, 89 bp, Homo sapiens
  chr16:88957857-88957946
  hypo
gggtgctggctccaggagggacctgctgcatgtcctgggccctatccccgagccttgcccccacactggcacgtcgtcagtgctcaaaa

SEQ ID NO: 25344 - DNA, 39 bp, Homo sapiens
  chr16:88958358-88958397
  hypo
ctcgatcgtcaatgtcgagttctgcaggggagaaaaccc

SEQ ID NO: 25345 - DNA, 18 bp, Homo sapiens
  chr16:88958431-88958449
  hypo
cgccgacccacccatgcc

SEQ ID NO: 25346 - DNA, 63 bp, Homo sapiens
  chr16:88963214-88963277
  hypo
gccctcccttaggtgcgcttaccagccttgccccgggtgcctggtccttccggcggcctgctc

SEQ ID NO: 25347 - DNA, 30 bp, Homo sapiens; identical to SEQ ID NO: 16121
  chr16:88976653-88976683
  hypo

SEQ ID NO: 25348 - DNA, 57 bp, Homo sapiens; identical to SEQ ID NO: 16123
  chr16:88994398-88994455
  hypo

SEQ ID NO: 25349 - DNA, 19 bp, Homo sapiens
  chr16:89001075-89001094
  hypo
gaggcagagatgccacgaa

SEQ ID NO: 25350 - DNA, 38 bp, Homo sapiens; identical to SEQ ID NO: 16126
  chr16:89025782-89025820
  hypo

SEQ ID NO: 25351 - DNA, 30 bp, Homo sapiens; identical to SEQ ID NO: 16127
  chr16:89026022-89026052
  hypo

SEQ ID NO: 25352 - DNA, 256 bp, Homo sapiens; identical to SEQ ID NO: 16128
  chr16:89055673-89055929
  hypo

SEQ ID NO: 25353 - DNA, 52 bp, Homo sapiens
  chr16:89107732-89107784
  hypo
ccctacacctgcaatcccctgagggacgggaggaggccggtagtccatgagc

SEQ ID NO: 25354 - DNA, 30 bp, Homo sapiens; identical to SEQ ID NO: 16131
  chr16:89109506-89109536
  hypo

SEQ ID NO: 25355 - DNA, 17 bp, Homo sapiens
  chr16:89120319-89120336
  hypo
ggcgggcaggtgctgga

SEQ ID NO: 25356 - DNA, 115 bp, Homo sapiens; identical to SEQ ID NO: 16135
  chr16:89172217-89172332
  hypo

SEQ ID NO: 25357 - DNA, 30 bp, Homo sapiens; identical to SEQ ID NO: 16136
  chr16:89189873-89189903
  hypo

SEQ ID NO: 25358 - DNA, 14 bp, Homo sapiens
  chr16:89220641-89220655
  hypo
gtggggagcagcag

SEQ ID NO: 25359 - DNA, 104 bp, Homo sapiens
  chr16:89220922-89221026
  hypo
tgcagttgccaggctctccagggcaggtcccagaggtttcccacaaaaaacaaagactccactggaggaaacaagcccctgtcccacgccgtctgcacgtgcct

SEQ ID NO: 25360 - DNA, 30 bp, Homo sapiens; identical to SEQ ID NO: 16139
  chr16:89225881-89225911
  hypo

SEQ ID NO: 25361 - DNA, 34 bp, Homo sapiens; identical to SEQ ID NO: 16140
  chr16:89226363-89226397
  hypo

SEQ ID NO: 25362 - DNA, 126 bp, Homo sapiens; identical to SEQ ID NO: 16141
  chr16:89245316-89245442
  hypo

SEQ ID NO: 25363 - DNA, 35 bp, Homo sapiens; identical to SEQ ID NO: 16142
  chr16:89245710-89245745
  hypo

SEQ ID NO: 25364 - DNA, 20 bp, Homo sapiens
  chr16:89254633-89254653
  hypo
gggcagttcaccatccgcac

SEQ ID NO: 25365 - DNA, 24 bp, Homo sapiens
  chr16:89575654-89575678
  hypo
aggttgttgttttttcggttattt

SEQ ID NO: 25366 - DNA, 30 bp, Homo sapiens; identical to SEQ ID NO: 16146
  chr16:89576068-89576098
  hypo

SEQ ID NO: 25367 - DNA, 79 bp, Homo sapiens; identical to SEQ ID NO: 16147
  chr16:89655054-89655133
  hypo

SEQ ID NO: 25368 - DNA, 30 bp, Homo sapiens; identical to SEQ ID NO: 16148
  chr16:89668379-89668409
  hypo

SEQ ID NO: 25369 - DNA, 40 bp, Homo sapiens; identical to SEQ ID NO: 16149
  chr16:89702746-89702786
  hypo

SEQ ID NO: 25370 - DNA, 30 bp, Homo sapiens; identical to SEQ ID NO: 16150
  chr16:89704648-89704678
  hypo

SEQ ID NO: 25371 - DNA, 20 bp, Homo sapiens
  chr16:89883952-89883972
  hypo
ccaaacataagaattcgtaa

SEQ ID NO: 25372 - DNA, 165 bp, Homo sapiens; identical to SEQ ID NO: 16152
  chr16:89900625-89900790
  hypo

SEQ ID NO: 25373 - DNA, 40 bp, Homo sapiens; identical to SEQ ID NO: 16153
  chr16:90066907-90066947
  hypo

SEQ ID NO: 25374 - DNA, 133 bp, Homo sapiens; identical to SEQ ID NO: 16154
  chr16:90069191-90069324
  hypo

SEQ ID NO: 25375 - DNA, 32 bp, Homo sapiens; identical to SEQ ID NO: 5187
  chr17:1136665-1136697
  hypo

SEQ ID NO: 25376 - DNA, 18 bp, Homo sapiens
  chr17:1471448-1471466
  hypo
acccggccactctttcat

SEQ ID NO: 25377 - DNA, 8 bp, Homo sapiens
  chr17:1546442-1546450
  hypo
ctgtgtcc

SEQ ID NO: 25378 - DNA, 30 bp, Homo sapiens; identical to SEQ ID NO: 16160
  chr17:2298979-2299009
  hypo

SEQ ID NO: 25379 - DNA, 170 bp, Homo sapiens; identical to SEQ ID NO: 16162
  chr17:3741605-3741775
  hypo

SEQ ID NO: 25380 - DNA, 39 bp, Homo sapiens; identical to SEQ ID NO: 16163
  chr17:4236673-4236712
  hypo

SEQ ID NO: 25381 - DNA, 30 bp, Homo sapiens; identical to SEQ ID NO: 16164
  chr17:4976853-4976883
  hypo

SEQ ID NO: 25382 - DNA, 69 bp, Homo sapiens; identical to SEQ ID NO: 16165
  chr17:7466711-7466780
  hypo

SEQ ID NO: 25383 - DNA, 88 bp, Homo sapiens; identical to SEQ ID NO: 16166
  chr17:8104512-8104600
  hypo

SEQ ID NO: 25384 - DNA, 33 bp, Homo sapiens; identical to SEQ ID NO: 16167
  chr17:8384676-8384709
  hypo

SEQ ID NO: 25385 - DNA, 30 bp, Homo sapiens; identical to SEQ ID NO: 16168
  chr17:10212959-10212989
  hypo

SEQ ID NO: 25386 - DNA, 30 bp, Homo sapiens; identical to SEQ ID NO: 16169
  chr17:11572707-11572737
  hypo

SEQ ID NO: 25387 - DNA, 30 bp, Homo sapiens; identical to SEQ ID NO: 16170
  chr17:11637568-11637598
  hypo

SEQ ID NO: 25388 - DNA, 30 bp, Homo sapiens; identical to SEQ ID NO: 16171
  chr17:16282207-16282237
  hypo

SEQ ID NO: 25389 - DNA, 187 bp, Homo sapiens; identical to SEQ ID NO: 16172
  chr17:17579341-17579528
  hypo

SEQ ID NO: 25390 - DNA, 96 bp, Homo sapiens; identical to SEQ ID NO: 16173
  chr17:17891258-17891354
  hypo

SEQ ID NO: 25391 - DNA, 29 bp, Homo sapiens
  chr17:18163325-18163354
  hypo
tgttcaagggggctcgccctggctgacac

SEQ ID NO: 25392 - DNA, 20 bp, Homo sapiens
  chr17:19769860-19769880
  hypo
tcatccgataagcaacaaag

SEQ ID NO: 25393 - DNA, 37 bp, Homo sapiens; identical to SEQ ID NO: 16176
  chr17:20771887-20771924
  hypo

SEQ ID NO: 25394 - DNA, 23 bp, Homo sapiens
  chr17:20817586-20817609
  hypo
aatgtgactcttggccgggcgcg

SEQ ID NO: 25395 - DNA, 30 bp, Homo sapiens; identical to SEQ ID NO: 16178
  chr17:21104001-21104031
  hypo

SEQ ID NO: 25396 - DNA, 53 bp, Homo sapiens; identical to SEQ ID NO: 16179
  chr17:21147486-21147539
  hypo

SEQ ID NO: 25397 - DNA, 33 bp, Homo sapiens; identical to SEQ ID NO: 1617
  chr17:26927180-26927213
  hypo

SEQ ID NO: 25398 - DNA, 24 bp, Homo sapiens
  chr17:27056401-27056425
  hypo
ctccctctgtcaccccggctggag

SEQ ID NO: 25399 - DNA, 12 bp, Homo sapiens
  chr17:27056857-27056869
  hypo
caggccagaagt

SEQ ID NO: 25400 - DNA, 30 bp, Homo sapiens; identical to SEQ ID NO: 16185
  chr17:27074858-27074888
  hypo

SEQ ID NO: 25401 - DNA, 30 bp, Homo sapiens; identical to SEQ ID NO: 16187
  chr17:27411663-27411693
  hypo

SEQ ID NO: 25402 - DNA, 68 bp, Homo sapiens
  chr17:27716046-27716114
  hypo
catacactgtatacacggattgcttaggtctgatcaacatgctccttccttggagcacagatctacta

SEQ ID NO: 25403 - DNA, 57 bp, Homo sapiens
  chr17:27716220-27716277
  hypo
ttttattcatgaaactcatataacaggtttatttatttcagtcgttttgttggttaa

SEQ ID NO: 25404 - DNA, 25 bp, Homo sapiens
  chr17:30243907-30243932
  hypo
ccctgggctgcgcagccccagccag

SEQ ID NO: 25405 - DNA, 30 bp, Homo sapiens; identical to SEQ ID NO: 16192
  chr17:31214057-31214087
  hypo

SEQ ID NO: 25406 - DNA, 23 bp, Homo sapiens
  chr17:37011132-37011155
  hypo
aatataaatagtggccgggcctt

SEQ ID NO: 25407 - DNA, 21 bp, Homo sapiens
  chr17:37369159-37369180
  hypo
cagagcatttacccccgcacc

SEQ ID NO: 25408 - DNA, 23 bp, Homo sapiens
  chr17:40477866-40477889
  hypo
accgcgcccggccaatcaatttc

SEQ ID NO: 25409 - DNA, 108 bp, Homo sapiens; identical to SEQ ID NO: 16201
  chr17:41464822-41464930
  hypo

SEQ ID NO: 25410 - DNA, 39 bp, Homo sapiens; identical to SEQ ID NO: 16202
  chr17:42330587-42330626
  hypo

SEQ ID NO: 25411 - DNA, 102 bp, Homo sapiens; identical to SEQ ID NO: 1619
  chr17:42331669-42331771
  hypo

SEQ ID NO: 25412 - DNA, 41 bp, Homo sapiens; identical to SEQ ID NO: 16204
  chr17:42395128-42395169
  hypo

SEQ ID NO: 25413 - DNA, 24 bp, Homo sapiens
  chr17:46177212-46177236
  hypo
taaaatatggccaggcgcagtggc

SEQ ID NO: 25414 - DNA, 86 bp, Homo sapiens; identical to SEQ ID NO: 16206
  chr17:47227368-47227454
  hypo

SEQ ID NO: 25415 - DNA, 11 bp, Homo sapiens
  chr17:47657583-47657594
  hypo
gagcatgtgct

SEQ ID NO: 25416 - DNA, 32 bp, Homo sapiens; identical to SEQ ID NO: 16208
  chr17:47851118-47851150
  hypo

SEQ ID NO: 25417 - DNA, 31 bp, Homo sapiens; identical to SEQ ID NO: 16209
  chr17:47851390-47851421
  hypo

SEQ ID NO: 25418 - DNA, 60 bp, Homo sapiens; identical to SEQ ID NO: 16211
  chr17:48653004-48653064
  hypo

SEQ ID NO: 25419 - DNA, 54 bp, Homo sapiens; identical to SEQ ID NO: 16212
  chr17:48653279-48653333
  hypo

SEQ ID NO: 25420 - DNA, 41 bp, Homo sapiens; identical to SEQ ID NO: 16213
  chr17:48687181-48687222
  hypo

SEQ ID NO: 25421 - DNA, 39 bp, Homo sapiens; identical to SEQ ID NO: 16215
  chr17:53479136-53479175
  hypo

SEQ ID NO: 25422 - DNA, 30 bp, Homo sapiens; identical to SEQ ID NO: 16216
  chr17:54473510-54473540
  hypo

SEQ ID NO: 25423 - DNA, 34 bp, Homo sapiens; identical to SEQ ID NO: 5202
  chr17:55037248-55037282
  hypo

SEQ ID NO: 25424 - DNA, 44 bp, Homo sapiens; identical to SEQ ID NO: 16218
  chr17:55184791-55184835
  hypo

SEQ ID NO: 25425 - DNA, 102 bp, Homo sapiens; identical to SEQ ID NO: 16219
  chr17:55364127-55364229
  hypo

SEQ ID NO: 25426 - DNA, 228 bp, Homo sapiens; identical to SEQ ID NO: 16221
  chr17:60856637-60856865
  hypo

SEQ ID NO: 25427 - DNA, 37 bp, Homo sapiens; identical to SEQ ID NO: 16222
  chr17:61677502-61677539
  hypo

SEQ ID NO: 25428 - DNA, 30 bp, Homo sapiens; identical to SEQ ID NO: 16224
  chr17:66643303-66643333
  hypo

SEQ ID NO: 25429 - DNA, 44 bp, Homo sapiens; identical to SEQ ID NO: 16226
  chr17:68268160-68268204
  hypo

SEQ ID NO: 25430 - DNA, 38 bp, Homo sapiens; identical to SEQ ID NO: 16227
  chr17:70657503-70657541
  hypo

SEQ ID NO: 25431 - DNA, 30 bp, Homo sapiens; identical to SEQ ID NO: 16228
  chr17:70712704-70712734
  hypo

SEQ ID NO: 25432 - DNA, 30 bp, Homo sapiens; identical to SEQ ID NO: 16229
  chr17:71391476-71391506
  hypo

SEQ ID NO: 25433 - DNA, 30 bp, Homo sapiens; identical to SEQ ID NO: 16230
  chr17:71879558-71879588
  hypo

SEQ ID NO: 25434 - DNA, 47 bp, Homo sapiens; identical to SEQ ID NO: 16231
  chr17:72356264-72356311
  hypo

SEQ ID NO: 25435 - DNA, 30 bp, Homo sapiens; identical to SEQ ID NO: 16232
  chr17:72370768-72370798
  hypo

SEQ ID NO: 25436 - DNA, 16 bp, Homo sapiens
  chr17:73031621-73031637
  hypo
actccagtctctggcc

SEQ ID NO: 25437 - DNA, 26 bp, Homo sapiens
  chr17:73083437-73083463
  hypo
agcgagactcccggccaactgagtac

SEQ ID NO: 25438 - DNA, 41 bp, Homo sapiens; identical to SEQ ID NO: 16235
  chr17:73089693-73089734
  hypo

SEQ ID NO: 25439 - DNA, 17 bp, Homo sapiens
  chr17:73135904-73135921
  hypo
tccgtctcaaaaataaa

SEQ ID NO: 25440 - DNA, 30 bp, Homo sapiens; identical to SEQ ID NO: 16238
  chr17:73606380-73606410
  hypo

SEQ ID NO: 25441 - DNA, 142 bp, Homo sapiens; identical to SEQ ID NO: 16239
  chr17:73615938-73616080
  hypo

SEQ ID NO: 25442 - DNA, 37 bp, Homo sapiens; identical to SEQ ID NO: 16241
  chr17:73638388-73638425
  hypo

SEQ ID NO: 25443 - DNA, 165 bp, Homo sapiens; identical to SEQ ID NO: 16242
  chr17:74128189-74128354
  hypo

SEQ ID NO: 25444 - DNA, 30 bp, Homo sapiens; identical to SEQ ID NO: 16243
  chr17:74908784-74908814
  hypo

SEQ ID NO: 25445 - DNA, 44 bp, Homo sapiens; identical to SEQ ID NO: 16244
  chr17:75049830-75049874
  hypo

SEQ ID NO: 25446 - DNA, 24 bp, Homo sapiens
  chr17:75523118-75523142
  hypo
cccctcctccctctccgctgctgc

SEQ ID NO: 25447 - DNA, 4 bp, Homo sapiens
  chr17:75733974-75733978
  hypo
ataa

SEQ ID NO: 25448 - DNA, 30 bp, Homo sapiens; identical to SEQ ID NO: 16247
  chr17:76021291-76021321
  hypo

SEQ ID NO: 25449 - DNA, 53 bp, Homo sapiens
  chr17:76137898-76137951
  hypo
aacctagcagcctcacgtccacagagctgccttgtgaaactcagcagagccct

SEQ ID NO: 25450 - DNA, 31 bp, Homo sapiens; identical to SEQ ID NO: 1623
  chr17:76211256-76211287
  hypo

SEQ ID NO: 25451 - DNA, 91 bp, Homo sapiens; identical to SEQ ID NO: 1624
  chr17:76211527-76211618
  hypo

SEQ ID NO: 25452 - DNA, 30 bp, Homo sapiens; identical to SEQ ID NO: 16251
  chr17:76419409-76419439
  hypo

SEQ ID NO: 25453 - DNA, 82 bp, Homo sapiens; identical to SEQ ID NO: 16252
  chr17:77002830-77002912
  hypo

SEQ ID NO: 25454 - DNA, 25 bp, Homo sapiens
  chr17:77105030-77105055
  hypo
ccctgcgttgaacagcgaggatgca

SEQ ID NO: 25455 - DNA, 30 bp, Homo sapiens; identical to SEQ ID NO: 16254
  chr17:77127147-77127177
  hypo

SEQ ID NO: 25456 - DNA, 63 bp, Homo sapiens; identical to SEQ ID NO: 16255
  chr17:77135878-77135941
  hypo

SEQ ID NO: 25457 - DNA, 115 bp, Homo sapiens; identical to SEQ ID NO: 16256
  chr17:77807753-77807868
  hypo

SEQ ID NO: 25458 - DNA, 78 bp, Homo sapiens; identical to SEQ ID NO: 16257
  chr17:77926480-77926558
  hypo

SEQ ID NO: 25459 - DNA, 30 bp, Homo sapiens; identical to SEQ ID NO: 16258
  chr17:77948916-77948946
  hypo

SEQ ID NO: 25460 - DNA, 63 bp, Homo sapiens
  chr17:78122190-78122253
  hypo
ctttcttatctgacactttaagtgcttcttcgtacccagctcctctaacgccttttgaagcag

SEQ ID NO: 25461 - DNA, 30 bp, Homo sapiens; identical to SEQ ID NO: 16260
  chr17:78447089-78447119
  hypo

SEQ ID NO: 25462 - DNA, 92 bp, Homo sapiens
  chr17:78667900-78667992
  hypo
tagagcaaatacaggcggctctgacatctcagcttttgtttgccactgctgcagcctcaggtgcctcatctggggcttcattcagagtgggt

SEQ ID NO: 25463 - DNA, 35 bp, Homo sapiens; identical to SEQ ID NO: 16262
  chr17:79096981-79097016
  hypo

SEQ ID NO: 25464 - DNA, 1 bp, Homo sapiens
  chr17:79099769-79099770
  hypo
g

SEQ ID NO: 25465 - DNA, 9 bp, Homo sapiens
  chr17:79099799-79099808
  hypo
ttcttccag

SEQ ID NO: 25466 - DNA, 48 bp, Homo sapiens; identical to SEQ ID NO: 16264
  chr17:79100184-79100232
  hypo

SEQ ID NO: 25467 - DNA, 30 bp, Homo sapiens; identical to SEQ ID NO: 16265
  chr17:79107633-79107663
  hypo

SEQ ID NO: 25468 - DNA, 30 bp, Homo sapiens; identical to SEQ ID NO: 16266
  chr17:79211720-79211750
  hypo

SEQ ID NO: 25469 - DNA, 48 bp, Homo sapiens; identical to SEQ ID NO: 16267
  chr17:79609256-79609304
  hypo

SEQ ID NO: 25470 - DNA, 49 bp, Homo sapiens
  chr17:79769384-79769433
  hypo
cagccagaaaattggcgacgacctcagtgtcagcacctggctcagtgat

SEQ ID NO: 25471 - DNA, 30 bp, Homo sapiens; identical to SEQ ID NO: 16269
  chr17:79774960-79774990
  hypo

SEQ ID NO: 25472 - DNA, 30 bp, Homo sapiens; identical to SEQ ID NO: 16270
  chr17:79847763-79847793
  hypo

SEQ ID NO: 25473 - DNA, 30 bp, Homo sapiens; identical to SEQ ID NO: 16271
  chr17:79870492-79870522
  hypo

SEQ ID NO: 25474 - DNA, 173 bp, Homo sapiens; identical to SEQ ID NO: 16272
  chr17:79874854-79875027
  hypo

SEQ ID NO: 25475 - DNA, 112 bp, Homo sapiens; identical to SEQ ID NO: 16273
  chr17:79887664-79887776
  hypo

SEQ ID NO: 25476 - DNA, 17 bp, Homo sapiens
  chr17:79913149-79913166
  hypo
cccggcctacaagacct

SEQ ID NO: 25477 - DNA, 30 bp, Homo sapiens; identical to SEQ ID NO: 16275
  chr17:80251974-80252004
  hypo

SEQ ID NO: 25478 - DNA, 21 bp, Homo sapiens
  chr17:80254296-80254317
  hypo
cgttgacggacacttaggcga

SEQ ID NO: 25479 - DNA, 375 bp, Homo sapiens
  chr17:80798345-80798720
  hypo
gtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgg

SEQ ID NO: 25480 - DNA, 171 bp, Homo sapiens
  chr17:80832541-80832712
  hypo
ctccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaatt

SEQ ID NO: 25481 - DNA, 30 bp, Homo sapiens; identical to SEQ ID NO: 16282
  chr17:80972340-80972370
  hypo

SEQ ID NO: 25482 - DNA, 48 bp, Homo sapiens
  chr17:81008826-81008874
  hypo
tgggcaagtgtgccgggaatgtgtgacggcagacgtgtggggtgcgag

SEQ ID NO: 25483 - DNA, 156 bp, Homo sapiens; identical to SEQ ID NO: 16284
  chr17:81015300-81015456
  hypo

SEQ ID NO: 25484 - DNA, 58 bp, Homo sapiens; identical to SEQ ID NO: 16285
  chr17:81048783-81048841
  hypo

SEQ ID NO: 25485 - DNA, 87 bp, Homo sapiens; identical to SEQ ID NO: 16286
  chr17:81050193-81050280
  hypo

SEQ ID NO: 25486 - DNA, 30 bp, Homo sapiens; identical to SEQ ID NO: 16287
  chr17:81050936-81050966
  hypo

SEQ ID NO: 25487 - DNA, 30 bp, Homo sapiens; identical to SEQ ID NO: 16288
  chr17:81062138-81062168
  hypo

SEQ ID NO: 25488 - DNA, 30 bp, Homo sapiens; identical to SEQ ID NO: 16289
  chr17:81076347-81076377
  hypo

SEQ ID NO: 25489 - DNA, 19 bp, Homo sapiens
  chr17:81081890-81081909
  hypo
gggcgacgctcagggcggc

SEQ ID NO: 25490 - DNA, 30 bp, Homo sapiens; identical to SEQ ID NO: 16291
  chr18:597381-597411
  hypo

SEQ ID NO: 25491 - DNA, 19 bp, Homo sapiens
  chr18:5133188-5133207
  hypo
caccaccaccgaccacgat

SEQ ID NO: 25492 - DNA, 40 bp, Homo sapiens; identical to SEQ ID NO: 16294
  chr18:8845133-8845173
  hypo

SEQ ID NO: 25493 - DNA, 16 bp, Homo sapiens
  chr18:9364512-9364528
  hypo
aggtgtggtggctcac

SEQ ID NO: 25494 - DNA, 38 bp, Homo sapiens
  chr18:10589348-10589386
  hypo
gaaggcaccgccgccgcccgccgcgggaggcttccgcg

SEQ ID NO: 25495 - DNA, 17 bp, Homo sapiens
  chr18:11014809-11014826
  hypo
tccggggccccctcatt

SEQ ID NO: 25496 - DNA, 30 bp, Homo sapiens; identical to SEQ ID NO: 16298
  chr18:11979044-11979074
  hypo

SEQ ID NO: 25497 - DNA, 30 bp, Homo sapiens; identical to SEQ ID NO: 16300
  chr18:12701811-12701841
  hypo

SEQ ID NO: 25498 - DNA, 26 bp, Homo sapiens
  chr18:12949149-12949175
  hypo
gccaccgcgcccggcctacaagcaga

SEQ ID NO: 25499 - DNA, 39 bp, Homo sapiens; identical to SEQ ID NO: 16302
  chr18:13461328-13461367
  hypo

SEQ ID NO: 25500 - DNA, 10 bp, Homo sapiens
  chr18:13826383-13826393
  hypo
acatgttcct

SEQ ID NO: 25501 - DNA, 59 bp, Homo sapiens; identical to SEQ ID NO: 16304
  chr18:13940522-13940581
  hypo

SEQ ID NO: 25502 - DNA, 30 bp, Homo sapiens; identical to SEQ ID NO: 16305
  chr18:20911344-20911374
  hypo

SEQ ID NO: 25503 - DNA, 181 bp, Homo sapiens; identical to SEQ ID NO: 16306
  chr18:53968903-53969084
  hypo

SEQ ID NO: 25504 - DNA, 39 bp, Homo sapiens; identical to SEQ ID NO: 16309
  chr18:68051369-68051408
  hypo

SEQ ID NO: 25505 - DNA, 30 bp, Homo sapiens; identical to SEQ ID NO: 16310
  chr18:72896219-72896249
  hypo

SEQ ID NO: 25506 - DNA, 143 bp, Homo sapiens; identical to SEQ ID NO: 16311
  chr18:75229713-75229856
  hypo

SEQ ID NO: 25507 - DNA, 99 bp, Homo sapiens; identical to SEQ ID NO: 16312
  chr18:75230687-75230786
  hypo

SEQ ID NO: 25508 - DNA, 378 bp, Homo sapiens; identical to SEQ ID NO: 16313
  chr18:75998610-75998988
  hypo

SEQ ID NO: 25509 - DNA, 30 bp, Homo sapiens; identical to SEQ ID NO: 16314
  chr18:76073322-76073352
  hypo

SEQ ID NO: 25510 - DNA, 30 bp, Homo sapiens; identical to SEQ ID NO: 16315
  chr18:76123862-76123892
  hypo

SEQ ID NO: 25511 - DNA, 63 bp, Homo sapiens; identical to SEQ ID NO: 16316
  chr18:76239475-76239538
  hypo

SEQ ID NO: 25512 - DNA, 30 bp, Homo sapiens; identical to SEQ ID NO: 16317
  chr18:76412736-76412766
  hypo

SEQ ID NO: 25513 - DNA, 30 bp, Homo sapiens; identical to SEQ ID NO: 16318
  chr18:76477600-76477630
  hypo

SEQ ID NO: 25514 - DNA, 30 bp, Homo sapiens; identical to SEQ ID NO: 16320
  chr18:76541560-76541590
  hypo

SEQ ID NO: 25515 - DNA, 30 bp, Homo sapiens; identical to SEQ ID NO: 16321
  chr18:76686197-76686227
  hypo

SEQ ID NO: 25516 - DNA, 12 bp, Homo sapiens
  chr18:77167812-77167824
  hypo
gagggcatttct

SEQ ID NO: 25517 - DNA, 38 bp, Homo sapiens
  chr18:77181317-77181355
  hypo
acagacctggaatcacgaggaaatgcccgtcctcctcc

SEQ ID NO: 25518 - DNA, 17 bp, Homo sapiens
  chr18:77181409-77181426
  hypo
agcgcctggatgacgtc

SEQ ID NO: 25519 - DNA, 30 bp, Homo sapiens; identical to SEQ ID NO: 16325
  chr18:77201979-77202009
  hypo

SEQ ID NO: 25520 - DNA, 64 bp, Homo sapiens; identical to SEQ ID NO: 16326
  chr18:77246511-77246575
  hypo

SEQ ID NO: 25521 - DNA, 39 bp, Homo sapiens; identical to SEQ ID NO: 16327
  chr18:77272049-77272088
  hypo

SEQ ID NO: 25522 - DNA, 27 bp, Homo sapiens
  chr18:77285870-77285897
  hypo
gcaaggctgaaccagcgcagtgggaaa

SEQ ID NO: 25523 - DNA, 42 bp, Homo sapiens
  chr18:77286028-77286070
  hypo
agcctagggcatttgggtggggacgtgcgacccccacacaga

SEQ ID NO: 25524 - DNA, 30 bp, Homo sapiens; identical to SEQ ID NO: 16329
  chr18:77288262-77288292
  hypo

SEQ ID NO: 25525 - DNA, 32 bp, Homo sapiens; identical to SEQ ID NO: 16330
  chr18:77313917-77313949
  hypo

SEQ ID NO: 25526 - DNA, 131 bp, Homo sapiens; identical to SEQ ID NO: 16333
  chr18:77364414-77364545
  hypo

SEQ ID NO: 25527 - DNA, 30 bp, Homo sapiens; identical to SEQ ID NO: 16334
  chr18:77410108-77410138
  hypo

SEQ ID NO: 25528 - DNA, 30 bp, Homo sapiens; identical to SEQ ID NO: 16335
  chr18:77542905-77542935
  hypo

SEQ ID NO: 25529 - DNA, 19 bp, Homo sapiens
  chr18:77543230-77543249
  hypo
catccccgtgagctccgcc

SEQ ID NO: 25530 - DNA, 10 bp, Homo sapiens
  chr18:77550196-77550206
  hypo
gacacaagag

SEQ ID NO: 25531 - DNA, 30 bp, Homo sapiens; identical to SEQ ID NO: 16338
  chr18:77636150-77636180
  hypo

SEQ ID NO: 25532 - DNA, 153 bp, Homo sapiens
  chr18:77636621-77636774
  hypo
cctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccggg

SEQ ID NO: 25533 - DNA, 30 bp, Homo sapiens; identical to SEQ ID NO: 16340
  chr18:77644664-77644694
  hypo

SEQ ID NO: 25534 - DNA, 30 bp, Homo sapiens; identical to SEQ ID NO: 16341
  chr19:292163-292193
  hypo

SEQ ID NO: 25535 - DNA, 30 bp, Homo sapiens; identical to SEQ ID NO: 16342
  chr19:349135-349165
  hypo

SEQ ID NO: 25536 - DNA, 171 bp, Homo sapiens
  chr19:403367-403538
  hypo
agacctgaggcagggcgagacaccacgcaggcgcagaatccctggatgacgcccacttggaagtggaggggggagggcatgggcagctgcagctcccagacaccagcacacacaaacgcacacacaagtgcacaccagcagcgacacaggcacacacaagcgcacacaggg

SEQ ID NO: 25537 - DNA, 145 bp, Homo sapiens; identical to SEQ ID NO: 16344
  chr19:407470-407615
  hypo

SEQ ID NO: 25538 - DNA, 92 bp, Homo sapiens; identical to SEQ ID NO: 16346
  chr19:470863-470955
  hypo

SEQ ID NO: 25539 - DNA, 181 bp, Homo sapiens; identical to SEQ ID NO: 16348
  chr19:491311-491492
  hypo

SEQ ID NO: 25540 - DNA, 23 bp, Homo sapiens
  chr19:530233-530256
  hypo
accgtgcccggcctgtatgttga

SEQ ID NO: 25541 - DNA, 30 bp, Homo sapiens; identical to SEQ ID NO: 16350
  chr19:548574-548604
  hypo

SEQ ID NO: 25542 - DNA, 229 bp, Homo sapiens
  chr19:549451-549680
  hypo
gagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccaga

SEQ ID NO: 25543 - DNA, 111 bp, Homo sapiens; identical to SEQ ID NO: 16352
  chr19:550388-550499
  hypo

SEQ ID NO: 25544 - DNA, 140 bp, Homo sapiens
  chr19:593150-593290
  hypo
agtccaccctgctcccgtgctcggaagtggcctctttcacgccccacgtcccagtcccagtatacagcaggtgccacatatttgctgaattttctgaggggcagagcatgggtcctgggctgacgtgggtccagatttcg

SEQ ID NO: 25545 - DNA, 14 bp, Homo sapiens
  chr19:599200-599214
  hypo
tttggaccgtttcc

SEQ ID NO: 25546 - DNA, 42 bp, Homo sapiens
  chr19:883582-883624
  hypo
ggcatgtgtgtgagacgtggctctcgggcgggtaacagctgg

SEQ ID NO: 25547 - DNA, 227 bp, Homo sapiens
  chr19:883791-884018
  hypo
caggagccagcgcagcccaaactgcctggtgactcaccacgaggcccaggggaaggaatgaggcccaacaaggccctggggaccgggcgaaggaacgagccctgggagaaggaatggcagcagccctcttcacctgcctggtgactcactacaagccctgggggaaggaatggcagtggccctcttcacctttactgcctctgcggccacaatgggcagttgacata

SEQ ID NO: 25548 - DNA, 52 bp, Homo sapiens
  chr19:884162-884214
  hypo
ctctcatctaccgggaaaacatctcccttctccagagcggaggccagcctaa

SEQ ID NO: 25549 - DNA, 163 bp, Homo sapiens; identical to SEQ ID NO: 16358
  chr19:900851-901014
  hypo

SEQ ID NO: 25550 - DNA, 38 bp, Homo sapiens
  chr19:955719-955757
  hypo
aggcagggtagaccccgtaataccgggtcagaatctca

SEQ ID NO: 25551 - DNA, 100 bp, Homo sapiens
  chr19:1003205-1003305
  hypo
gcacgcctgggaagacgtcggcctggccctgtgccgcactcaggaccccggcggcctggtggccctctggacaagccgggctggccggcccccacagctg

SEQ ID NO: 25552 - DNA, 58 bp, Homo sapiens
  chr19:1003384-1003442
  hypo
gtgaagcaccggtacccgcggcggtcctcctcggctgtgacatcgcccgtgcccgtcg

SEQ ID NO: 25553 - DNA, 32 bp, Homo sapiens; identical to SEQ ID NO: 16363
  chr19:1030092-1030124
  hypo

SEQ ID NO: 25554 - DNA, 69 bp, Homo sapiens; identical to SEQ ID NO: 16364
  chr19:1112645-1112714
  hypo

SEQ ID NO: 25555 - DNA, 17 bp, Homo sapiens
  chr19:1128414-1128431
  hypo
ggattcttacactgtcg

SEQ ID NO: 25556 - DNA, 30 bp, Homo sapiens; identical to SEQ ID NO: 16366
  chr19:1156568-1156598
  hypo

SEQ ID NO: 25557 - DNA, 73 bp, Homo sapiens
  chr19:1171324-1171397
  hypo
aagaatacacacatccatacaacacacaggcacacaacacacatgtgcatgcacatggcgcaacatacagata

SEQ ID NO: 25558 - DNA, 53 bp, Homo sapiens; identical to SEQ ID NO: 16368
  chr19:1227555-1227608
  hypo

SEQ ID NO: 25559 - DNA, 30 bp, Homo sapiens; identical to SEQ ID NO: 16369
  chr19:1236238-1236268
  hypo

SEQ ID NO: 25560 - DNA, 53 bp, Homo sapiens; identical to SEQ ID NO: 16371
  chr19:1274693-1274746
  hypo

SEQ ID NO: 25561 - DNA, 30 bp, Homo sapiens; identical to SEQ ID NO: 16372
  chr19:1308187-1308217
  hypo

SEQ ID NO: 25562 - DNA, 30 bp, Homo sapiens; identical to SEQ ID NO: 16373
  chr19:1325942-1325972
  hypo

SEQ ID NO: 25563 - DNA, 43 bp, Homo sapiens; identical to SEQ ID NO: 16374
  chr19:1482018-1482061
  hypo

SEQ ID NO: 25564 - DNA, 106 bp, Homo sapiens; identical to SEQ ID NO: 16375
  chr19:1482370-1482476
  hypo

SEQ ID NO: 25565 - DNA, 28 bp, Homo sapiens
  chr19:1496626-1496654
  hypo
cccggtggctgtggccgggccctccact

SEQ ID NO: 25566 - DNA, 30 bp, Homo sapiens; identical to SEQ ID NO: 16379
  chr19:1533726-1533756
  hypo

SEQ ID NO: 25567 - DNA, 48 bp, Homo sapiens; identical to SEQ ID NO: 16380
  chr19:1799852-1799900
  hypo

SEQ ID NO: 25568 - DNA, 377 bp, Homo sapiens; identical to SEQ ID NO: 16382
  chr19:1809512-1809889
  hypo

SEQ ID NO: 25569 - DNA, 37 bp, Homo sapiens; identical to SEQ ID NO: 16383
  chr19:1912092-1912129
  hypo

SEQ ID NO: 25570 - DNA, 79 bp, Homo sapiens; identical to SEQ ID NO: 16384
  chr19:1970005-1970084
  hypo

SEQ ID NO: 25571 - DNA, 35 bp, Homo sapiens; identical to SEQ ID NO: 16385
  chr19:1970474-1970509
  hypo

SEQ ID NO: 25572 - DNA, 306 bp, Homo sapiens; identical to SEQ ID NO: 16386
  chr19:1978313-1978619
  hypo

SEQ ID NO: 25573 - DNA, 141 bp, Homo sapiens; identical to SEQ ID NO: 16387
  chr19:1993071-1993212
  hypo

SEQ ID NO: 25574 - DNA, 55 bp, Homo sapiens; identical to SEQ ID NO: 16388
  chr19:2274600-2274655
  hypo

SEQ ID NO: 25575 - DNA, 124 bp, Homo sapiens; identical to SEQ ID NO: 16389
  chr19:2359026-2359150
  hypo

SEQ ID NO: 25576 - DNA, 124 bp, Homo sapiens; identical to SEQ ID NO: 16390
  chr19:2363060-2363184
  hypo

SEQ ID NO: 25577 - DNA, 29 bp, Homo sapiens
  chr19:2471700-2471729
  hypo
aaatacggtgactcacgcctgtaattcca

SEQ ID NO: 25578 - DNA, 40 bp, Homo sapiens; identical to SEQ ID NO: 16392
  chr19:2513207-2513247
  hypo

SEQ ID NO: 25579 - DNA, 39 bp, Homo sapiens; identical to SEQ ID NO: 16393
  chr19:2513455-2513494
  hypo

SEQ ID NO: 25580 - DNA, 22 bp, Homo sapiens
  chr19:2524913-2524935
  hypo
gtgcgcacgggagtgcatgtgg

SEQ ID NO: 25581 - DNA, 20 bp, Homo sapiens
  chr19:2683891-2683911
  hypo
gctggtggacagcatcggcc

SEQ ID NO: 25582 - DNA, 45 bp, Homo sapiens; identical to SEQ ID NO: 16396
  chr19:2899991-2900036
  hypo

SEQ ID NO: 25583 - DNA, 69 bp, Homo sapiens
  chr19:3219565-3219634
  hypo
gtaacatccatggcacgggcatcctgcagtgaccgatgcccaccagactgcatccgctaacaagacagg

SEQ ID NO: 25584 - DNA, 107 bp, Homo sapiens; identical to SEQ ID NO: 16402
  chr19:3779159-3779266
  hypo

SEQ ID NO: 25585 - DNA, 30 bp, Homo sapiens; identical to SEQ ID NO: 16405
  chr19:4131483-4131513
  hypo

SEQ ID NO: 25586 - DNA, 30 bp, Homo sapiens; identical to SEQ ID NO: 16406
  chr19:4512122-4512152
  hypo

SEQ ID NO: 25587 - DNA, 100 bp, Homo sapiens
  chr19:4548034-4548134
  hypo
tcacttcatacaccccgagtactgctggcagcgagccacaggcactcggaccacgcagcgggggaaggcagccagcaggccccccgaagctgcgtccagc

SEQ ID NO: 25588 - DNA, 20 bp, Homo sapiens
  chr19:4548364-4548384
  hypo
aggaccgtccccgcctcaga

SEQ ID NO: 25589 - DNA, 38 bp, Homo sapiens; identical to SEQ ID NO: 16408
  chr19:4555023-4555061
  hypo

SEQ ID NO: 25590 - DNA, 65 bp, Homo sapiens
  chr19:4557235-4557300
  hypo
ctgggggaggggcatagttagtgagaactgggggctccgccaccctctcccgttccatccttccc

SEQ ID NO: 25591 - DNA, 25 bp, Homo sapiens
  chr19:4670740-4670765
  hypo
cgaacttctcataatcgttgcagcc

SEQ ID NO: 25592 - DNA, 38 bp, Homo sapiens; identical to SEQ ID NO: 16412
  chr19:4789994-4790032
  hypo

SEQ ID NO: 25593 - DNA, 90 bp, Homo sapiens; identical to SEQ ID NO: 16413
  chr19:4792950-4793040
  hypo

SEQ ID NO: 25594 - DNA, 30 bp, Homo sapiens; identical to SEQ ID NO: 16414
  chr19:4800545-4800575
  hypo

SEQ ID NO: 25595 - DNA, 30 bp, Homo sapiens; identical to SEQ ID NO: 16415
  chr19:5676881-5676911
  hypo

SEQ ID NO: 25596 - DNA, 7 bp, Homo sapiens
  chr19:5759774-5759781
  hypo
gactcag

SEQ ID NO: 25597 - DNA, 30 bp, Homo sapiens; identical to SEQ ID NO: 16417
  chr19:5789897-5789927
  hypo

SEQ ID NO: 25598 - DNA, 37 bp, Homo sapiens; identical to SEQ ID NO: 16418
  chr19:5790176-5790213
  hypo

SEQ ID NO: 25599 - DNA, 19 bp, Homo sapiens
  chr19:5826127-5826146
  hypo
agagcgagactccgtctca

SEQ ID NO: 25600 - DNA, 34 bp, Homo sapiens
  chr19:5915060-5915094
  hypo
ccgtgcccaccccaaggtgcgcagtggggagtgg

SEQ ID NO: 25601 - DNA, 30 bp, Homo sapiens; identical to SEQ ID NO: 16421
  chr19:5915421-5915451
  hypo

SEQ ID NO: 25602 - DNA, 30 bp, Homo sapiens; identical to SEQ ID NO: 16422
  chr19:5915925-5915955
  hypo

SEQ ID NO: 25603 - DNA, 188 bp, Homo sapiens; identical to SEQ ID NO: 16423
  chr19:6358262-6358450
  hypo

SEQ ID NO: 25604 - DNA, 35 bp, Homo sapiens; identical to SEQ ID NO: 16424
  chr19:7727784-7727819
  hypo

SEQ ID NO: 25605 - DNA, 30 bp, Homo sapiens; identical to SEQ ID NO: 16425
  chr19:8009581-8009611
  hypo

SEQ ID NO: 25606 - DNA, 99 bp, Homo sapiens; identical to SEQ ID NO: 16426
  chr19:8475426-8475525
  hypo

SEQ ID NO: 25607 - DNA, 11 bp, Homo sapiens
  chr19:8576903-8576914
  hypo
ctgtgcaatgc

SEQ ID NO: 25608 - DNA, 30 bp, Homo sapiens; identical to SEQ ID NO: 16430
  chr19:10231504-10231534
  hypo

SEQ ID NO: 25609 - DNA, 68 bp, Homo sapiens; identical to SEQ ID NO: 16431
  chr19:10370372-10370440
  hypo

SEQ ID NO: 25610 - DNA, 151 bp, Homo sapiens; identical to SEQ ID NO: 16432
  chr19:10562153-10562304
  hypo

SEQ ID NO: 25611 - DNA, 30 bp, Homo sapiens; identical to SEQ ID NO: 16433
  chr19:10570365-10570395
  hypo

SEQ ID NO: 25612 - DNA, 18 bp, Homo sapiens
  chr19:10711942-10711960
  hypo
acccggcctgttttcacc

SEQ ID NO: 25613 - DNA, 204 bp, Homo sapiens; identical to SEQ ID NO: 16435
  chr19:10875903-10876107
  hypo

SEQ ID NO: 25614 - DNA, 30 bp, Homo sapiens; identical to SEQ ID NO: 16436
  chr19:10954418-10954448
  hypo

SEQ ID NO: 25615 - DNA, 30 bp, Homo sapiens; identical to SEQ ID NO: 16437
  chr19:11002992-11003022
  hypo

SEQ ID NO: 25616 - DNA, 30 bp, Homo sapiens; identical to SEQ ID NO: 16438
  chr19:11005335-11005365
  hypo

SEQ ID NO: 25617 - DNA, 25 bp, Homo sapiens
  chr19:11008369-11008394
  hypo
atgctagctctgggccgggcacggt

SEQ ID NO: 25618 - DNA, 30 bp, Homo sapiens; identical to SEQ ID NO: 16440
  chr19:11252737-11252767
  hypo

SEQ ID NO: 25619 - DNA, 23 bp, Homo sapiens
  chr19:12220425-12220448
  hypo
cacacaaacgtttttatgtttga

SEQ ID NO: 25620 - DNA, 30 bp, Homo sapiens; identical to SEQ ID NO: 16442
  chr19:12222728-12222758
  hypo

SEQ ID NO: 25621 - DNA, 51 bp, Homo sapiens
  chr19:12863520-12863571
  hypo
ttccttgggttctacatggcgctgagtgctgcctaccggtgaggctgccct

SEQ ID NO: 25622 - DNA, 30 bp, Homo sapiens; identical to SEQ ID NO: 16444
  chr19:13335742-13335772
  hypo

SEQ ID NO: 25623 - DNA, 30 bp, Homo sapiens; identical to SEQ ID NO: 16445
  chr19:13781908-13781938
  hypo

SEQ ID NO: 25624 - DNA, 20 bp, Homo sapiens
  chr19:13988706-13988726
  hypo
agttgattttatttacgtat

SEQ ID NO: 25625 - DNA, 40 bp, Homo sapiens; identical to SEQ ID NO: 16448
  chr19:14327052-14327092
  hypo

SEQ ID NO: 25626 - DNA, 36 bp, Homo sapiens; identical to SEQ ID NO: 16449
  chr19:14630627-14630663
  hypo

SEQ ID NO: 25627 - DNA, 30 bp, Homo sapiens; identical to SEQ ID NO: 16450
  chr19:15237724-15237754
  hypo

SEQ ID NO: 25628 - DNA, 30 bp, Homo sapiens; identical to SEQ ID NO: 16451
  chr19:15292289-15292319
  hypo

SEQ ID NO: 25629 - DNA, 136 bp, Homo sapiens; identical to SEQ ID NO: 16452
  chr19:16275694-16275830
  hypo

SEQ ID NO: 25630 - DNA, 30 bp, Homo sapiens; identical to SEQ ID NO: 16453
  chr19:16638285-16638315
  hypo

SEQ ID NO: 25631 - DNA, 30 bp, Homo sapiens; identical to SEQ ID NO: 16454
  chr19:16638706-16638736
  hypo

SEQ ID NO: 25632 - DNA, 50 bp, Homo sapiens; identical to SEQ ID NO: 16455
  chr19:16939668-16939718
  hypo

SEQ ID NO: 25633 - DNA, 30 bp, Homo sapiens; identical to SEQ ID NO: 16456
  chr19:17365715-17365745
  hypo

SEQ ID NO: 25634 - DNA, 25 bp, Homo sapiens
  chr19:17379245-17379270
  hypo
tttttttttttgagacggagtttcg

SEQ ID NO: 25635 - DNA, 30 bp, Homo sapiens; identical to SEQ ID NO: 16458
  chr19:17404772-17404802
  hypo

SEQ ID NO: 25636 - DNA, 164 bp, Homo sapiens; identical to SEQ ID NO: 16459
  chr19:17405108-17405272
  hypo

SEQ ID NO: 25637 - DNA, 30 bp, Homo sapiens; identical to SEQ ID NO: 16461
  chr19:17836551-17836581
  hypo

SEQ ID NO: 25638 - DNA, 39 bp, Homo sapiens
  chr19:18041203-18041242
  hypo
ggaattggcgaaaactagcagtcacgccctttggccagg

SEQ ID NO: 25639 - DNA, 144 bp, Homo sapiens; identical to SEQ ID NO: 16463
  chr19:18054338-18054482
  hypo

SEQ ID NO: 25640 - DNA, 30 bp, Homo sapiens; identical to SEQ ID NO: 16464
  chr19:18054810-18054840
  hypo

SEQ ID NO: 25641 - DNA, 176 bp, Homo sapiens; identical to SEQ ID NO: 16465
  chr19:18092619-18092795
  hypo

SEQ ID NO: 25642 - DNA, 11 bp, Homo sapiens
  chr19:18103700-18103711
  hypo
acctccccaga

SEQ ID NO: 25643 - DNA, 42 bp, Homo sapiens
  chr19:18104430-18104472
  hypo
gggctcagctcctgccggaggagggcacaaggacccgctgtg

SEQ ID NO: 25644 - DNA, 47 bp, Homo sapiens; identical to SEQ ID NO: 16468
  chr19:18207919-18207966
  hypo

SEQ ID NO: 25645 - DNA, 18 bp, Homo sapiens
  chr19:18298268-18298286
  hypo
acaggcataagccaccga

SEQ ID NO: 25646 - DNA, 40 bp, Homo sapiens
  chr19:18330991-18331031
  hypo
gtactcctaaaatgtcgtccaggcagtgactcaacaaagc

SEQ ID NO: 25647 - DNA, 55 bp, Homo sapiens
  chr19:18331136-18331191
  hypo
ggagagaaggtgaagaccgtgatgatggggcaccgtgggccgaggcaggtgagct

SEQ ID NO: 25648 - DNA, 42 bp, Homo sapiens; identical to SEQ ID NO: 16472
  chr19:18788397-18788439
  hypo

SEQ ID NO: 25649 - DNA, 30 bp, Homo sapiens; identical to SEQ ID NO: 16473
  chr19:18883509-18883539
  hypo

SEQ ID NO: 25650 - DNA, 65 bp, Homo sapiens; identical to SEQ ID NO: 16474
  chr19:18883973-18884038
  hypo

SEQ ID NO: 25651 - DNA, 83 bp, Homo sapiens; identical to SEQ ID NO: 16475
  chr19:18988902-18988985
  hypo

SEQ ID NO: 25652 - DNA, 97 bp, Homo sapiens
  chr19:18989724-18989821
  hypo
ccctccacactcactcggctttgctgggcttcaggctctgggcctcggctgtgtcatactcccgcaggtccttcagctcgtgcacctggcctgtcaa

SEQ ID NO: 25653 - DNA, 37 bp, Homo sapiens
  chr19:18994850-18994887
  hypo
gtgtgggctgtgcctcggccccctgccacccgatcct

SEQ ID NO: 25654 - DNA, 138 bp, Homo sapiens; identical to SEQ ID NO: 16478
  chr19:19218614-19218752
  hypo

SEQ ID NO: 25655 - DNA, 30 bp, Homo sapiens; identical to SEQ ID NO: 16479
  chr19:19335195-19335225
  hypo

SEQ ID NO: 25656 - DNA, 30 bp, Homo sapiens; identical to SEQ ID NO: 16480
  chr19:22017749-22017779
  hypo

SEQ ID NO: 25657 - DNA, 32 bp, Homo sapiens
  chr19:30555376-30555408
  hypo
gcggcccactgtgctcccggcagccctcctga

SEQ ID NO: 25658 - DNA, 22 bp, Homo sapiens
  chr19:30637531-30637553
  hypo
gcaagcacgtgacatccagtac

SEQ ID NO: 25659 - DNA, 30 bp, Homo sapiens; identical to SEQ ID NO: 16483
  chr19:31587530-31587560
  hypo

SEQ ID NO: 25660 - DNA, 30 bp, Homo sapiens; identical to SEQ ID NO: 16485
  chr19:32672333-32672363
  hypo

SEQ ID NO: 25661 - DNA, 30 bp, Homo sapiens; identical to SEQ ID NO: 16486
  chr19:32835111-32835141
  hypo

SEQ ID NO: 25662 - DNA, 30 bp, Homo sapiens; identical to SEQ ID NO: 16487
  chr19:33415273-33415303
  hypo

SEQ ID NO: 25663 - DNA, 25 bp, Homo sapiens
  chr19:33557305-33557330
  hypo
cgcacccggccgtggagcacggttc

SEQ ID NO: 25664 - DNA, 30 bp, Homo sapiens; identical to SEQ ID NO: 16489
  chr19:34263853-34263883
  hypo

SEQ ID NO: 25665 - DNA, 30 bp, Homo sapiens; identical to SEQ ID NO: 16490
  chr19:35615979-35616009
  hypo

SEQ ID NO: 25666 - DNA, 85 bp, Homo sapiens
  chr19:35616256-35616341
  hypo
ttgtcaggctcaaggcggaggacctggctgaaggcgaagtcgctgcctaggatggccagctggtccctggcgatgagcagtggct

SEQ ID NO: 25667 - DNA, 21 bp, Homo sapiens
  chr19:35616397-35616418
  hypo
tcccagcgcatgacctgtggg

SEQ ID NO: 25668 - DNA, 7 bp, Homo sapiens
  chr19:35797909-35797916
  hypo
aaaagat

SEQ ID NO: 25669 - DNA, 344 bp, Homo sapiens; identical to SEQ ID NO: 16494
  chr19:36221572-36221916
  hypo

SEQ ID NO: 25670 - DNA, 19 bp, Homo sapiens
  chr19:36250134-36250153
  hypo
gcaacggtgcttcatggaa

SEQ ID NO: 25671 - DNA, 169 bp, Homo sapiens; identical to SEQ ID NO: 16497
  chr19:36604561-36604730
  hypo

SEQ ID NO: 25672 - DNA, 6 bp, Homo sapiens
  chr19:38481038-38481044
  hypo
agccag

SEQ ID NO: 25673 - DNA, 20 bp, Homo sapiens
  chr19:38828365-38828385
  hypo
tttatttttttgagacggag

SEQ ID NO: 25674 - DNA, 20 bp, Homo sapiens
  chr19:38905702-38905722
  hypo
tgcggcggtagcgggcgtag

SEQ ID NO: 25675 - DNA, 47 bp, Homo sapiens; identical to SEQ ID NO: 16503
  chr19:38998362-38998409
  hypo

SEQ ID NO: 25676 - DNA, 30 bp, Homo sapiens; identical to SEQ ID NO: 16504
  chr19:39330221-39330251
  hypo

SEQ ID NO: 25677 - DNA, 26 bp, Homo sapiens
  chr19:39392993-39393019
  hypo
gccaccgcgcccggcctcattttatt

SEQ ID NO: 25678 - DNA, 39 bp, Homo sapiens; identical to SEQ ID NO: 16506
  chr19:39646149-39646188
  hypo

SEQ ID NO: 25679 - DNA, 189 bp, Homo sapiens; identical to SEQ ID NO: 16507
  chr19:40218707-40218896
  hypo

SEQ ID NO: 25680 - DNA, 49 bp, Homo sapiens; identical to SEQ ID NO: 16509
  chr19:41062945-41062994
  hypo

SEQ ID NO: 25681 - DNA, 59 bp, Homo sapiens
  chr19:41881475-41881534
  hypo
cccggcccgtgagcccgtttctttatctgcaaaacagggattaaaaacaagccaacacc

SEQ ID NO: 25682 - DNA, 31 bp, Homo sapiens; identical to SEQ ID NO: 16511
  chr19:42202366-42202397
  hypo

SEQ ID NO: 25683 - DNA, 127 bp, Homo sapiens; identical to SEQ ID NO: 16512
  chr19:42349306-42349433
  hypo

SEQ ID NO: 25684 - DNA, 30 bp, Homo sapiens; identical to SEQ ID NO: 16513
  chr19:42373877-42373907
  hypo

SEQ ID NO: 25685 - DNA, 44 bp, Homo sapiens; identical to SEQ ID NO: 16514
  chr19:42408203-42408247
  hypo

SEQ ID NO: 25686 - DNA, 30 bp, Homo sapiens; identical to SEQ ID NO: 16515
  chr19:42408664-42408694
  hypo

SEQ ID NO: 25687 - DNA, 19 bp, Homo sapiens
  chr19:42579050-42579069
  hypo
tttcagatggagtctcgct

SEQ ID NO: 25688 - DNA, 33 bp, Homo sapiens; identical to SEQ ID NO: 16517
  chr19:45381918-45381951
  hypo

SEQ ID NO: 25689 - DNA, 30 bp, Homo sapiens; identical to SEQ ID NO: 16518
  chr19:45626698-45626728
  hypo

SEQ ID NO: 25690 - DNA, 30 bp, Homo sapiens; identical to SEQ ID NO: 16519
  chr19:45709152-45709182
  hypo

SEQ ID NO: 25691 - DNA, 87 bp, Homo sapiens
  chr19:45810015-45810102
  hypo
gggcggggatcatgtcgtcaatggactggcctttctccaacttcttctccatttccaccatgagcttcacaccatccaccaccagct

SEQ ID NO: 25692 - DNA, 83 bp, Homo sapiens
  chr19:45997445-45997528
  hypo
gaattctaattggtccgtgctatcgaggcactgtccccttactggctctcgctccagtggcccccactgcttttcttcctctt

SEQ ID NO: 25693 - DNA, 19 bp, Homo sapiens
  chr19:45997584-45997603
  hypo
gtaccggcctggggtgtcc

SEQ ID NO: 25694 - DNA, 48 bp, Homo sapiens; identical to SEQ ID NO: 16524
  chr19:46321351-46321399
  hypo

SEQ ID NO: 25695 - DNA, 52 bp, Homo sapiens; identical to SEQ ID NO: 16525
  chr19:46327091-46327143
  hypo

SEQ ID NO: 25696 - DNA, 13 bp, Homo sapiens
  chr19:46404601-46404614
  hypo
gctgtgaagaggg

SEQ ID NO: 25697 - DNA, 44 bp, Homo sapiens; identical to SEQ ID NO: 16528
  chr19:47429440-47429484
  hypo

SEQ ID NO: 25698 - DNA, 42 bp, Homo sapiens; identical to SEQ ID NO: 16529
  chr19:48003498-48003540
  hypo

SEQ ID NO: 25699 - DNA, 37 bp, Homo sapiens
  chr19:48151337-48151374
  hypo
cgtctccctgttttcctgttaccgtctccccgtccct

SEQ ID NO: 25700 - DNA, 13 bp, Homo sapiens
  chr19:48614830-48614843
  hypo
aagcccagcacta

SEQ ID NO: 25701 - DNA, 97 bp, Homo sapiens
  chr19:49119132-49119229
  hypo
cttggtgtggctgtgcggggttcctggggccttgccgaaatgccggtacacctctcggcccttgcgaggacctagggaaggggaaggagaaccgggt

SEQ ID NO: 25702 - DNA, 91 bp, Homo sapiens
  chr19:49119259-49119350
  hypo
ctcccagatccaggagggtgaaggctgccagtagccacacagctcagtccaaacccgtcgaccacgtatcactcaccggagagcaggacag

SEQ ID NO: 25703 - DNA, 26 bp, Homo sapiens
  chr19:49402376-49402402
  hypo
gaggtagacaccgtctcaaaaaaaaa

SEQ ID NO: 25704 - DNA, 30 bp, Homo sapiens; identical to SEQ ID NO: 16535
  chr19:50053089-50053119
  hypo

SEQ ID NO: 25705 - DNA, 75 bp, Homo sapiens; identical to SEQ ID NO: 16536
  chr19:50166634-50166709
  hypo

SEQ ID NO: 25706 - DNA, 30 bp, Homo sapiens; identical to SEQ ID NO: 16537
  chr19:50216075-50216105
  hypo

SEQ ID NO: 25707 - DNA, 136 bp, Homo sapiens; identical to SEQ ID NO: 16538
  chr19:50216693-50216829
  hypo

SEQ ID NO: 25708 - DNA, 16 bp, Homo sapiens
  chr19:50320037-50320053
  hypo
ccggccctggtcaggt

SEQ ID NO: 25709 - DNA, 30 bp, Homo sapiens; identical to SEQ ID NO: 16540
  chr19:50353152-50353182
  hypo

SEQ ID NO: 25710 - DNA, 90 bp, Homo sapiens; identical to SEQ ID NO: 16542
  chr19:50364908-50364998
  hypo

SEQ ID NO: 25711 - DNA, 35 bp, Homo sapiens; identical to SEQ ID NO: 16544
  chr19:51046474-51046509
  hypo

SEQ ID NO: 25712 - DNA, 23 bp, Homo sapiens
  chr19:52512149-52512172
  hypo
ggttgggaaagaggccgggcgcg

SEQ ID NO: 25713 - DNA, 30 bp, Homo sapiens; identical to SEQ ID NO: 16547
  chr19:54033359-54033389
  hypo

SEQ ID NO: 25714 - DNA, 16 bp, Homo sapiens
  chr19:55727832-55727848
  hypo
gcgattagatcattga

SEQ ID NO: 25715 - DNA, 151 bp, Homo sapiens; identical to SEQ ID NO: 16549
  chr19:58457421-58457572
  hypo

SEQ ID NO: 25716 - DNA, 30 bp, Homo sapiens; identical to SEQ ID NO: 16550
  chr19:58891154-58891184
  hypo

SEQ ID NO: 25717 - DNA, 11 bp, Homo sapiens
  chr20:399996-400007
  hypo
gcttcaaggac

SEQ ID NO: 25718 - DNA, 9 bp, Homo sapiens
  chr20:401582-401591
  hypo
gaacacgga

SEQ ID NO: 25719 - DNA, 237 bp, Homo sapiens
  chr20:401756-401993
  hypo
gtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctg

SEQ ID NO: 25720 - DNA, 24 bp, Homo sapiens
  chr20:799706-799730
  hypo
gagccaccgcgccgggcccagctt

SEQ ID NO: 25721 - DNA, 41 bp, Homo sapiens; identical to SEQ ID NO: 16556
  chr20:1323452-1323493
  hypo

SEQ ID NO: 25722 - DNA, 30 bp, Homo sapiens; identical to SEQ ID NO: 16557
  chr20:1692274-1692304
  hypo

SEQ ID NO: 25723 - DNA, 147 bp, Homo sapiens; identical to SEQ ID NO: 5237
  chr20:2113428-2113575
  hypo

SEQ ID NO: 25724 - DNA, 30 bp, Homo sapiens; identical to SEQ ID NO: 16559
  chr20:2444402-2444432
  hypo

SEQ ID NO: 25725 - DNA, 32 bp, Homo sapiens; identical to SEQ ID NO: 16560
  chr20:2645508-2645540
  hypo

SEQ ID NO: 25726 - DNA, 91 bp, Homo sapiens; identical to SEQ ID NO: 16562
  chr20:3202418-3202509
  hypo

SEQ ID NO: 25727 - DNA, 23 bp, Homo sapiens
  chr20:3204952-3204975
  hypo
atgccacacgcccttactctgtg

SEQ ID NO: 25728 - DNA, 30 bp, Homo sapiens; identical to SEQ ID NO: 16564
  chr20:3763473-3763503
  hypo

SEQ ID NO: 25729 - DNA, 105 bp, Homo sapiens; identical to SEQ ID NO: 16565
  chr20:3820924-3821029
  hypo

SEQ ID NO: 25730 - DNA, 33 bp, Homo sapiens; identical to SEQ ID NO: 16566
  chr20:4690739-4690772
  hypo

SEQ ID NO: 25731 - DNA, 30 bp, Homo sapiens; identical to SEQ ID NO: 16567
  chr20:5762556-5762586
  hypo

SEQ ID NO: 25732 - DNA, 20 bp, Homo sapiens
  chr20:16554697-16554717
  hypo
taagggagttaaaggcgaac

SEQ ID NO: 25733 - DNA, 126 bp, Homo sapiens
  chr20:16555030-16555156
  hypo
tggtatcttaaggcttagggcctctggtagaagtgagctccacctcccttcctgtgtagaaggtaaatgcattcattcattcagtgaatcgagcatgcatgaaatcgtttgcgcacacccagaagc

SEQ ID NO: 25734 - DNA, 40 bp, Homo sapiens; identical to SEQ ID NO: 16570
  chr20:18233341-18233381
  hypo

SEQ ID NO: 25735 - DNA, 30 bp, Homo sapiens; identical to SEQ ID NO: 16571
  chr20:19674013-19674043
  hypo

SEQ ID NO: 25736 - DNA, 120 bp, Homo sapiens; identical to SEQ ID NO: 16572
  chr20:24571035-24571155
  hypo

SEQ ID NO: 25737 - DNA, 16 bp, Homo sapiens
  chr20:30468303-30468319
  hypo
tttttttttttgagac

SEQ ID NO: 25738 - DNA, 153 bp, Homo sapiens; identical to SEQ ID NO: 5243
  chr20:30864866-30865019
  hypo

SEQ ID NO: 25739 - DNA, 31 bp, Homo sapiens
  chr20:31115652-31115683
  hypo
aatcttccaccacagcgacccgcttcagaga

SEQ ID NO: 25740 - DNA, 18 bp, Homo sapiens
  chr20:31115799-31115817
  hypo
ggacgggcaatgcctccg

SEQ ID NO: 25741 - DNA, 160 bp, Homo sapiens; identical to SEQ ID NO: 16579
  chr20:32242529-32242689
  hypo

SEQ ID NO: 25742 - DNA, 91 bp, Homo sapiens
  chr20:32450427-32450518
  hypo
gacttcaggggcaaatgtacattgggaatctccaagggacatctcccaaactacctgaccagggtgtgggttccgccgaatatcttttggg

SEQ ID NO: 25743 - DNA, 30 bp, Homo sapiens; identical to SEQ ID NO: 16581
  chr20:32524318-32524348
  hypo

SEQ ID NO: 25744 - DNA, 30 bp, Homo sapiens; identical to SEQ ID NO: 16582
  chr20:33134914-33134944
  hypo

SEQ ID NO: 25745 - DNA, 30 bp, Homo sapiens; identical to SEQ ID NO: 16583
  chr20:33547626-33547656
  hypo

SEQ ID NO: 25746 - DNA, 30 bp, Homo sapiens; identical to SEQ ID NO: 16584
  chr20:33866905-33866935
  hypo

SEQ ID NO: 25747 - DNA, 67 bp, Homo sapiens; identical to SEQ ID NO: 16586
  chr20:35089090-35089157
  hypo

SEQ ID NO: 25748 - DNA, 34 bp, Homo sapiens; identical to SEQ ID NO: 16587
  chr20:35924375-35924409
  hypo

SEQ ID NO: 25749 - DNA, 39 bp, Homo sapiens; identical to SEQ ID NO: 16588
  chr20:36151122-36151161
  hypo

SEQ ID NO: 25750 - DNA, 30 bp, Homo sapiens; identical to SEQ ID NO: 16589
  chr20:36571234-36571264
  hypo

SEQ ID NO: 25751 - DNA, 30 bp, Homo sapiens
  chr20:42218664-42218694
  hypo
ttaatatcctagattcgaagacaaacataa

SEQ ID NO: 25752 - DNA, 128 bp, Homo sapiens; identical to SEQ ID NO: 16591
  chr20:43065628-43065756
  hypo

SEQ ID NO: 25753 - DNA, 24 bp, Homo sapiens
  chr20:43952320-43952344
  hypo
gagtttcaccgtgttagccaggat

SEQ ID NO: 25754 - DNA, 25 bp, Homo sapiens
  chr20:44601522-44601547
  hypo
gggcgctgtgagtcacgcctgtaat

SEQ ID NO: 25755 - DNA, 280 bp, Homo sapiens
  chr20:44601794-44602074
  hypo
gcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaact

SEQ ID NO: 25756 - DNA, 90 bp, Homo sapiens
  chr20:44602364-44602454
  hypo
caaacaaacaaacaaaaagtcctaaggagaagacctattaataaggagaaaaggtccgggctcggtgggtcacacctgtaataaccagca

SEQ ID NO: 25757 - DNA, 30 bp, Homo sapiens; identical to SEQ ID NO: 16596
  chr20:44756572-44756602
  hypo

SEQ ID NO: 25758 - DNA, 76 bp, Homo sapiens
  chr20:45337945-45338021
  hypo
acaagtgtggaccagtgattggggcacctcttccctgcaaagaggccaggggaagacagtgcgtgtggggtcttct

SEQ ID NO: 25759 - DNA, 95 bp, Homo sapiens; identical to SEQ ID NO: 16598
  chr20:46013566-46013661
  hypo

SEQ ID NO: 25760 - DNA, 38 bp, Homo sapiens
  chr20:47247201-47247239
  hypo
gtcctgactcctgagcgccccaccctgcccaagctccc

SEQ ID NO: 25761 - DNA, 69 bp, Homo sapiens; identical to SEQ ID NO: 16600
  chr20:47274233-47274302
  hypo

SEQ ID NO: 25762 - DNA, 184 bp, Homo sapiens; identical to SEQ ID NO: 16602
  chr20:47428537-47428721
  hypo

SEQ ID NO: 25763 - DNA, 30 bp, Homo sapiens; identical to SEQ ID NO: 16604
  chr20:48477511-48477541
  hypo

SEQ ID NO: 25764 - DNA, 16 bp, Homo sapiens
  chr20:48720810-48720826
  hypo
ccgtctcaaaaaaaaa

SEQ ID NO: 25765 - DNA, 30 bp, Homo sapiens; identical to SEQ ID NO: 16606
  chr20:48771341-48771371
  hypo

SEQ ID NO: 25766 - DNA, 30 bp, Homo sapiens; identical to SEQ ID NO: 16607
  chr20:48863456-48863486
  hypo

SEQ ID NO: 25767 - DNA, 131 bp, Homo sapiens; identical to SEQ ID NO: 16608
  chr20:49047031-49047162
  hypo

SEQ ID NO: 25768 - DNA, 33 bp, Homo sapiens; identical to SEQ ID NO: 16609
  chr20:49200517-49200550
  hypo

SEQ ID NO: 25769 - DNA, 60 bp, Homo sapiens; identical to SEQ ID NO: 16611
  chr20:49218718-49218778
  hypo

SEQ ID NO: 25770 - DNA, 42 bp, Homo sapiens
  chr20:49261761-49261803
  hypo
gagcccaggcagggacggccaaaagctcgctacccctgccca

SEQ ID NO: 25771 - DNA, 68 bp, Homo sapiens; identical to SEQ ID NO: 5247
  chr20:49286826-49286894
  hypo

SEQ ID NO: 25772 - DNA, 30 bp, Homo sapiens; identical to SEQ ID NO: 16614
  chr20:49345697-49345727
  hypo

SEQ ID NO: 25773 - DNA, 212 bp, Homo sapiens; identical to SEQ ID NO: 1639
  chr20:49346547-49346759
  hypo

SEQ ID NO: 25774 - DNA, 26 bp, Homo sapiens
  chr20:49350870-49350896
  hypo
aactaggtagtgtgccggtccttttt

SEQ ID NO: 25775 - DNA, 17 bp, Homo sapiens
  chr20:49378043-49378060
  hypo
ggcggagtttttgcgct

SEQ ID NO: 25776 - DNA, 30 bp, Homo sapiens; identical to SEQ ID NO: 16619
  chr20:49380822-49380852
  hypo

SEQ ID NO: 25777 - DNA, 36 bp, Homo sapiens; identical to SEQ ID NO: 16620
  chr20:52693155-52693191
  hypo

SEQ ID NO: 25778 - DNA, 18 bp, Homo sapiens
  chr20:53052060-53052078
  hypo
aatagctgttaaggccgg

SEQ ID NO: 25779 - DNA, 30 bp, Homo sapiens; identical to SEQ ID NO: 16622
  chr20:55693399-55693429
  hypo

SEQ ID NO: 25780 - DNA, 30 bp, Homo sapiens; identical to SEQ ID NO: 16624
  chr20:55925381-55925411
  hypo

SEQ ID NO: 25781 - DNA, 222 bp, Homo sapiens; identical to SEQ ID NO: 16625
  chr20:55958990-55959212
  hypo

SEQ ID NO: 25782 - DNA, 54 bp, Homo sapiens
  chr20:56766190-56766244
  hypo
tctggtcagttagaatcctccatcctggccgggcgcggtggctcacgcctgtaa

SEQ ID NO: 25783 - DNA, 30 bp, Homo sapiens; identical to SEQ ID NO: 16627
  chr20:57198958-57198988
  hypo

SEQ ID NO: 25784 - DNA, 30 bp, Homo sapiens; identical to SEQ ID NO: 16628
  chr20:57699792-57699822
  hypo

SEQ ID NO: 25785 - DNA, 97 bp, Homo sapiens; identical to SEQ ID NO: 16629
  chr20:58507740-58507837
  hypo

SEQ ID NO: 25786 - DNA, 236 bp, Homo sapiens; identical to SEQ ID NO: 16630
  chr20:58514132-58514368
  hypo

SEQ ID NO: 25787 - DNA, 21 bp, Homo sapiens
  chr20:59185811-59185832
  hypo
cacgcccggccgagtaaaagt

SEQ ID NO: 25788 - DNA, 7 bp, Homo sapiens
  chr20:59910346-59910353
  hypo
attatat

SEQ ID NO: 25789 - DNA, 35 bp, Homo sapiens; identical to SEQ ID NO: 16633
  chr20:60120848-60120883
  hypo

SEQ ID NO: 25790 - DNA, 30 bp, Homo sapiens; identical to SEQ ID NO: 16634
  chr20:60202364-60202394
  hypo

SEQ ID NO: 25791 - DNA, 21 bp, Homo sapiens
  chr20:60202624-60202645
  hypo
ttgtgtcgaccatgactgctt

SEQ ID NO: 25792 - DNA, 90 bp, Homo sapiens
  chr20:60238291-60238381
  hypo
cagaggagctttcatcgagggcttggcgcccacgacaaatgagtccacgcaggaaaggagtggcacccgcaggaggcctgtgctgcggag

SEQ ID NO: 25793 - DNA, 30 bp, Homo sapiens; identical to SEQ ID NO: 16638
  chr20:60281435-60281465
  hypo

SEQ ID NO: 25794 - DNA, 150 bp, Homo sapiens; identical to SEQ ID NO: 16641
  chr20:60385207-60385357
  hypo

SEQ ID NO: 25795 - DNA, 30 bp, Homo sapiens; identical to SEQ ID NO: 16642
  chr20:60428191-60428221
  hypo

SEQ ID NO: 25796 - DNA, 30 bp, Homo sapiens; identical to SEQ ID NO: 16643
  chr20:60448710-60448740
  hypo

SEQ ID NO: 25797 - DNA, 30 bp, Homo sapiens; identical to SEQ ID NO: 16645
  chr20:60502281-60502311
  hypo

SEQ ID NO: 25798 - DNA, 182 bp, Homo sapiens
  chr20:60502848-60503030
  hypo
gtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatgg

SEQ ID NO: 25799 - DNA, 155 bp, Homo sapiens; identical to SEQ ID NO: 16648
  chr20:60781351-60781506
  hypo

SEQ ID NO: 25800 - DNA, 23 bp, Homo sapiens
  chr20:60790124-60790147
  hypo
tggcgaagcggcccctgcccggg

SEQ ID NO: 25801 - DNA, 40 bp, Homo sapiens; identical to SEQ ID NO: 16650
  chr20:60925501-60925541
  hypo

SEQ ID NO: 25802 - DNA, 70 bp, Homo sapiens; identical to SEQ ID NO: 16651
  chr20:60925868-60925938
  hypo

SEQ ID NO: 25803 - DNA, 96 bp, Homo sapiens; identical to SEQ ID NO: 16652
  chr20:60953312-60953408
  hypo

SEQ ID NO: 25804 - DNA, 20 bp, Homo sapiens
  chr20:60970933-60970953
  hypo
ctctcagggtgcagccggtg

SEQ ID NO: 25805 - DNA, 30 bp, Homo sapiens; identical to SEQ ID NO: 16655
  chr20:60984485-60984515
  hypo

SEQ ID NO: 25806 - DNA, 5 bp, Homo sapiens
  chr20:61288063-61288068
  hypo
cggct

SEQ ID NO: 25807 - DNA, 307 bp, Homo sapiens
  chr20:61288156-61288463
  hypo
gatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagc

SEQ ID NO: 25808 - DNA, 30 bp, Homo sapiens; identical to SEQ ID NO: 16657
  chr20:61294663-61294693
  hypo

SEQ ID NO: 25809 - DNA, 30 bp, Homo sapiens; identical to SEQ ID NO: 16658
  chr20:61312730-61312760
  hypo

SEQ ID NO: 25810 - DNA, 52 bp, Homo sapiens; identical to SEQ ID NO: 16659
  chr20:61393835-61393887
  hypo

SEQ ID NO: 25811 - DNA, 109 bp, Homo sapiens; identical to SEQ ID NO: 16661
  chr20:61570765-61570874
  hypo

SEQ ID NO: 25812 - DNA, 30 bp, Homo sapiens; identical to SEQ ID NO: 16662
  chr20:61695664-61695694
  hypo

SEQ ID NO: 25813 - DNA, 136 bp, Homo sapiens; identical to SEQ ID NO: 16663
  chr20:61725275-61725411
  hypo

SEQ ID NO: 25814 - DNA, 30 bp, Homo sapiens; identical to SEQ ID NO: 16665
  chr20:61838532-61838562
  hypo

SEQ ID NO: 25815 - DNA, 297 bp, Homo sapiens
  chr20:61973894-61974191
  hypo
agcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcag

SEQ ID NO: 25816 - DNA, 6 bp, Homo sapiens
  chr20:61974354-61974360
  hypo
gcagac

SEQ ID NO: 25817 - DNA, 45 bp, Homo sapiens
  chr20:61980815-61980860
  hypo
tcagcctgggacctgcggccacatagcaggcttgggaagaggctg

SEQ ID NO: 25818 - DNA, 30 bp, Homo sapiens; identical to SEQ ID NO: 16668
  chr20:61982304-61982334
  hypo

SEQ ID NO: 25819 - DNA, 35 bp, Homo sapiens; identical to SEQ ID NO: 16669
  chr20:61990913-61990948
  hypo

SEQ ID NO: 25820 - DNA, 30 bp, Homo sapiens; identical to SEQ ID NO: 16670
  chr20:62011933-62011963
  hypo

SEQ ID NO: 25821 - DNA, 66 bp, Homo sapiens; identical to SEQ ID NO: 5253
  chr20:62031666-62031732
  hypo

SEQ ID NO: 25822 - DNA, 82 bp, Homo sapiens
  chr20:62031976-62032058
  hypo
agccagaggcaacggcgcaaatggggaagctgcagccaccgtcacggccagaggatggcagactgcaatggcgtggggcgcg

SEQ ID NO: 25823 - DNA, 53 bp, Homo sapiens; identical to SEQ ID NO: 16673
  chr20:62033547-62033600
  hypo

SEQ ID NO: 25824 - DNA, 30 bp, Homo sapiens; identical to SEQ ID NO: 16674
  chr20:62038095-62038125
  hypo

SEQ ID NO: 25825 - DNA, 41 bp, Homo sapiens; identical to SEQ ID NO: 16675
  chr20:62038570-62038611
  hypo

SEQ ID NO: 25826 - DNA, 26 bp, Homo sapiens
  chr20:62046201-62046227
  hypo
caccacatccatccccggagaggatg

SEQ ID NO: 25827 - DNA, 89 bp, Homo sapiens
  chr20:62046421-62046510
  hypo
cttggcagccacgcctcgggggctggagaagacacgatctttcaaactgaccttctggctgctcccacgggaaccgacagacagacaga

SEQ ID NO: 25828 - DNA, 113 bp, Homo sapiens; identical to SEQ ID NO: 16677
  chr20:62053226-62053339
  hypo

SEQ ID NO: 25829 - DNA, 38 bp, Homo sapiens; identical to SEQ ID NO: 16678
  chr20:62054264-62054302
  hypo

SEQ ID NO: 25830 - DNA, 24 bp, Homo sapiens
  chr20:62090500-62090524
  hypo
acctgagggcaggctcggcaagga

SEQ ID NO: 25831 - DNA, 39 bp, Homo sapiens; identical to SEQ ID NO: 16681
  chr20:62097848-62097887
  hypo

SEQ ID NO: 25832 - DNA, 37 bp, Homo sapiens
  chr20:62126081-62126118
  hypo
cacctgccggtgcctcgctctgggccagggggtccag

SEQ ID NO: 25833 - DNA, 40 bp, Homo sapiens; identical to SEQ ID NO: 16684
  chr20:62153405-62153445
  hypo

SEQ ID NO: 25834 - DNA, 33 bp, Homo sapiens
  chr20:62165598-62165631
  hypo
tcgttcaggtgcagccggcccccggcacgccgc

SEQ ID NO: 25835 - DNA, 73 bp, Homo sapiens
  chr20:62165762-62165835
  hypo
tccccacagttgctgttggtgcttcctcagtaccacccctgcctcccctccctcagaacggctccctcctgcc

SEQ ID NO: 25836 - DNA, 30 bp, Homo sapiens; identical to SEQ ID NO: 16686
  chr20:62167765-62167795
  hypo

SEQ ID NO: 25837 - DNA, 30 bp, Homo sapiens; identical to SEQ ID NO: 16687
  chr20:62168240-62168270
  hypo

SEQ ID NO: 25838 - DNA, 16 bp, Homo sapiens
  chr20:62170163-62170179
  hypo
atgtccaggaagcctc

SEQ ID NO: 25839 - DNA, 278 bp, Homo sapiens
  chr20:62172667-62172945
  hypo
cttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggc

SEQ ID NO: 25840 - DNA, 32 bp, Homo sapiens; identical to SEQ ID NO: 16690
  chr20:62221371-62221403
  hypo

SEQ ID NO: 25841 - DNA, 283 bp, Homo sapiens
  chr20:62320923-62321206
  hypo
ccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcct

SEQ ID NO: 25842 - DNA, 52 bp, Homo sapiens
  chr20:62321341-62321393
  hypo
agcgtggggcccctgcagcagatgagggtcttcacttcggtgaactgaaccc

SEQ ID NO: 25843 - DNA, 30 bp, Homo sapiens; identical to SEQ ID NO: 16693
  chr20:62329526-62329556
  hypo

SEQ ID NO: 25844 - DNA, 29 bp, Homo sapiens
  chr20:62383189-62383218
  hypo
tctcccatgaagccccgccccccggtggg

SEQ ID NO: 25845 - DNA, 147 bp, Homo sapiens
  chr20:62383289-62383436
  hypo
cagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccc

SEQ ID NO: 25846 - DNA, 30 bp, Homo sapiens; identical to SEQ ID NO: 16695
  chr20:62384067-62384097
  hypo

SEQ ID NO: 25847 - DNA, 71 bp, Homo sapiens; identical to SEQ ID NO: 16696
  chr20:62400829-62400900
  hypo

SEQ ID NO: 25848 - DNA, 35 bp, Homo sapiens; identical to SEQ ID NO: 16697
  chr20:62481615-62481650
  hypo

SEQ ID NO: 25849 - DNA, 69 bp, Homo sapiens
  chr20:62488224-62488293
  hypo
aaaaaaagaaaagaaaagaagaaaagaaaagcccctagaggccagggtccttgaacaaaagtgcgcgat

SEQ ID NO: 25850 - DNA, 80 bp, Homo sapiens
  chr20:62488350-62488430
  hypo
acacagtggtgccagggcaggaaccctgggggcatttgcaggcctgtgctgcgagactgcagtggcgctcaggacacacc

SEQ ID NO: 25851 - DNA, 144 bp, Homo sapiens; identical to SEQ ID NO: 16699
  chr20:62722776-62722920
  hypo

SEQ ID NO: 25852 - DNA, 36 bp, Homo sapiens; identical to SEQ ID NO: 16700
  chr20:62762699-62762735
  hypo

SEQ ID NO: 25853 - DNA, 79 bp, Homo sapiens; identical to SEQ ID NO: 16701
  chr21:15694241-15694320
  hypo

SEQ ID NO: 25854 - DNA, 30 bp, Homo sapiens; identical to SEQ ID NO: 16702
  chr21:20360095-20360125
  hypo

SEQ ID NO: 25855 - DNA, 95 bp, Homo sapiens; identical to SEQ ID NO: 16704
  chr21:34459377-34459472
  hypo

SEQ ID NO: 25856 - DNA, 30 bp, Homo sapiens; identical to SEQ ID NO: 16705
  chr21:37750050-37750080
  hypo

SEQ ID NO: 25857 - DNA, 78 bp, Homo sapiens
  chr21:37758492-37758570
  hypo
acttccagcatgggacggctgggaggatccacagactggcgtctgccggcgtggacaccaatgtcagggtaaactggg

SEQ ID NO: 25858 - DNA, 17 bp, Homo sapiens
  chr21:37775141-37775158
  hypo
cacgccaggtgtgtttc

SEQ ID NO: 25859 - DNA, 63 bp, Homo sapiens; identical to SEQ ID NO: 16709
  chr21:38935380-38935443
  hypo

SEQ ID NO: 25860 - DNA, 30 bp, Homo sapiens; identical to SEQ ID NO: 16710
  chr21:42613756-42613786
  hypo

SEQ ID NO: 25861 - DNA, 195 bp, Homo sapiens; identical to SEQ ID NO: 16711
  chr21:43248726-43248921
  hypo

SEQ ID NO: 25862 - DNA, 125 bp, Homo sapiens
  chr21:43786558-43786683
  hypo
acaccaggaccagggcgcagatcaccttgttctccatggtggccattgcctcctctctgctccaaaggcgaccccgagtcagggatgagaggccgcccgagccccggattttatagggcaggctc

SEQ ID NO: 25863 - DNA, 28 bp, Homo sapiens
  chr21:43786713-43786741
  hypo
gcctaaggaggcccggggatcctctgag

SEQ ID NO: 25864 - DNA, 30 bp, Homo sapiens; identical to SEQ ID NO: 16713
  chr21:44338342-44338372
  hypo

SEQ ID NO: 25865 - DNA, 192 bp, Homo sapiens
  chr21:44866711-44866903
  hypo
gctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcac

SEQ ID NO: 25866 - DNA, 57 bp, Homo sapiens; identical to SEQ ID NO: 16716
  chr21:45170351-45170408
  hypo

SEQ ID NO: 25867 - DNA, 9 bp, Homo sapiens
  chr21:45195319-45195328
  hypo
acagggaag

SEQ ID NO: 25868 - DNA, 30 bp, Homo sapiens; identical to SEQ ID NO: 16718
  chr21:45232947-45232977
  hypo

SEQ ID NO: 25869 - DNA, 30 bp, Homo sapiens; identical to SEQ ID NO: 16719
  chr21:45247147-45247177
  hypo

SEQ ID NO: 25870 - DNA, 30 bp, Homo sapiens; identical to SEQ ID NO: 16721
  chr21:45365737-45365767
  hypo

SEQ ID NO: 25871 - DNA, 62 bp, Homo sapiens; identical to SEQ ID NO: 16722
  chr21:45844751-45844813
  hypo

SEQ ID NO: 25872 - DNA, 132 bp, Homo sapiens; identical to SEQ ID NO: 16723
  chr21:45929217-45929349
  hypo

SEQ ID NO: 25873 - DNA, 30 bp, Homo sapiens; identical to SEQ ID NO: 16724
  chr21:46015435-46015465
  hypo

SEQ ID NO: 25874 - DNA, 37 bp, Homo sapiens
  chr21:46036605-46036642
  hypo
gtgagaatgagacaccgtgacaatgcggctgcgcacc

SEQ ID NO: 25875 - DNA, 60 bp, Homo sapiens
  chr21:46036767-46036827
  hypo
gtgtattttttgtctgacttttgcttctggggccgaacaacccagcgaattcaacacagc

SEQ ID NO: 25876 - DNA, 30 bp, Homo sapiens; identical to SEQ ID NO: 16726
  chr21:46068645-46068675
  hypo

SEQ ID NO: 25877 - DNA, 112 bp, Homo sapiens; identical to SEQ ID NO: 16727
  chr21:46256944-46257056
  hypo

SEQ ID NO: 25878 - DNA, 30 bp, Homo sapiens; identical to SEQ ID NO: 16728
  chr21:46257286-46257316
  hypo

SEQ ID NO: 25879 - DNA, 196 bp, Homo sapiens; identical to SEQ ID NO: 16729
  chr21:46308621-46308817
  hypo

SEQ ID NO: 25880 - DNA, 157 bp, Homo sapiens; identical to SEQ ID NO: 16730
  chr21:46310607-46310764
  hypo

SEQ ID NO: 25881 - DNA, 30 bp, Homo sapiens; identical to SEQ ID NO: 16731
  chr21:46311771-46311801
  hypo

SEQ ID NO: 25882 - DNA, 46 bp, Homo sapiens
  chr21:46319459-46319505
  hypo
gagggccgtccctcccgtctgtggctcccggcggaggacctgagtc

SEQ ID NO: 25883 - DNA, 30 bp, Homo sapiens; identical to SEQ ID NO: 16733
  chr21:46321598-46321628
  hypo

SEQ ID NO: 25884 - DNA, 94 bp, Homo sapiens
  chr21:46452280-46452374
  hypo
ctggtcttggggaggcgggctccagctcgaaaggaggcacacaaaactgctgggaaacgggccgggcaggcaggggcggggccgggcgggtgag

SEQ ID NO: 25885 - DNA, 32 bp, Homo sapiens; identical to SEQ ID NO: 16735
  chr21:46677808-46677840
  hypo

SEQ ID NO: 25886 - DNA, 43 bp, Homo sapiens; identical to SEQ ID NO: 16736
  chr21:46844706-46844749
  hypo

SEQ ID NO: 25887 - DNA, 34 bp, Homo sapiens; identical to SEQ ID NO: 16737
  chr21:46863752-46863786
  hypo

SEQ ID NO: 25888 - DNA, 50 bp, Homo sapiens; identical to SEQ ID NO: 16738
  chr21:46908931-46908981
  hypo

SEQ ID NO: 25889 - DNA, 127 bp, Homo sapiens; identical to SEQ ID NO: 16739
  chr21:46912135-46912262
  hypo

SEQ ID NO: 25890 - DNA, 57 bp, Homo sapiens; identical to SEQ ID NO: 16740
  chr21:46921503-46921560
  hypo

SEQ ID NO: 25891 - DNA, 26 bp, Homo sapiens
  chr21:46925754-46925780
  hypo
aggctctgggctacacgccaggccat

SEQ ID NO: 25892 - DNA, 19 bp, Homo sapiens
  chr21:46926565-46926584
  hypo
catccgtgggagcctccat

SEQ ID NO: 25893 - DNA, 30 bp, Homo sapiens; identical to SEQ ID NO: 16743
  chr21:47013235-47013265
  hypo

SEQ ID NO: 25894 - DNA, 48 bp, Homo sapiens; identical to SEQ ID NO: 16744
  chr21:47287102-47287150
  hypo

SEQ ID NO: 25895 - DNA, 39 bp, Homo sapiens
  chr21:47404135-47404174
  hypo
gcgccaggggccgcccgcctcacgcccgccgtgcctgtt

SEQ ID NO: 25896 - DNA, 30 bp, Homo sapiens; identical to SEQ ID NO: 16746
  chr21:47425521-47425551
  hypo

SEQ ID NO: 25897 - DNA, 30 bp, Homo sapiens; identical to SEQ ID NO: 16747
  chr21:47501864-47501894
  hypo

SEQ ID NO: 25898 - DNA, 34 bp, Homo sapiens; identical to SEQ ID NO: 16748
  chr21:47503061-47503095
  hypo

SEQ ID NO: 25899 - DNA, 37 bp, Homo sapiens; identical to SEQ ID NO: 16749
  chr21:47531922-47531959
  hypo

SEQ ID NO: 25900 - DNA, 37 bp, Homo sapiens; identical to SEQ ID NO: 16750
  chr21:47737928-47737965
  hypo

SEQ ID NO: 25901 - DNA, 92 bp, Homo sapiens
  chr21:47746178-47746270
  hypo
gactgggtcagccctcgggcctcatggtccccaccagtctgttgactttgtggttctgttatttttttctcacttacctttgcctttactac

SEQ ID NO: 25902 - DNA, 16 bp, Homo sapiens
  chr22:18110631-18110647
  hypo
acgaccttgtcaaaac

SEQ ID NO: 25903 - DNA, 30 bp, Homo sapiens; identical to SEQ ID NO: 16753
  chr22:18553893-18553923
  hypo

SEQ ID NO: 25904 - DNA, 27 bp, Homo sapiens
  chr22:19117537-19117564
  hypo
catgcactgcagccccgacccacccat

SEQ ID NO: 25905 - DNA, 26 bp, Homo sapiens
  chr22:21214345-21214371
  hypo
aacaattattctggccgagcgcagtg

SEQ ID NO: 25906 - DNA, 250 bp, Homo sapiens; identical to SEQ ID NO: 16757
  chr22:22899696-22899946
  hypo

SEQ ID NO: 25907 - DNA, 42 bp, Homo sapiens; identical to SEQ ID NO: 16758
  chr22:24374229-24374271
  hypo

SEQ ID NO: 25908 - DNA, 30 bp, Homo sapiens; identical to SEQ ID NO: 16759
  chr22:27045927-27045957
  hypo

SEQ ID NO: 25909 - DNA, 83 bp, Homo sapiens; identical to SEQ ID NO: 16760
  chr22:29445929-29446012
  hypo

SEQ ID NO: 25910 - DNA, 30 bp, Homo sapiens; identical to SEQ ID NO: 16761
  chr22:29446295-29446325
  hypo

SEQ ID NO: 25911 - DNA, 18 bp, Homo sapiens
  chr22:29701031-29701049
  hypo
gcccggccgggaatgtta

SEQ ID NO: 25912 - DNA, 29 bp, Homo sapiens
  chr22:29977934-29977963
  hypo
tagggagtggaagccgtcctcttgtgctg

SEQ ID NO: 25913 - DNA, 27 bp, Homo sapiens
  chr22:29998650-29998677
  hypo
aataataattctaggcggggcgtggtg

SEQ ID NO: 25914 - DNA, 38 bp, Homo sapiens; identical to SEQ ID NO: 16767
  chr22:30783975-30784013
  hypo

SEQ ID NO: 25915 - DNA, 35 bp, Homo sapiens; identical to SEQ ID NO: 16768
  chr22:32014233-32014268
  hypo

SEQ ID NO: 25916 - DNA, 29 bp, Homo sapiens
  chr22:32356777-32356806
  hypo
aaaaactccgtccccgccccccccccccc

SEQ ID NO: 25917 - DNA, 30 bp, Homo sapiens; identical to SEQ ID NO: 16770
  chr22:33255298-33255328
  hypo

SEQ ID NO: 25918 - DNA, 30 bp, Homo sapiens; identical to SEQ ID NO: 5265
  chr22:35079354-35079384
  hypo

SEQ ID NO: 25919 - DNA, 30 bp, Homo sapiens; identical to SEQ ID NO: 5266
  chr22:35768487-35768517
  hypo

SEQ ID NO: 25920 - DNA, 30 bp, Homo sapiens; identical to SEQ ID NO: 16773
  chr22:35822752-35822782
  hypo

SEQ ID NO: 25921 - DNA, 40 bp, Homo sapiens; identical to SEQ ID NO: 16774
  chr22:36585960-36586000
  hypo

SEQ ID NO: 25922 - DNA, 58 bp, Homo sapiens; identical to SEQ ID NO: 16775
  chr22:36684241-36684299
  hypo

SEQ ID NO: 25923 - DNA, 30 bp, Homo sapiens; identical to SEQ ID NO: 16776
  chr22:36878964-36878994
  hypo

SEQ ID NO: 25924 - DNA, 57 bp, Homo sapiens; identical to SEQ ID NO: 16777
  chr22:36902482-36902539
  hypo

SEQ ID NO: 25925 - DNA, 26 bp, Homo sapiens
  chr22:38199743-38199769
  hypo
taagtgaacagtgaccggcctctatg

SEQ ID NO: 25926 - DNA, 30 bp, Homo sapiens; identical to SEQ ID NO: 16779
  chr22:38520276-38520306
  hypo

SEQ ID NO: 25927 - DNA, 44 bp, Homo sapiens; identical to SEQ ID NO: 16780
  chr22:38578694-38578738
  hypo

SEQ ID NO: 25928 - DNA, 43 bp, Homo sapiens; identical to SEQ ID NO: 16781
  chr22:38694550-38694593
  hypo

SEQ ID NO: 25929 - DNA, 30 bp, Homo sapiens; identical to SEQ ID NO: 16782
  chr22:39757008-39757038
  hypo

SEQ ID NO: 25930 - DNA, 165 bp, Homo sapiens; identical to SEQ ID NO: 16783
  chr22:40018163-40018328
  hypo

SEQ ID NO: 25931 - DNA, 37 bp, Homo sapiens
  chr22:40042590-40042627
  hypo
gatcaacctgtgcctcgttgtcatagcgacccagttc

SEQ ID NO: 25932 - DNA, 117 bp, Homo sapiens
  chr22:40042743-40042860
  hypo
gtatgtctgccacatcctgcgcaaggccaagcgccgcgccctgggcctctaccaggccctgcagagccggcgccaggccctgggcccggaggccccggcccccgccaaacctgggcc

SEQ ID NO: 25933 - DNA, 16 bp, Homo sapiens
  chr22:40991414-40991430
  hypo
gcgcccggccgagaaa

SEQ ID NO: 25934 - DNA, 30 bp, Homo sapiens; identical to SEQ ID NO: 16787
  chr22:41637166-41637196
  hypo

SEQ ID NO: 25935 - DNA, 17 bp, Homo sapiens
  chr22:41839926-41839943
  hypo
gccggaaggtttttcag

SEQ ID NO: 25936 - DNA, 37 bp, Homo sapiens; identical to SEQ ID NO: 16789
  chr22:42109085-42109122
  hypo

SEQ ID NO: 25937 - DNA, 30 bp, Homo sapiens; identical to SEQ ID NO: 16790
  chr22:42995705-42995735
  hypo

SEQ ID NO: 25938 - DNA, 30 bp, Homo sapiens; identical to SEQ ID NO: 16792
  chr22:43083005-43083035
  hypo

SEQ ID NO: 25939 - DNA, 92 bp, Homo sapiens; identical to SEQ ID NO: 16794
  chr22:43524971-43525063
  hypo

SEQ ID NO: 25940 - DNA, 30 bp, Homo sapiens; identical to SEQ ID NO: 16795
  chr22:43581330-43581360
  hypo

SEQ ID NO: 25941 - DNA, 197 bp, Homo sapiens; identical to SEQ ID NO: 16796
  chr22:43601102-43601299
  hypo

SEQ ID NO: 25942 - DNA, 107 bp, Homo sapiens
  chr22:44455600-44455707
  hypo
aataaagaaagatgccgtacacattttcctttaaaaagtctcacttggcttgtttgacaggcacagaagatgtgttattaaacacttgcaaagcctgctgtcatttg

SEQ ID NO: 25943 - DNA, 39 bp, Homo sapiens; identical to SEQ ID NO: 16798
  chr22:44538737-44538776
  hypo

SEQ ID NO: 25944 - DNA, 30 bp, Homo sapiens; identical to SEQ ID NO: 16799
  chr22:44580569-44580599
  hypo

SEQ ID NO: 25945 - DNA, 23 bp, Homo sapiens
  chr22:45088743-45088766
  hypo
tctcagcacggggccaggcacag

SEQ ID NO: 25946 - DNA, 51 bp, Homo sapiens; identical to SEQ ID NO: 16802
  chr22:46929253-46929304
  hypo

SEQ ID NO: 25947 - DNA, 41 bp, Homo sapiens; identical to SEQ ID NO: 16803
  chr22:46929668-46929709
  hypo

SEQ ID NO: 25948 - DNA, 44 bp, Homo sapiens; identical to SEQ ID NO: 16804
  chr22:46931911-46931955
  hypo

SEQ ID NO: 25949 - DNA, 30 bp, Homo sapiens; identical to SEQ ID NO: 16806
  chr22:47005505-47005535
  hypo

SEQ ID NO: 25950 - DNA, 30 bp, Homo sapiens; identical to SEQ ID NO: 16807
  chr22:47054582-47054612
  hypo

SEQ ID NO: 25951 - DNA, 132 bp, Homo sapiens
  chr22:47525714-47525846
  hypo
tgtcagcgtcactgccgctgagtcaccacgtgcactgtgcctgtcatccctttctgggacagcatgtcactttccttggtgtcaccaatcatctcccttaggagtctgtgaaccacccactccctccctccc

SEQ ID NO: 25952 - DNA, 39 bp, Homo sapiens
  chr22:47525885-47525924
  hypo
aggcagagcaggtgctgtacacctcgtgtcctctgggac

SEQ ID NO: 25953 - DNA, 46 bp, Homo sapiens
  chr22:48931835-48931881
  hypo
gagtgcccgtgttgtcgagcccccgccacagagctgcaccgccgct

SEQ ID NO: 25954 - DNA, 41 bp, Homo sapiens
  chr22:48932027-48932068
  hypo
gcagggacttggaaacctaccgtccccggctcaaggcaaat

SEQ ID NO: 25955 - DNA, 167 bp, Homo sapiens; identical to SEQ ID NO: 16810
  chr22:49115643-49115810
  hypo

SEQ ID NO: 25956 - DNA, 30 bp, Homo sapiens; identical to SEQ ID NO: 16811
  chr22:49117093-49117123
  hypo

SEQ ID NO: 25957 - DNA, 30 bp, Homo sapiens; identical to SEQ ID NO: 16812
  chr22:49387651-49387681
  hypo

SEQ ID NO: 25958 - DNA, 30 bp, Homo sapiens; identical to SEQ ID NO: 16813
  chr22:49831409-49831439
  hypo

SEQ ID NO: 25959 - DNA, 30 bp, Homo sapiens; identical to SEQ ID NO: 16814
  chr22:49941803-49941833
  hypo

SEQ ID NO: 25960 - DNA, 33 bp, Homo sapiens
  chr22:49979613-49979646
  hypo
accccatccctgggccggggctgaccggtcatc

SEQ ID NO: 25961 - DNA, 14 bp, Homo sapiens
  chr22:50001685-50001699
  hypo
gcctctcctgggtg

SEQ ID NO: 25962 - DNA, 16 bp, Homo sapiens
  chr22:50002771-50002787
  hypo
ggacagtccctgcttc

SEQ ID NO: 25963 - DNA, 48 bp, Homo sapiens
  chr22:50003234-50003282
  hypo
agggtctctgaggggtggacacaaaacagggaccgcagtctgtgcctc

SEQ ID NO: 25964 - DNA, 30 bp, Homo sapiens; identical to SEQ ID NO: 16819
  chr22:50007987-50008017
  hypo

SEQ ID NO: 25965 - DNA, 30 bp, Homo sapiens; identical to SEQ ID NO: 16820
  chr22:50010606-50010636
  hypo

SEQ ID NO: 25966 - DNA, 30 bp, Homo sapiens; identical to SEQ ID NO: 16821
  chr22:50024083-50024113
  hypo

SEQ ID NO: 25967 - DNA, 99 bp, Homo sapiens
  chr22:50149332-50149431
  hypo
ccctttccatggcaacgacccataaggtgccacccctttccatggcaacgccccatacggtgccacccctttccatggcaacgccccatacggtgccac

SEQ ID NO: 25968 - DNA, 36 bp, Homo sapiens; identical to SEQ ID NO: 16823
  chr22:50170666-50170702
  hypo

SEQ ID NO: 25969 - DNA, 43 bp, Homo sapiens
  chr22:50466962-50467005
  hypo
tgggaatcagggaggcggcaacacctgcgtgccgtcataaaga

SEQ ID NO: 25970 - DNA, 4 bp, Homo sapiens
  chr22:50467035-50467039
  hypo
caca

SEQ ID NO: 25971 - DNA, 105 bp, Homo sapiens; identical to SEQ ID NO: 16825
  chr22:50507059-50507164
  hypo

SEQ ID NO: 25972 - DNA, 30 bp, Homo sapiens; identical to SEQ ID NO: 16826
  chr22:50529568-50529598
  hypo

SEQ ID NO: 25973 - DNA, 30 bp, Homo sapiens; identical to SEQ ID NO: 16827
  chr22:50686625-50686655
  hypo

SEQ ID NO: 25974 - DNA, 37 bp, Homo sapiens; identical to SEQ ID NO: 16828
  chr22:50695483-50695520
  hypo

SEQ ID NO: 25975 - DNA, 14 bp, Homo sapiens
  chr22:50899279-50899293
  hypo
tcacacgaaggcaa

SEQ ID NO: 25976 - DNA, 17 bp, Homo sapiens
  chr22:50899672-50899689
  hypo
agcgcagccaccgggaa

SEQ ID NO: 25977 - DNA, 38 bp, Homo sapiens; identical to SEQ ID NO: 16830
  chrX:20160933-20160971
  hypo

SEQ ID NO: 25978 - DNA, 21 bp, Homo sapiens
  chrX:44755607-44755628
  hypo
tcaccgcgcccggccaaaaat

SEQ ID NO: 25979 - DNA, 30 bp, Homo sapiens; identical to SEQ ID NO: 16832
  AEKP01139090.1_11256-14570:719-749
  hypo

SEQ ID NO: 25980 - DNA, 86 bp, Homo sapiens; identical to SEQ ID NO: 16833
  AEKP01153556.1_1-5252:404-490
  hypo

SEQ ID NO: 25981 - DNA, 126 bp, Homo sapiens; identical to SEQ ID NO: 16834
  AEKP01196136.1_22995-25251:484-610
  hypo

SEQ ID NO: 25982 - DNA, 34 bp, Homo sapiens; identical to SEQ ID NO: 16835
  NW_001838014.1_249000-295694:4094-4128
  hypo

SEQ ID NO: 25983 - DNA, 37 bp, Homo sapiens; identical to SEQ ID NO: 16836
  NW_001841145.1_177495-186900:5222-5259
  hypo

SEQ ID NO: 25984 - DNA, 30 bp, Homo sapiens; identical to SEQ ID NO: 16837
  NW_001841145.1_90215-97412:6862-6892
  hypo

SEQ ID NO: 25985 - DNA, 282 bp, Homo sapiens
  chr1:840722-841004
  hyper
cgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagc

SEQ ID NO: 25986 - DNA, 49 bp, Homo sapiens
  chr1:975817-975866
  hyper
atccctggagaggcccggggctggcgggaatcctcggcgggcggggtct

SEQ ID NO: 25987 - DNA, 30 bp, Homo sapiens
  chr1:1355593-1355623
  hyper
cagcagctccagcaccgccagccgcccgcc

SEQ ID NO: 25988 - DNA, 107 bp, Homo sapiens; identical to SEQ ID NO: 1645
  chr1:1475537-1475644
  hyper

SEQ ID NO: 25989 - DNA, 15 bp, Homo sapiens
  chr1:1476254-1476269
  hyper
cggtcctggaggggc

SEQ ID NO: 25990 - DNA, 187 bp, Homo sapiens
  chr1:1535001-1535188
  hyper
cgcggcaggaggccccgaggagcacgcgctcgcacgggaagcgcgtgtaggcgccgcgccacgagcagttgagcgcgaaggcgcgcacgcggcgcgcggcggccggggccaggcgccactgcaggaggacgctgcggttgcgcaggacgctggcgcgcagggagcggccggccggggcgtgcagcac

SEQ ID NO: 25991 - DNA, 135 bp, Homo sapiens
  chr1:1535782-1535917
  hyper
ctcacgggctgtggccggcttcgtttcgcgtcgtgcagctccgcgaccgcccgtggccacaccagtcggggacttcgtgctttacgatgggggcgcagcggtctggcacgcgcaggaccccgggccttgcacccc

SEQ ID NO: 25992 - DNA, 39 bp, Homo sapiens
  chr1:1567286-1567325
  hyper
cttcgctcccccctccgaggaccccgcccagcaggccat

SEQ ID NO: 25993 - DNA, 132 bp, Homo sapiens
  chr1:1567781-1567913
  hyper
gggttgggggggtcctcacgtctgtgggtctggtctatcggggggcccgcaggacgtgtgcggggtgtgcggggtgtttgagggtccggatgtgcgtcccgaggtcggagggttggacgcccctgtgtccag

SEQ ID NO: 25994 - DNA, 169 bp, Homo sapiens
  chr1:1935385-1935554
  hyper
ggaggtcgcgggccccgaggcgcggctgaagggccaggccacaggccgcggggcggggacgtctccggggtcccagacagccaggcctggcccagggccaaggcttggaggtgacagacagacttggggggcctggaggagctcagcaccggcgcgttggcccagagga

SEQ ID NO: 25995 - DNA, 779 bp, Homo sapiens
  chr1:1950582-1951361
  hyper
cggagagccagaccccggccagggagagctgcccgcgagggagggggcgcggctggcggaggggggcgggatggggcggggggcggggggaggagaggggagcggcgggcggggccgggctgcagggagcggcgggctggggcgggctcggggcgggctccgcgctccgtccgccccctcgcgcccgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccaggtgagcgggcggggtccgcgcggcgcggggtcgggggcggtggggggcccgcgtcggcccgagatagcggctgggagagcggccggcgcgagccccgggccccggaccccaagtctgagagccccgcgtcctccctccccggggtcttgccccgcgggcccctcgttggactcgcccggacgctgcccttgggctcgggacgcggcgacccccgcgctggccgcccccgcccggtgctgtccgccgtcctggtgctgaacctgggctgggcgagggcgtcggagcctcccggttcccctgctccgcggcgcgcgtggagggtccccgggtccgcggcactcgcgggtccctgcccggcgggtgccttgaggagaggaaagacctgagaactcggtgcggggaggctgctccctttgcgggggagccgttcc

SEQ ID NO: 25996 - DNA, 44 bp, Homo sapiens
  chr1:2136044-2136088
  hyper
gggagccggagaacccgcaggacgtcagccgggtggattccctc

SEQ ID NO: 25997 - DNA, 146 bp, Homo sapiens
  chr1:2136893-2137039
  hyper
tccacaggcccagcccggcgcgcgccgctcgttctgcgacctccagggcgagcgcgcttccggggcggccgtgcaagaggcgtgggaagcgcgcggggggttctgagcgtgcagtcgccgcctgcggacggcgaaggggcgggtga

SEQ ID NO: 25998 - DNA, 675 bp, Homo sapiens
  chr1:2374950-2375625
  hyper
gggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgagctctccggatggcctcaggt

SEQ ID NO: 25999 - DNA, 30 bp, Homo sapiens
  chr1:2472253-2472283
  hyper
tggttaaaaaccccgcggtgtcagagagca

SEQ ID NO: 26000 - DNA, 482 bp, Homo sapiens
  chr1:2560443-2560925
  hyper
gcgccccccaccctccgggagtccggcggaggcggaggcggaggcggaggcgggcgggtgcggagctgcagaagcagcgcgcgggagtcggggccggggcagagctttctggaagggaccgcgggctccctgcaggtcagtgcccctcccgccgcctctgagtccgcagctcggccccgggagcccctgggtgcccagtgcagacccacctgccccatctgacgggcgggctcgggctgggggcaggcggaccctgcagcaggtgcagcggggcgagcgcggagagcgggcacggggacaggcgggggcggggcacccgcactcacctctgcggtcggcgtagaggacacccaaggccaccagggcagcggtcaccagcagcagcagcagcagcagccccccctccaggaaccccgggcgcttctgccctgcacggccggcgctctccaccatccccactgggccttcggacttccccatca

SEQ ID NO: 26001 - DNA, 28 bp, Homo sapiens
  chr1:2706307-2706335
  hyper
cgcagcagtccccggccgcacagcgcgc

SEQ ID NO: 26002 - DNA, 70 bp, Homo sapiens
  chr1:2984719-2984789
  hyper
gtgtccccagtggcccgggtccccgaaggtggcccagctcgggcgctcgcgcagccgggtactcaccttg

SEQ ID NO: 26003 - DNA, 288 bp, Homo sapiens
  chr1:2985115-2985403
  hyper
ggagccgggttctggcgcgcgagccccgacgccccctccagcgatcgcagggcggggacgggggccgaggggagaatgcaggagaaaagcgggccggggcgacggggaacgcaaagcttttaaattagtaatcaaacgcagtaaaacggagcaaaaccagcccggactcgcgtccgaactatcggcgcgtgtgccccgagatccaaggaagtcgtgtggaaaaccgcagccgccgccccatcttcggccccggctggggcgggagcagcagcgcgacgcgccgcgacg

SEQ ID NO: 26004 - DNA, 82 bp, Homo sapiens
  chr1:2986416-2986498
  hyper
gggggcgcgggccggcgcccacccggctccgcgggcgcaggggcaggggtggcgacggcgggacagccgcagccacttgggg

SEQ ID NO: 26005 - DNA, 165 bp, Homo sapiens
  chr1:2987055-2987220
  hyper
cggaatcggcgccgcctgctcccgccgccccctcctctgcaggccgcccgcccgcccacccgcagaagaggcgcccgggccgctcccctcgaggtccccgcccgacccacgccgttccgtccgcgcctccggggccgggtccctccaggccggcctcgcagctcc

SEQ ID NO: 26006 - DNA, 44 bp, Homo sapiens
  chr1:2987457-2987501
  hyper
gctgccgggtgccctcggcctcggcctcccgtgacctctgaccc

SEQ ID NO: 26007 - DNA, 102 bp, Homo sapiens
  chr1:3087621-3087723
  hyper
ccccgcacccctcagcgccccacggagacctgcaccttccagactgacagtgctcggggccctctctccctcttgcgatttttatttcggggccacgtttgt

SEQ ID NO: 26008 - DNA, 192 bp, Homo sapiens
  chr1:3310353-3310545
  hyper
tgcgcggattcccgttcacctctgacccccgaagcagttggaggcaggtcggggacccccgcccccgccccgccccgcctcgggccctgcgatcagcagtaatagcgattaattccgactgtggctccaagtcccatggccaaggcgccctcctcctgcaggtccagggccagggagggggagcccgcggcc

SEQ ID NO: 26009 - DNA, 198 bp, Homo sapiens
  chr1:3567147-3567345
  hyper
tataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcac

SEQ ID NO: 26010 - DNA, 114 bp, Homo sapiens; identical to SEQ ID NO: 2
  chr1:3567737-3567851
  hyper

SEQ ID NO: 26011 - DNA, 576 bp, Homo sapiens
  chr1:3567882-3568458
  hyper
cggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacagga

SEQ ID NO: 26012 - DNA, 45 bp, Homo sapiens
  chr1:3663242-3663287
  hyper
gcttcaccaccaggtcggtgaactccgccgcgtagtcgtgtaaag

SEQ ID NO: 26013 - DNA, 389 bp, Homo sapiens
  chr1:3663586-3663975
  hyper
ggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgtgagatcccgcaacaacccggatccggaagcgcggggtcgcggctgggcgagggc

SEQ ID NO: 26014 - DNA, 152 bp, Homo sapiens; identical to SEQ ID NO: 5289
  chr1:4712671-4712823
  hyper

SEQ ID NO: 26015 - DNA, 51 bp, Homo sapiens
  chr1:4714024-4714075
  hyper
cataggaccgggcttcgctgggttcggggcagaagcgccgaagctccgacc

SEQ ID NO: 26016 - DNA, 182 bp, Homo sapiens
  chr1:4714163-4714345
  hyper
cggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaa

SEQ ID NO: 26017 - DNA, 113 bp, Homo sapiens; identical to SEQ ID NO: 4
  chr1:4715427-4715540
  hyper

SEQ ID NO: 26018 - DNA, 963 bp, Homo sapiens
  chr1:4715574-4716537
  hyper
cggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgc

SEQ ID NO: 26019 - DNA, 126 bp, Homo sapiens; identical to SEQ ID NO: 5294
  chr1:4716538-4716664
  hyper

SEQ ID NO: 26020 - DNA, 184 bp, Homo sapiens
  chr1:6208628-6208812
  hyper
actgaacagtggtcgcggtgttggcatgatcaccacacctgtctgcctttccctaacactcatgcctcccgtctctaggggagtcagacgcggagaagggcgcgaggaagctattgtggacggggtctcgagcagcgcgggcgaagctttgcgggatcggctaccgaggcggggcaggagccgg

SEQ ID NO: 26021 - DNA, 30 bp, Homo sapiens
  chr1:6221982-6222012
  hyper
ccacggttaatcctacgtggcctgccagtg

SEQ ID NO: 26022 - DNA, 507 bp, Homo sapiens
  chr1:6239505-6240012
  hyper
agcaccgccggtcctcgcccctctctgggccccacccagcccgccccgcggccgacatgggccaggggccgggtcccgcctgcccgcagcgaggccagaggcgcacggcggcgggacgcgagcgcggggtgcgccgctccgggagctagcgcgattcccgcccccttcaagggcacgcgggctgaccctgacagcgccgcgccccccagcgcaggccccggcccgcggtcctctggcccgcctggcccgcgtcgccgcccggggggcccggatcgcaccccgcccttagccgccctcacgccggcccgggcgctcacccagccttcgcccttggccgcgcggcgccagcagggcgggagcgcagccccgcaacccgggtgcccctcctgcgaggcgccagcccggccgcgccgcccccgccgcccgcgctccgccctgggcccggcccgtctcggcgcccccgccgctctggccccaggcgcacccgcgccccgctcacctgacatc

SEQ ID NO: 26023 - DNA, 427 bp, Homo sapiens
  chr1:6240281-6240708
  hyper
gctccccgcaaagcccgggcgctcctcccaccgcgccccgcagcccgagtcccgcagccggccgagggtggcggcggcagcgccagaggcacggcggcacggcgggggggcggcacacatgcccggattgtgacgtccagtctggttgctgtggcaaccccatcccatcgttccggcagcgcgactagttaacagcagagaacaagttgggggactagtcctgagccgccgggtgagggtggggaccggggggcgccccggcagggggagccgtcgaggcgtccgcgcgcccgcggacccgacggccgagcgggcagtcggggcttggcgagcccgggcgcagggggaggcgaggaaacaccgcccccgcgcaccccgggcagagccagccgccgccgctcgcctgcgaaggcgctgggccccgagc

SEQ ID NO: 26024 - DNA, 280 bp, Homo sapiens
  chr1:6240931-6241211
  hyper
cctcacctgcttccccgctcccaccgcccacgtgcccccttccaaaaagcccctccaggctgggtgcagctgaaacccatgcagacccctaggggtggtgcggatctgcgatgtctgtgcccaaaactcccgctcagaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaag

SEQ ID NO: 26025 - DNA, 30 bp, Homo sapiens
  chr1:6266556-6266586
  hyper
cgtgcgtgccccagccgcccgcttgcgctg

SEQ ID NO: 26026 - DNA, 262 bp, Homo sapiens
  chr1:6301710-6301972
  hyper
gtgtaaggcgagtagcgggccaaggaggctgtttgtgatggaggagccacgggtgggggcgtcagaaagtagggggatcattccaggtggggagaccactgaccgaaaacgggccacaggacagggggcgcggcgggcagtgtcggggttggggtcggggggcaacggaggcggaagtccattcagtggaccagggcggagcgacgcctgagaattccgcccaggccttgaggcgggcctcgcctcccgcagccaaagcaga

SEQ ID NO: 26027 - DNA, 192 bp, Homo sapiens; identical to SEQ ID NO: 5298
  chr1:6304118-6304310
  hyper

SEQ ID NO: 26028 - DNA, 71 bp, Homo sapiens
  chr1:6304595-6304666
  hyper
atggtcgggtagatccggaagcgcaaattggagaaggccgacatcctggagttgagcgtgaagtacatgag

SEQ ID NO: 26029 - DNA, 775 bp, Homo sapiens
  chr1:6309246-6310021
  hyper
gagccggaagacaaacgctgaggccaacgccccctcacccctgggaggggtggcgcatgtctgcgcgcggggcggaggcgggcgtctttggtgctgcggccccggagagcggcctggcctgcctggcgtccgtggggaggcgccggcggtcctaggacgcggagcccagcgagtccgagtgcagcgtggcgtagcccgaggactcggagggggaactcaggaagctgctggtgctgccgccgccgcccgccgcgcgcagccccccgggctcgccccacgacgcgctcaggccggggcgcagagagccggcgtgcgagtgcgcagaggggcgtggccctgggctccgctgggcgctgcttgggggcgtcggggcctctccgggatctgcgccgtcgggggcggcgggcgcagcggggaagggcccgggcgggcggcgcagggcctgtggctcgcactcgaaggcggtcagggcgaaggcgtcgggcagcagcgaggccgaggcggagcgggggccgggcccggggcggcggcgcgggctgccggggggcgagtcgcgggctccccgcgggccgctatccagggccgagggccgcagcgacagcaggctctcggccgagcggcggcgcgcgcgggacggtggtgcgtcctccgcgaaggccaggaggctggcgcggcgccgctcgggcccggcaggcagcaccaggtgcgccagggcggccaggtcctcgccggagccccagcgcggcaggaaggcgggcagcgggacggcggccca

SEQ ID NO: 26030 - DNA, 626 bp, Homo sapiens
  chr1:6480325-6480951
  hyper
caggctcgggttcagcgtcttctctgagccccgccctgggccgcagcaggggacccagcggttacgggagctcccatgagggacagcagcgggagggacttgcacccccagctgctttatcgggtgaagggctgagctggacgggaaatccgagttccggagaaaggtcgtgacttgctccagtcctcgacgctgggaacaggccgagcctggacaagggccccagtcgctggacgcccggctctaaggagcccgtagaacccttcggcggcttgcctagttaagagtcttttggttaccccactccaggctttgggtggggaaacggaatcctagagaagcagaggcagccctggagccctcggagctcgttttcattcccaccggctaggggtccgggttctcgcccgcaagacagtcagggctcatgtgacgcgcgggcaggacagttttgggtgcgggccccagtggcccgcccaggaccgccttcgcgccgcgtggccgttgctgcggcaaactggctggcgtcccccgcccatctgctccgggctcccctcccccgaccggctggcggggcaacggccacgcccgcgaaccacactgcgaactgccgggcagagagatga

SEQ ID NO: 26031 - DNA, 16 bp, Homo sapiens
  chr1:6484964-6484980
  hyper
gcgtcctggggaaggc

SEQ ID NO: 26032 - DNA, 288 bp, Homo sapiens
  chr1:6484981-6485269
  hyper
ctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctg

SEQ ID NO: 26033 - DNA, 48 bp, Homo sapiens
  chr1:6500940-6500988
  hyper
gcgggggtcccagctcgcggccgcggccgggtcctcactgcgtgcccc

SEQ ID NO: 26034 - DNA, 125 bp, Homo sapiens; identical to SEQ ID NO: 8
  chr1:6501054-6501179
  hyper

SEQ ID NO: 26035 - DNA, 73 bp, Homo sapiens
  chr1:6507490-6507563
  hyper
ggtgtcgcatttcctgcaacgtgagccaggtcgggcggggtgaagggtctgaggccaccgcagggacgcatgg

SEQ ID NO: 26036 - DNA, 1094 bp, Homo sapiens
  chr1:6508019-6509113
  hyper
gggattggcgggccccgggtgatgtcaggccgtcggagcccataggctggctgtgcgcgggtggctgtaacctgagaggaagtatcaggtaacgcaggtgtcgggtcctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccc

SEQ ID NO: 26037 - DNA, 46 bp, Homo sapiens
  chr1:6545397-6545443
  hyper
cgcgggcacgacccccggcccaggagggctccgagtcccggagggg

SEQ ID NO: 26038 - DNA, 171 bp, Homo sapiens
  chr1:6663729-6663900
  hyper
cggactccacgagagggtaactgggtataaagagcgagggctcaaagtcagataggagaccgccttgaaactagatgacgccactaagcacagtcccgccgtcacttgtactgcggtggggaatggtgaaagaaggaatcgcccttattttagttccgatagacacagcac

SEQ ID NO: 26039 - DNA, 80 bp, Homo sapiens
  chr1:7023766-7023846
  hyper
acctggctgggggggcgcgctcccggggcctgggggctgggcgcggctcggggagctgcgctttgcggactggaggtggc

SEQ ID NO: 26040 - DNA, 30 bp, Homo sapiens
  chr1:7130249-7130279
  hyper
agcatcagatgggggcgggctcaaaagggc

SEQ ID NO: 26041 - DNA, 52 bp, Homo sapiens
  chr1:7764556-7764608
  hyper
tccgcccgcaacctccggccgggcccccgccgtccagcgcggctcgggcgca

SEQ ID NO: 26042 - DNA, 85 bp, Homo sapiens
  chr1:7765187-7765272
  hyper
cgcgcgtttctggcgcgagtgggaagtgtggggatccggcgggcccggtgtgaggggcgtgtttctggggcgagagtggggagtg

SEQ ID NO: 26043 - DNA, 329 bp, Homo sapiens
  chr1:8002422-8002751
  hyper
gccgtcctcctgccccgcggttcccagcacgagctctcccgacagaagaggaaaacgcggcgcgactcggttgggggacagcgctgagatgcggacagatgcggacgttctgccgccgcctgcaggcagagggactcggagatcaggccgcagaagcagaagaaggcagacgggaaggaggaggaaggaaaggagccttgtggcttcgtgtccgaccctcccgcccttggcccgcgtgcctggagccagccccaccgcgcccgcgtttcctcccgcgggacttcccttggccctgggtctgcagcgggtcctgccgagcttccttccct

SEQ ID NO: 26044 - DNA, 30 bp, Homo sapiens; identical to SEQ ID NO: 9
  chr1:8277113-8277143
  hyper

SEQ ID NO: 26045 - DNA, 60 bp, Homo sapiens
  chr1:8277775-8277835
  hyper
cgcagggaaaaggaggatgctagtgacccatcctttctcgccgtgcgctttaatttcaac

SEQ ID NO: 26046 - DNA, 94 bp, Homo sapiens
  chr1:9243226-9243320
  hyper
agggcttggctcagccgaggggccgcggctcagcccccctcaccggccttaaaggttcccagagacgcaaagtcggacgcgggtcctgagcgcg

SEQ ID NO: 26047 - DNA, 879 bp, Homo sapiens
  chr1:9712135-9713014
  hyper
ccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaaaatactcttacccgtaattcagcctgaatgaggctttttaaaaaaatcgagtttcctgtttttatttaggcttcctcatttgcacctcctcctttgaggtagagaagaggggaactgggacgacctttcgtgggcaccaggatgggggcgttgcagggcggggagacgggggtccagagaaccggggaagggccgctgggaggtcccgaaaagtgcgctgtgggtggggcgagggtgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcact

SEQ ID NO: 26048 - DNA, 201 bp, Homo sapiens
  chr1:10057409-10057610
  hyper
cggcggcgcgaggctcgccgtgggtctcgggatcaggcgaaggcggccgggccgggcctgtaggtacgtcctctgtccgtgcctccgccctgctgcgcccaccgtcgcccagtcgcccccgagtccgctggtccttggcgcctccgtccatcgggcgcgggaccccagtccttcagtcccccagtccgtcctttcccgcgc

SEQ ID NO: 26049 - DNA, 91 bp, Homo sapiens
  chr1:10948529-10948620
  hyper
cccgggtctcccaggcgagaggggcgggaggctccagacgcccagagcccacagcttcccgcccggggcggctgagcggtcccggggagag

SEQ ID NO: 26050 - DNA, 30 bp, Homo sapiens
  chr1:10948841-10948871
  hyper
gcccgggggagggggcgctgtgggggctcc

SEQ ID NO: 26051 - DNA, 1056 bp, Homo sapiens
  chr1:11538940-11539996
  hyper
gccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccag

SEQ ID NO: 26052 - DNA, 140 bp, Homo sapiens
  chr1:11540039-11540179
  hyper
cgcgaacgagggtggaggtggagtgggcagccgggcagtggcggcgctgagggtcgggaaagattcccagcgcaaggggcgccaagtcccgggagccaaccccaccgccgggagaacttttcccaactccctggggaggc

SEQ ID NO: 26053 - DNA, 30 bp, Homo sapiens
  chr1:11611023-11611053
  hyper
acagcggtcttcccacgatttgctatttac

SEQ ID NO: 26054 - DNA, 61 bp, Homo sapiens
  chr1:11751330-11751391
  hyper
attgttggggtccaccgaggaccgcccgccgcggccctttgtcgcccgccctgcgcggggc

SEQ ID NO: 26055 - DNA, 172 bp, Homo sapiens
  chr1:11752464-11752636
  hyper
gcccggaaccagcaccgccggtggccccgcgccgtcccatctgtgcccaggaaggtactcagcctggctcccccgacggcgctggtctttcgcctgtggtctcccgctctgtccctcctgctccccaccgccggcttttggcttttctccgtccgctcgtcaagggtctcag

SEQ ID NO: 26056 - DNA, 109 bp, Homo sapiens
  chr1:11919143-11919252
  hyper
gtgggaggtggagaccgggcagagccgaccttgtatagaaatgggccgggtcgggccggggggcaggaacgcgctggagacacagacaagtccccgtctcccgcttctt

SEQ ID NO: 26057 - DNA, 164 bp, Homo sapiens
  chr1:11959074-11959238
  hyper
ggacccacctggatccgaggtcggcccctgtccccggtgctgaaatgcgggcgcccgcggggttcacggccaggactcagccctggagtccctgagaccgctagccccgtagcaatcccctatgtaggatttgtttcaagggctcagaccggcacagagccccc

SEQ ID NO: 26058 - DNA, 432 bp, Homo sapiens
  chr1:12123122-12123554
  hyper
ctactcacatttcaccgtttcttggggcaggagtggaggtgggggcattggaacccccttggggcctcctaatatcctgtgagtccccacctccagggccagaagctgcctgcctccgctccccgcagcccaggtgcggcgggcagcacactccctagagccaggaccactagttccgtcaaatccggggcgggccattcaaacagctaagggaggcgtctcctagtgtgccttttcctgagtcatctctgcacgtgtttgcccccttttttcttcgctgcttgtagctaagtgttcctggaaccaatttgatacgggagaactaaggctgaaacctcggaggaacaaccacttttgaagtgacttcgcggcgtgcgttgggtgcggactaggtggccgcggcgggagtgtgctggagcctgaagtccacgc

SEQ ID NO: 26059 - DNA, 145 bp, Homo sapiens
  chr1:12123787-12123932
  hyper
cgcaagggaggacactcctcaccccgttccctgcccagctggagtgagggggcgcgggtgacaagcaggaacaccggaatatgctagcacccacaggtgggaggctggctgaagggctagtggtggggggcgcctccttctcacc

SEQ ID NO: 26060 - DNA, 309 bp, Homo sapiens
  chr1:13839460-13839769
  hyper
tgggcagtttggatgcgttctcctggatccaggagaagaggtgggcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaaca

SEQ ID NO: 26061 - DNA, 177 bp, Homo sapiens
  chr1:13840521-13840698
  hyper
gcggtttccctaaggcgtgtcccgggcgtgcgccctgccccctcgcgcccgcctggtgccaaagcacgctccctgcacgccaccctatgtcgccaaagggagtgggacctgggtcactctgactctgctccgggggcaatccctgcaggttctcgggtgccgcgccagggtctgctg

SEQ ID NO: 26062 - DNA, 368 bp, Homo sapiens; identical to SEQ ID NO: 1659
  chr1:13910330-13910698
  hyper

SEQ ID NO: 26063 - DNA, 15 bp, Homo sapiens
  chr1:13910699-13910714
  hyper
cgggggagctgaggg

SEQ ID NO: 26064 - DNA, 37 bp, Homo sapiens
  chr1:14026539-14026576
  hyper
atccgcggtgacctacgaggggcggctgggtggtggc

SEQ ID NO: 26065 - DNA, 88 bp, Homo sapiens
  chr1:14027035-14027123
  hyper
gccgtggggtccctgcggcgaagttcgggattcggtttgtcgccgtgaagagccgcgcgccccgcgggggacgcgtgcgggctgcaga

SEQ ID NO: 26066 - DNA, 30 bp, Homo sapiens
  chr1:14219099-14219129
  hyper
acagtagggttgggtcggctaagatgaagt

SEQ ID NO: 26067 - DNA, 339 bp, Homo sapiens
  chr1:14219335-14219674
  hyper
ctgccccctttgcatcgccgcaccggggtggcggcgcgggctgggggccgctgcagcaggtctcagtccctccctgctgccacgcgaggagtggggagcggcagggcctaggcgtcccgagtggaggatgagccggagacgcctgcgggtccggagctgcaccgcgcccgtgcggcccgcgccgcccgcctcccgcgctctccctttggcagcagccggacgcctggcgcgtgcaggacctggggccgcggcgctcgcgcggggacgcgggagcccagggtcggcgctgcaggcagcggggcggcgccagcaaggccagctccccggggaccctggggc

SEQ ID NO: 26068 - DNA, 679 bp, Homo sapiens
  chr1:14924519-14925198
  hyper
cgccaatattcagcccggctaagaagcttaggagctggctaaggctgctcctccacctggatgcacacacagggctagggctgtggagaggcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctc

SEQ ID NO: 26069 - DNA, 869 bp, Homo sapiens
  chr1:14925199-14926068
  hyper
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccggcatcagaaagtgccctttccgtggcaccagccccctagctccgtgcaaacttttcatgccggggccttttcccc

SEQ ID NO: 26070 - DNA, 35 bp, Homo sapiens
  chr1:15251220-15251255
  hyper
gcagcgggaggcgtgcgggacgcagagtgagttcc

SEQ ID NO: 26071 - DNA, 81 bp, Homo sapiens
  chr1:15251499-15251580
  hyper
gcgaaattgatgcctcgcatttgctaggagcggagagattgctgcgtttctcatacacttgaactccgagtaatgcagaaa

SEQ ID NO: 26072 - DNA, 48 bp, Homo sapiens
  chr1:15479729-15479777
  hyper
gagaggtgagtatcccgccaggtaaaggcggggcggctggcggagctg

SEQ ID NO: 26073 - DNA, 156 bp, Homo sapiens
  chr1:15573605-15573761
  hyper
ggagcattcagcaggcggtaacccagtgggcgttccctgcacggtgccacgccccctctgccgcgcaggccacgccctcatctattaggctggaccccgcggcgcctggcggcgttgccatggcaacgcgcgtacacaggccggccgggcgggcgg

SEQ ID NO: 26074 - DNA, 336 bp, Homo sapiens
  chr1:15930022-15930358
  hyper
cgcttgagctgagtccgaaactcgcacagcaacctcgggaggataaactccagcaaccagaatcgggttggcgtcgcctagcaaccaggagccaaatgcgcggacgccaggcattggcctgcacgtgtcacgtgagccagcgccgctgcccagtgggagattacgccgcaggcacgtgatgcggcgcaaccgccctttggcagagcttttcgcgaaggcagttgtggctctgagcgcataggcgaggcattcctggggtttgcgccgtatccttttacaaagtcctggctttggctggtgcgaccaaagaaaggaaaccggcgcttgagacttgtc

SEQ ID NO: 26075 - DNA, 30 bp, Homo sapiens
  chr1:16375412-16375442
  hyper
gcattccaggctggacgggtctctgggcag

SEQ ID NO: 26076 - DNA, 34 bp, Homo sapiens
  chr1:16533298-16533332
  hyper
ctagagccaaccttccgcgcggacagtcgcgcca

SEQ ID NO: 26077 - DNA, 51 bp, Homo sapiens
  chr1:16542965-16543016
  hyper
tgctgactgaaacagcgtctcccggttgtctgccaccgcctgcttggccag

SEQ ID NO: 26078 - DNA, 88 bp, Homo sapiens
  chr1:16553585-16553673
  hyper
gcaggctcagttcctcggcgtagcacagcggctcccaggcgcgctcagctcggcgaagggtgcggcgctatgccggggtactctcctg

SEQ ID NO: 26079 - DNA, 274 bp, Homo sapiens
  chr1:16861468-16861742
  hyper
tctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaaga

SEQ ID NO: 26080 - DNA, 30 bp, Homo sapiens
  chr1:17033955-17033985
  hyper
tgggacccccgcgcccgggcagggccgtgc

SEQ ID NO: 26081 - DNA, 138 bp, Homo sapiens
  chr1:18152717-18152855
  hyper
gggcccagcatcccacgggccattgtggaatccgtggagtcctgcgagatctccctgcgccccctgctggtctcccacgtgatggcctgcgggggcaacaccctctatcccgggttcacaaagcgcctgttcagggag

SEQ ID NO: 26082 - DNA, 65 bp, Homo sapiens
  chr1:18434751-18434816
  hyper
gggggagggcgctggccggggtcgctccgagaggctcgggctacgagcaccggtcctgcccgggg

SEQ ID NO: 26083 - DNA, 33 bp, Homo sapiens
  chr1:18435496-18435529
  hyper
tgtgtgtgtgtgtcccgccgtgtggacttgctc

SEQ ID NO: 26084 - DNA, 507 bp, Homo sapiens
  chr1:18436492-18436999
  hyper
gctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttca

SEQ ID NO: 26085 - DNA, 388 bp, Homo sapiens
  chr1:18437043-18437431
  hyper
cgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagcc

SEQ ID NO: 26086 - DNA, 385 bp, Homo sapiens
  chr1:18437432-18437817
  hyper
ggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatggg

SEQ ID NO: 26087 - DNA, 30 bp, Homo sapiens
  chr1:18956225-18956255
  hyper
gcgtggggccagagacgctctttcccccgg

SEQ ID NO: 26088 - DNA, 141 bp, Homo sapiens
  chr1:18956470-18956611
  hyper
tgtatcaagtcttgacgggctccctccctcccatttcccacctctttgggcccccagatcctcacaccagcaccaactccctgtaaacccaactacctgctggaaaggagttataggcccggcctgggggcctgaggagga

SEQ ID NO: 26089 - DNA, 849 bp, Homo sapiens
  chr1:18956738-18957587
  hyper
cggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatat

SEQ ID NO: 26090 - DNA, 244 bp, Homo sapiens
  chr1:18957985-18958229
  hyper
ttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcctcgccgcgactccgccgcccggaact

SEQ ID NO: 26091 - DNA, 61 bp, Homo sapiens
  chr1:18958358-18958419
  hyper
cgcttctgcgtgggtttcactgcccggcggccttcgtttcgcaggtcgctagctgccggtc

SEQ ID NO: 26092 - DNA, 58 bp, Homo sapiens; identical to SEQ ID NO: 5338
  chr1:18958829-18958887
  hyper

SEQ ID NO: 26093 - DNA, 48 bp, Homo sapiens
  chr1:18959220-18959268
  hyper
tgggctggcagcctgcgatccgggaggagctcccttgggcagcgagac

SEQ ID NO: 26094 - DNA, 121 bp, Homo sapiens
  chr1:18959269-18959390
  hyper
gcgccgggtccctgaattagacagaggcgaagagagcggctccgtgatcaagtgcgcgccggcagccacgcaggcgggagagcgcgcaaacccggggatttgcagtggcactctcctgtag

SEQ ID NO: 26095 - DNA, 450 bp, Homo sapiens
  chr1:18959455-18959905
  hyper
cgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctcccc

SEQ ID NO: 26096 - DNA, 107 bp, Homo sapiens
  chr1:18960897-18961004
  hyper
gcccaccatggcatccggccctgtgtcatctcccgacagctgcgtgtctcccacggctgcgtctccaagattctttgccgctaccaggagaccgggtccatccggcc

SEQ ID NO: 26097 - DNA, 547 bp, Homo sapiens
  chr1:18962727-18963274
  hyper
gaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctaccccaatactgcggggagtgcgtcctcccgggctggcgttttggctgctactctcggcgtcgatcaattatttataggaaacttgggcaagggggcgggggacgggagggagggaga

SEQ ID NO: 26098 - DNA, 182 bp, Homo sapiens
  chr1:18963662-18963844
  hyper
aagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaa

SEQ ID NO: 26099 - DNA, 129 bp, Homo sapiens
  chr1:18964285-18964414
  hyper
ggcccctagtgatgccgcagtcccgcccgggacaaaagggcgagggaagaaagggagccagctgtgccgggcgccccgctgtgcccggcctgccgaggggccacgggtctgcggcgggaggcagccctg

SEQ ID NO: 26100 - DNA, 41 bp, Homo sapiens
  chr1:18966656-18966697
  hyper
tggagtgggaaatgacggggaaggatcggaaaggaggggag

SEQ ID NO: 26101 - DNA, 129 bp, Homo sapiens
  chr1:18968003-18968132
  hyper
tggggtcccccgctgcgagggcgtgcgggttttgtgttcccctcggggcacgcaccgccacacttgggctgtttcaaggcgtttgtacctaaaagactagtgtgcacggcgcagcggttaaaggaatta

SEQ ID NO: 26102 - DNA, 1308 bp, Homo sapiens
  chr1:18969493-18970801
  hyper
gcgaagggagggggtcggctgcacttggaacttcaacctcctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttct

SEQ ID NO: 26103 - DNA, 190 bp, Homo sapiens
  chr1:18971739-18971929
  hyper
ggctgggccttgcttcgccacgggttcgagggagaggcggagggaggagcggctgggctgcggagcctcttgccttcactgcactctttgtctgacaccacgaaaagaccgaagatcaaagaggcccccgagcgggacagaaaaaggggtggggcggcgggcgcgataagtagctcggaaaactccaccc

SEQ ID NO: 26104 - DNA, 38 bp, Homo sapiens
  chr1:18972986-18973024
  hyper
gcaggaaattagggccgggaaagcggtttggaaactgg

SEQ ID NO: 26105 - DNA, 73 bp, Homo sapiens
  chr1:18973661-18973734
  hyper
gctgggtcagctgcccgcgccggccagcggaggggaggggggcaaaggacctgggctccgccgccactgccgc

SEQ ID NO: 26106 - DNA, 13 bp, Homo sapiens
  chr1:19043054-19043067
  hyper
tcttttctccctt

SEQ ID NO: 26107 - DNA, 29 bp, Homo sapiens
  chr1:19043114-19043143
  hyper
cgtctccctgatcgcgtcataaccctgag

SEQ ID NO: 26108 - DNA, 391 bp, Homo sapiens
  chr1:19043352-19043743
  hyper
cctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactg

SEQ ID NO: 26109 - DNA, 151 bp, Homo sapiens; identical to SEQ ID NO: 5351
  chr1:19043756-19043907
  hyper

SEQ ID NO: 26110 - DNA, 74 bp, Homo sapiens
  chr1:20512379-20512453
  hyper
aggagagaaggaggccgcgggtccctgtcgcctccaggccaggcaatccactccaggctcgcaatccaccgacc

SEQ ID NO: 26111 - DNA, 413 bp, Homo sapiens
  chr1:20618140-20618553
  hyper
gcagggtgcccaccccggcagccgggctcatgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagcagcgggtgcagtgtggcgcctgctaacgcatcaagcctccgctggaagttccaccataacgtctgcggcagccccaacagttccaccccatgctcccgccgccggcaccacagcagcagaaggaggcctgtggggcgggggccagaacctttccctcctcccttctgaagagcaacaggcgtcacaccatcctgcctctcccactaaccccgttccttcttttgc

SEQ ID NO: 26112 - DNA, 150 bp, Homo sapiens
  chr1:20669698-20669848
  hyper
ggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgactt

SEQ ID NO: 26113 - DNA, 38 bp, Homo sapiens
  chr1:20669896-20669934
  hyper
cggaactgcgcccctcccgcggacggcctccggaggac

SEQ ID NO: 26114 - DNA, 40 bp, Homo sapiens; identical to SEQ ID NO: 5354
  chr1:20692819-20692859
  hyper

SEQ ID NO: 26115 - DNA, 203 bp, Homo sapiens
  chr1:20810635-20810838
  hyper
aggtgcggagatgagcggaaccaggaggggacgccaaaaccggttcccacgacgcgcagcgggtgggggttagggcctggcctgggcgggcgccccctcctgcgcgccctctcccagccgctggccgactgactcggccgccccgcgctccccgctgccgcagaggtcagagcctcccttcgctgcctgccagggacacatgc

SEQ ID NO: 26116 - DNA, 47 bp, Homo sapiens
  chr1:20810864-20810911
  hyper
cgacttagcctcgcctttctcagtccctccatcgtccctcggcgcga

SEQ ID NO: 26117 - DNA, 148 bp, Homo sapiens
  chr1:20878512-20878660
  hyper
tcagctcaggcccagcggtctggcccacgaccttggaagaacctgggagaaagcttcaccaagcgacagtacttttccactgcactgctcggccacctcggctggctttgtgctgtgcagacgaggcaaagtgcgccaggccagcccc

SEQ ID NO: 26118 - DNA, 124 bp, Homo sapiens; identical to SEQ ID NO: 5357
  chr1:20878905-20879029
  hyper

SEQ ID NO: 26119 - DNA, 199 bp, Homo sapiens; identical to SEQ ID NO: 5358
  chr1:20879030-20879229
  hyper

SEQ ID NO: 26120 - DNA, 182 bp, Homo sapiens; identical to SEQ ID NO: 5359
  chr1:20879255-20879437
  hyper

SEQ ID NO: 26121 - DNA, 1143 bp, Homo sapiens
  chr1:20879462-20880605
  hyper
cgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggct

SEQ ID NO: 26122 - DNA, 57 bp, Homo sapiens
  chr1:20916163-20916220
  hyper
ctaagtgttaatgctcgtctttagatgaaactacggaggtctcgagaggtgacatga

SEQ ID NO: 26123 - DNA, 140 bp, Homo sapiens
  chr1:21044081-21044221
  hyper
ggatgcagcactgggcgcgcgcgcagtccacagtcaccacgggctggcagcgcagctctcgctcccgctggttcatgggacggcagcgcacgacaaccttcaccgcctcggaggccatggcgccgcgcccaggaccaacg

SEQ ID NO: 26124 - DNA, 66 bp, Homo sapiens
  chr1:21058309-21058375
  hyper
ccccggcagagtccccggacccaggagcgtgctgggctccgctgcaggggacggaggaggctacag

SEQ ID NO: 26125 - DNA, 127 bp, Homo sapiens
  chr1:21754473-21754600
  hyper
ataagccagggggggcgttctcggcgcggagtggagtggagcggagcgggctggtgctgggggcgcggagagcgcagtgctggccggggccgggagcggggccgagcgggagcggagtcgggcgtcg

SEQ ID NO: 26126 - DNA, 174 bp, Homo sapiens
  chr1:21835408-21835582
  hyper
agagagacagggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaac

SEQ ID NO: 26127 - DNA, 317 bp, Homo sapiens
  chr1:21836071-21836388
  hyper
cccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccct

SEQ ID NO: 26128 - DNA, 351 bp, Homo sapiens
  chr1:22140663-22141014
  hyper
cgcatcttagggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggc

SEQ ID NO: 26129 - DNA, 293 bp, Homo sapiens
  chr1:22141015-22141308
  hyper
gcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctcttt

SEQ ID NO: 26130 - DNA, 140 bp, Homo sapiens
  chr1:22889622-22889762
  hyper
ggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctg

SEQ ID NO: 26131 - DNA, 30 bp, Homo sapiens
  chr1:22890079-22890109
  hyper
ccaagcccgagggtgcgtggcgcccccgcc

SEQ ID NO: 26132 - DNA, 48 bp, Homo sapiens
  chr1:22933907-22933955
  hyper
ttctgctgccacctccgcttccctcagcgactgcggaagcctcatcag

SEQ ID NO: 26133 - DNA, 73 bp, Homo sapiens
  chr1:23038177-23038250
  hyper
gccgcgcaaggtctccgggcacccccgccggccaccgccccgcggccgcggcgctcagcgtggcggctggagc

SEQ ID NO: 26134 - DNA, 287 bp, Homo sapiens
  chr1:23748862-23749149
  hyper
gtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccatgcccacccagacactgccgagagcccaggcgc

SEQ ID NO: 26135 - DNA, 69 bp, Homo sapiens
  chr1:23884932-23885001
  hyper
ggagcagtcagtttccgccgagcgtgccgaggcgggggccgtccgcagactggccggcgccagggagga

SEQ ID NO: 26136 - DNA, 80 bp, Homo sapiens
  chr1:24648262-24648342
  hyper
gaagcatggaggccccggcggtgtagttagaaaccagctggaggtggctggcgggtgctgagcgccgggcctttcatgtg

SEQ ID NO: 26137 - DNA, 812 bp, Homo sapiens; identical to SEQ ID NO: 5370
  chr1:25256012-25256824
  hyper

SEQ ID NO: 26138 - DNA, 186 bp, Homo sapiens
  chr1:25257156-25257342
  hyper
gggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctc

SEQ ID NO: 26139 - DNA, 117 bp, Homo sapiens
  chr1:25259018-25259135
  hyper
tccttgccatccatgcggccaggtctcagacaaaccgatggctttgtgtcaaaccaaggccgccttcctcacctctgataagatggacgccttctgtcttcgcgttttcaggcaccc

SEQ ID NO: 26140 - DNA, 103 bp, Homo sapiens
  chr1:26249061-26249164
  hyper
ctcccaccccacctgcggcttgcacagcgacacacaagcgttgtgattggctcttccttggctgagacaagggtggggaccgaaatggcgtctctaacagctg

SEQ ID NO: 26141 - DNA, 196 bp, Homo sapiens
  chr1:26249400-26249596
  hyper
agaagcccagacccccgggcgcacgcggccgcgcccacccaggtcgctgggaggtgcccgcccgggaggcgccgcggccagtgcctgccgttagcttcaggaagaactaggattgagtaagaaacgactagggatggaagcacttggcactccgggtctcggagcaggctggggacgcccgcggcaggaacctggt

SEQ ID NO: 26142 - DNA, 113 bp, Homo sapiens
  chr1:26372988-26373101
  hyper
agaggctactggggccgcgtctgccccctccgactggcggctgccctgggcttgatcatgttcccctctcaggccggagaccccccgaggtcggcttgcgttcctgtcctcct

SEQ ID NO: 26143 - DNA, 479 bp, Homo sapiens
  chr1:26551728-26552207
  hyper
cgcgggcaagacgcccatgccaaccagtgagtgggcagccccgggacctcctgcgcagccgccgcagccttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcggtaaatggatcat

SEQ ID NO: 26144 - DNA, 121 bp, Homo sapiens
  chr1:26735162-26735283
  hyper
tgggaatcaagacagcgtgactcaattcagcaccgtggacagagctgctggagccctcaggaccctggacagagaagcaggccgcgcattcccggggaaccgaattcgcatcacttgagaa

SEQ ID NO: 26145 - DNA, 309 bp, Homo sapiens; identical to SEQ ID NO: 5374
  chr1:26735645-26735954
  hyper

SEQ ID NO: 26146 - DNA, 702 bp, Homo sapiens
  chr1:26737181-26737883
  hyper
ggggagggggctgcccgcggggggttgggtcattgtcttttagaatttgggagcctttgaaaagccgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggcgtgcgcgccagactacgtgggtggatggagaggagaggcttgtcccgccgtgagtctctgggaaacgcgttgtgggaagaggagcaaaactttcggggcactactgtcccggtgtacgctaggggaacgcgggaggcgaccgggataggtttcttctcttctgttgcttggtagctgccccctcctggctgtccacttgtggggctggatactcgggtctccctgcctggggcccgagacggccctccgattccgtgccccccagctaagtgcccggccctccctctctccaggtggctg

SEQ ID NO: 26147 - DNA, 417 bp, Homo sapiens
  chr1:26737907-26738324
  hyper
cgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccaggtgagactgattccggtaactttgcccagggaagggcgtctaggcgcccatatccacgggtgggctccgggctcgcagttgaattgagggccatcgggagccctcattatgcatccctgtctttgcttcggcaccccaattctgagtccctgttaactatctcgtgggggagtagtgggaggcagcaccaattatcagcacccccgcccccttccgggaacccctccggcttaccacgtgtctattacctc

SEQ ID NO: 26148 - DNA, 442 bp, Homo sapiens
  chr1:27960654-27961096
  hyper
ggggctgcgcccacccggagccccgcggcggcccagcgcggcccgccctctcgttgccttggaggcagcccctgcgggcactcgcggtcaaaggcaggatttccgtcggggcggcagcaattcccggatccagcggggagcgcgggccgagaccgccgcgggcgcggagggggcgcccggagaggcctgtccctgccgagggcggggacttccccaggaagcggggacccacgcctcgcgcgcccggcaggagtcccctgcagcccggaacctaccgcaagggcgggccgagagggtcgcggggccgcggtcgcggccgctaacgttaccctgcgggctgtgggcttcaccccgacttcggccggctcggaagaggggaacttcctggacccgcaattgcaccccaggttctccgtcctccagaagtcgttctcctcaaccc

SEQ ID NO: 26149 - DNA, 328 bp, Homo sapiens
  chr1:28199304-28199632
  hyper
tgtgtgatttggggccgcactcaacctctttggacctcggcttttgctttcgtggaacggggaccgctgacctgccccgcagggtagtgatgaaaagtcagtgggttgaggcgcgggaggtggatgcagccgggccactcctaggtggccccgcggtgcgcatgggacagagctccgaccgcgccgggacgcagcattaggccgctggtggtcgtggctgcgtcttgattctgaagtgcagggtcagtcttcccgtctgtgtcctcccactcctcccccggccctcctctacactgccttccttcagtccctgcgtccaccttggcct

SEQ ID NO: 26150 - DNA, 405 bp, Homo sapiens
  chr1:29138552-29138957
  hyper
tcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcgga

SEQ ID NO: 26151 - DNA, 237 bp, Homo sapiens
  chr1:29448530-29448767
  hyper
cgcgctcgggttttccgcagcggagctccgagccaggcacgcgcggcagaagccggagttggcccggccagcgggcggagaggagggaggggggcgcaggctgttccctggcgcatcccgggctgcaaatctgccgcctgcgtccggtccgcaagcccgcgggtcttgggcctcgggaaacgtgcggcccccagctgccgcgtctccagggtaagtacctcccgggctcgaccccac

SEQ ID NO: 26152 - DNA, 112 bp, Homo sapiens
  chr1:29449783-29449895
  hyper
gccggggagactgcccgaccccgcactaggcgggggctctgccaggtccgacgccgggctccggggccccagccctagacccctctcaggacagccacgggagtatccagga

SEQ ID NO: 26153 - DNA, 816 bp, Homo sapiens
  chr1:29586042-29586858
  hyper
cagagcggccgaggccgaacgcttcctcttgcaagtgagcgggagcggtgatcttggctgggggcggggtgggagggggttggtggctgcttctggccctgactccccccagattgctgagtccctgcttcatactccagcactgcgcacagcgtcccggccctcccctagctctgctctgcgctttcttgggtcccccattcccccaggttagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaagggtcagctggtggacgccggggagcgccgggacctcaccctcgaggggcggggccggcgacgggggcgggctctgcccgggggcgtggccgtggggggtggggccggcagggtgtcgctggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccagga

SEQ ID NO: 26154 - DNA, 140 bp, Homo sapiens
  chr1:29804985-29805125
  hyper
ggccatctcagggaccgtgtcggggggtgctgactctgcccatcaaggggagccggacatttatccgccaaagcccgtccctcgcggtgagggtcgctcctgggtgtgggacccctggcttcccgcgctgccctgcccgg

SEQ ID NO: 26155 - DNA, 30 bp, Homo sapiens
  chr1:29805353-29805383
  hyper
gcacccccaacttcacgctaaatgcataat

SEQ ID NO: 26156 - DNA, 166 bp, Homo sapiens
  chr1:30559014-30559180
  hyper
accaggaggaggtggcggaggtcccgggggccgccccgcctcgcagcctgggctctgcctgctctgcgtccacgccagcataagccccagccggctccgtctcccctaacgactctaattaccagccaagctcggctccccaaggcccaggcgccagaactgatga

SEQ ID NO: 26157 - DNA, 388 bp, Homo sapiens
  chr1:30815454-30815842
  hyper
cggcaggtccttgcagaggaggggctcttcccaggagggcgctccagccgaggcccctctgccttcacctgcgccatgaccacttccctcggccctctcccctcctccacgcctcctggggccgctctccagggtcctgggacgagaccagccccgggcagggcagcgcggggagccaggggtcccacacccaggagggcccctcaccgcaagggacgggcttaggcggataaatgtccggctcccctcgaggggcagagtcagcaccccccacacggtccctgagatggccctgggaccgagccgccgcccccgacttgtgattcagcctcttcctgcctggctttcccctccccactgtgcctcctgggatcgcctcccaaatcag

SEQ ID NO: 26158 - DNA, 223 bp, Homo sapiens
  chr1:31157994-31158217
  hyper
cagtgggaacaaggacgaccgtcgaggaacccgacaaatgaattaaaccagcaccagcgtgatgagcaaagcggagaaggaaagagggcgctgtgaggagagcgaggctcctccgggaaagctccttctgctccaggtgacagcggagagagatgccaccgcgcggcgaccggcagggccgcgtcccctctgcgtcctagcacagcgacgccccgcccgccac

SEQ ID NO: 26159 - DNA, 34 bp, Homo sapiens
  chr1:31712624-31712658
  hyper
ctttgtctagcgggccgtccgtcaggcgcgcctc

SEQ ID NO: 26160 - DNA, 287 bp, Homo sapiens
  chr1:31846347-31846634
  hyper
ggttgacttctggcacgggcatctgtcctcgttttacaagtgaggagtccgaggctcacaggggaactgacaaggtctcaagaaataggagggggtgaatggagctcagattgcaagcttagtctagcgggcttcagagctcgcgctctcccttcactctcactgcctggtggcggagacagtcaccagcggctcggtctgcggctgagctgaccttgtcctctgcctgttttgagcaaaagcctgacccttcgcgccccgcccgcctcacacgtgcttgcccctcc

SEQ ID NO: 26161 - DNA, 230 bp, Homo sapiens; identical to SEQ ID NO: 5384
  chr1:32180184-32180414
  hyper

SEQ ID NO: 26162 - DNA, 133 bp, Homo sapiens
  chr1:32180688-32180821
  hyper
gagcctcccgatggtcgctgtgtctgcccattggaccaggggccagggcgggcggggctttgggcgacagaactggctagggtgggagaggagaggaagctgccaggttctggggatcccgaccccaccccgc

SEQ ID NO: 26163 - DNA, 228 bp, Homo sapiens; identical to SEQ ID NO: 5385
  chr1:32180905-32181133
  hyper

SEQ ID NO: 26164 - DNA, 99 bp, Homo sapiens
  chr1:32181358-32181457
  hyper
ttctgggatgaggggcggaggatgggaggcggagcccggtctccagggcaccagccctccacctagcgggaagcttgggaatcgcggagtgcagaggtg

SEQ ID NO: 26165 - DNA, 20 bp, Homo sapiens
  chr1:32226308-32226328
  hyper
ccgacctgcccaggccgcca

SEQ ID NO: 26166 - DNA, 25 bp, Homo sapiens
  chr1:32237521-32237546
  hyper
cacaaagggccccaccgccggaagc

SEQ ID NO: 26167 - DNA, 1036 bp, Homo sapiens
  chr1:32237638-32238674
  hyper
cggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctga

SEQ ID NO: 26168 - DNA, 130 bp, Homo sapiens; identical to SEQ ID NO: 5388
  chr1:32410234-32410364
  hyper

SEQ ID NO: 26169 - DNA, 84 bp, Homo sapiens
  chr1:32827740-32827824
  hyper
ctggagaacccccaacggtgccccctgccgcccctggcactcagcgcgggccagaatcggggactggaggcctctggccatggc

SEQ ID NO: 26170 - DNA, 408 bp, Homo sapiens
  chr1:32930619-32931027
  hyper
cctctcatcggagggcgccaggtgaatgaaaggggggcgtgtcggtgcgcggtgctccgtggctgcgctgctggaacccgctggaaggtgagcgcgaagaagcgggttggcgctgccgctttcgttggtttggggaggattcctagcacccgggaggctggctggagattggggttagcgggcagggttgcccccactcagtcatcctccttcggaccgcttggccctggcaactcctgggacctccgccccgcgagcccttctagcgtggggaggggcaggcgcggccgtggggccccagcttccctgtcattgggtgtcctccgcgtcgtccagccgggggtcgcggcgccgactacttccacggtgaatggtgcccaggcgtggggggctcggccacactggaga

SEQ ID NO: 26171 - DNA, 35 bp, Homo sapiens; identical to SEQ ID NO: 5391
  chr1:33351678-33351713
  hyper

SEQ ID NO: 26172 - DNA, 98 bp, Homo sapiens
  chr1:33358896-33358994
  hyper
agccctccaagggagcgcggcagggcccgcccgatagccctctcttctgggaggccttcccggacacgccttcccgaagccctcggctccccacgcct

SEQ ID NO: 26173 - DNA, 75 bp, Homo sapiens
  chr1:33390730-33390805
  hyper
ggggagggggtcctgcgccgtcccctcccactcctcgcctgcaggtcggggagcctctgccgagggaaaggaggc

SEQ ID NO: 26174 - DNA, 71 bp, Homo sapiens
  chr1:33438729-33438800
  hyper
ccgcccctcgcgtgccgcatccgcgcgggagagcgcccggcgaggggccgggattccgccgcggtccgcta

SEQ ID NO: 26175 - DNA, 140 bp, Homo sapiens
  chr1:33772445-33772585
  hyper
gggctccagcagaactcgggcgacagcaccttggcgggcttgtgcagccagaagaacttgttgaggtggctctcgtcgtgccagcgcgcctccaggccgcgcgcgcggtcccagtccaggccccccgcacagtgcgccgt

SEQ ID NO: 26176 - DNA, 33 bp, Homo sapiens
  chr1:33772904-33772937
  hyper
cgctccacgggcagccggcgtcccgggcccagc

SEQ ID NO: 26177 - DNA, 1323 bp, Homo sapiens
  chr1:34628590-34629913
  hyper
ctgagcaaggagctgcgagcaaatggatctctatagggcaggattccagcaccgctgagcggtgcaagcgccggtgagtcggcctttttctctcccctaggggcaggatatgcccaaggggcagggacaaatctagccagaaaaacaattcagtccgatgccgagacattctccaatcagctaagccagagaccggcctcgcctcaacgtacgtccgggaggcctggcgggaggtagcagcgattcccccaccgcccatgtggcaagtctgggtgaccagcagcgtcggtatgcacagcctcccagtgggtgtgggtgtgcgagaggccagagctcccaggcgcgcgcaccgcgggcgcccctctctgggtgtcggtggctatgactcttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggggtgctgtgggtaaagcgggagggcaccagtcgcggccagtagcctccacaggggaccgggttccctcgaaggttcgcgtacctcccccgcgcgctgcaagctgcagccagacacccgcgaagttccgggactctccgcacccgctagatctgccccttcccggactcggtcgtcgggagctggtcccgccgcccgcgccgccgctgccgctgccgcagccgaggcgctcggctgcagcagggcgcgggaaagggcactttggcgcggagtgagcaccgaggggaatgtggcagcgcgaagcctggcggcggcactccctcccccgcctcgggctacaacccccaccccctccttcccatccctcaacaccctccagcccccacctgcaccctcctgcaaggaatgcgcgggacccccaccgtgggcacgcgtccacctgaaccc

SEQ ID NO: 26178 - DNA, 825 bp, Homo sapiens
  chr1:34630215-34631040
  hyper
ccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgctgggggtggaggcgcagctaaggataaaatattggggggcgggggttcctcttc

SEQ ID NO: 26179 - DNA, 293 bp, Homo sapiens
  chr1:34631516-34631809
  hyper
gggaggggggggaaccggttcatttgacccagtgcggtcccactcctaccctaagacaaaaatctcagggtggcagaggcggtccctgtgtgcacgcgagttgggggtggggagtgaggttggtggaaggacggtgcaagagttactagtacaatttatccccaaatttaaataatcggatcctacttcttcttctccccttcctcctcccagccaaggccccaaaccaagagagttcttcccaaggacgtgagctgctccccacctctccccagtagcggctgcctctaggc

SEQ ID NO: 26180 - DNA, 361 bp, Homo sapiens
  chr1:34632140-34632501
  hyper
caagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcc

SEQ ID NO: 26181 - DNA, 102 bp, Homo sapiens
  chr1:34642388-34642490
  hyper
agtggggcggcggcgcgtttggctttgacttctgatcccccgaagcgctctggggtcctttgggccccacccccacccaccccaccggcgggtcttgggctc

SEQ ID NO: 26182 - DNA, 276 bp, Homo sapiens
  chr1:34642862-34643138
  hyper
gctctgcgaggggctccctgggaacgcccaggcgagcgcctcctgcggggccccgccccccgagtgcctacaatggtgccaggcccgcacccagtcctccgcgtggcttagcgggacagcatgggctgagcccaggcgccgaaagttgtcacggcggcgtcgcaagggggcagtgccagggactgtggggagagccagccctccccttccagctgttcccagatgtcattctgcccgcccaggcgcctggttcctgagctccgcagcattccactg

SEQ ID NO: 26183 - DNA, 77 bp, Homo sapiens
  chr1:35247068-35247145
  hyper
ttgcagagtgcttcccgcccctgatctcattggagccttcggacagcccagcccatggccaccgatgcccccatttc

SEQ ID NO: 26184 - DNA, 243 bp, Homo sapiens
  chr1:35258561-35258804
  hyper
ctgcgctatttaaggcgcccccgccgctcgtgcggtccagcagggctcccgcgggcgtcactccggccatcgtccccacctccacctgggccgcccggcaggcaggcggtgagtcgggggctaggaagggaccaggggcgccacctgctcgcgggaggccgggaggagtcttgggtcctccgatgccgggacgggggttgctgcggaacgcccgccgcgacagagccgcgctcacccaggtgg

SEQ ID NO: 26185 - DNA, 817 bp, Homo sapiens
  chr1:35351039-35351856
  hyper
cagggtcagagccctcgtgggcgcctccccgttccatacctgcaccccaatggacggccgccacttccgctgccgcgccaggctccgcagctcctccctgccagggatggtcttgatgatgagtgtggggggcttggggctggcccggggcggcaccggcgccaactccagtgtgcgcgcacccatggcggggccgtccagcccgtcggcggagctgcagcgccgggcggggccctcggccgccgtgaagctctcgtgcgcggagtcggtgctgctctgggcggtgatggagatgcggggcggggcctggcttcccggcgggatggggggcggggcctttctgaagttgaaggctgtggccggcgagcgcagagacgcagtgggtgaggctcgcggccctgcctgggtcctgggcccgcgcccgactcccaccctcaagaggccctacgggaccctgcagcggcgcgcactccacatgctgctgcacacacgccaacggacgctctccccgtcatccgaccccgggagcgagcgatctgcgcgggtcacagcacagtcgagggggaggccagaacccggacccagggcgctctcctgcctagggccgggccaggggcaggaaggtgtactcacaggagccgggcctccctgagacagcggcaggggtagcgaggaggggcaggcagtcgtcgtcttgagagcagccggcctggatggcccggaggtagctgtggctccgcatgcggaaacagccgggcaggtccagggcgtccacggcctgggactccagctccccaaacaccgacccgcacacggc

SEQ ID NO: 26186 - DNA, 60 bp, Homo sapiens; identical to SEQ ID NO: 5400
  chr1:35390613-35390673
  hyper

SEQ ID NO: 26187 - DNA, 166 bp, Homo sapiens
  chr1:35395375-35395541
  hyper
cgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacccaggaacaggcaccc

SEQ ID NO: 26188 - DNA, 507 bp, Homo sapiens
  chr1:35395542-35396049
  hyper
aagtgtcacggccacgcacagccgacctgggtacagggacccaagcccggcggcgggcgggcggtcggggaccagctcagcctcacggaccgggtctcgccccccgccgaggggcagtcacgccctgaatgtcacacacagcccccaggcccgtccgcttaggagactctccttcgggctttcccggtcggccgcctgacctcagctcctggcttggggtcagggagcccccctcttcggccccagcccctgccaggatggggcgctgtgcccggcctcggagccgctggcaggcgtcccccacccacagtccgcacagccgaggcatccccagtgtggagggagagccccgctgtacctgccgcctgtgctgggcccccgcccgtgcccactgtgcccgcccgcctctgggccctgagcctgggattgtgccatggcggggtcggggtggggggaaagggactgtccgaagcacagctggaggctgcggagcccggacacaggctg

SEQ ID NO: 26189 - DNA, 24 bp, Homo sapiens
  chr1:35396107-35396131
  hyper
cgcccagagcgatgctgtaatggg

SEQ ID NO: 26190 - DNA, 940 bp, Homo sapiens; identical to SEQ ID NO: 21
  chr1:36042549-36043489
  hyper

SEQ ID NO: 26191 - DNA, 30 bp, Homo sapiens; identical to SEQ ID NO: 5405
  chr1:36549840-36549870
  hyper

SEQ ID NO: 26192 - DNA, 164 bp, Homo sapiens
  chr1:37498362-37498526
  hyper
gtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagag

SEQ ID NO: 26193 - DNA, 92 bp, Homo sapiens; identical to SEQ ID NO: 1674
  chr1:37498753-37498845
  hyper

SEQ ID NO: 26194 - DNA, 795 bp, Homo sapiens
  chr1:37498888-37499683
  hyper
cgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactc

SEQ ID NO: 26195 - DNA, 428 bp, Homo sapiens
  chr1:37500013-37500441
  hyper
gggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagc

SEQ ID NO: 26196 - DNA, 133 bp, Homo sapiens
  chr1:37500442-37500575
  hyper
cgagagctggcaccgcgagctgggagacggcggcagcccagcggccggaccagctggaggagacgcgcccgccgggagcagcgagaccgggagcccgccgtctgcggagcctggcctcgcggctcccacgcgg

SEQ ID NO: 26197 - DNA, 372 bp, Homo sapiens
  chr1:37500602-37500974
  hyper
cgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtag

SEQ ID NO: 26198 - DNA, 33 bp, Homo sapiens
  chr1:38100650-38100683
  hyper
aaaaatggactggagcgccggcccgggagtcca

SEQ ID NO: 26199 - DNA, 435 bp, Homo sapiens
  chr1:38219523-38219958
  hyper
tggcagcatggggaccgaaccgatggtgcgaaggtcgggagcccccctttcggctggagggtaggcagggtgaggagagggcagcggaggggcgctctcctcagtgatctgccaggcatcctaaccccatcctccgtctggactctcgcagttgtcctggttcttctcatcaaaggccccggcccccagggcgcgtccaggctccgctcccccgtacgccgccttccggggcgctggcccccatatccgcccacgtgcgccccagtgcggagaccctgccctcaccaccacctggatcaggccttccttcttggccactcccaccccccaccctccgcagtgcagcctggaggggggactcacgggtgcaggaagccgagggcgggtcggtgggtgagcgcgcatagctgtcctggcacacgcagaaggtggagg

SEQ ID NO: 26200 - DNA, 237 bp, Homo sapiens
  chr1:38230006-38230243
  hyper
ctggattcaactgagcgtatagctcccctaaatgcacaatcagaggcaagacgcgggctccagtatcgccgacagcctcaaacccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtc

SEQ ID NO: 26201 - DNA, 3 bp, Homo sapiens
  chr1:38230282-38230285
  hyper
cgc

SEQ ID NO: 26202 - DNA, 218 bp, Homo sapiens; identical to SEQ ID NO: 5415
  chr1:38230623-38230841
  hyper

SEQ ID NO: 26203 - DNA, 163 bp, Homo sapiens
  chr1:38510087-38510250
  hyper
aggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacact

SEQ ID NO: 26204 - DNA, 424 bp, Homo sapiens
  chr1:38510310-38510734
  hyper
tagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatc

SEQ ID NO: 26205 - DNA, 160 bp, Homo sapiens; identical to SEQ ID NO: 24
  chr1:38510773-38510933
  hyper

SEQ ID NO: 26206 - DNA, 866 bp, Homo sapiens; identical to SEQ ID NO: 25
  chr1:38510934-38511800
  hyper

SEQ ID NO: 26207 - DNA, 293 bp, Homo sapiens
  chr1:38511821-38512114
  hyper
cgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggc

SEQ ID NO: 26208 - DNA, 27 bp, Homo sapiens
  chr1:38512126-38512153
  hyper
cgcctgccttgccgtgttctaggtgcg

SEQ ID NO: 26209 - DNA, 39 bp, Homo sapiens
  chr1:38513064-38513103
  hyper
tcaccgcgcccgcctcgcctcccgcggctgccagcgtgc

SEQ ID NO: 26210 - DNA, 32 bp, Homo sapiens
  chr1:38599724-38599756
  hyper
ccggggtgggggcctcgcggggttggggggac

SEQ ID NO: 26211 - DNA, 20 bp, Homo sapiens
  chr1:39025499-39025519
  hyper
cggggcggggcggggggcga

SEQ ID NO: 26212 - DNA, 74 bp, Homo sapiens
  chr1:39044122-39044196
  hyper
acggggaccgggagacgcgatccggagagcggtgggaagtattcgcctccgttcctcaaacacaggatgcgagc

SEQ ID NO: 26213 - DNA, 109 bp, Homo sapiens
  chr1:39044197-39044306
  hyper
ccctttggagaagtcgcgctcggcggaaacgctaactccccggccaagtgcaaatgtaaagaggccctgagagcactttgtgcaaatatcaggccgggaagtgctgcgc

SEQ ID NO: 26214 - DNA, 520 bp, Homo sapiens
  chr1:39269643-39270163
  hyper
ccgactagcattgatcgctttttgatcttaaaagaaatactttttaattcgaaagttaatagaaatgcggagtcaggggcaggcctcggcggcgtccgggctgggggcgaggcgcccacgccccaccctcccgctgtggccgctggcgccggcccgagcgcgcgcagcccggtgcgcttcggcgcccgctgagcccgcgaacctctccgccgcgccatcagcgcagccatcagccgcgccgcgtgctgtcccgcgccccgctgctcgcggccgcgggccaccggcggtaataatgaggcacagcgccatgaccgcggccctcggctgcgccgccggcagcagcgcgggcgccgcattagcatctccgaagccttcctgtgtgttcttttgtgctcattttccagcccgaatgctcggcacatcccggaccgcggacggagccgcaggagccaccgcggccgaacgtagctgccctggttttagaaagagctgcgggctgcgggcccggctgtccccgaga

SEQ ID NO: 26215 - DNA, 33 bp, Homo sapiens
  chr1:39284513-39284546
  hyper
aggcaggcctccccgcggcgccttccagggctc

SEQ ID NO: 26216 - DNA, 614 bp, Homo sapiens
  chr1:40105079-40105693
  hyper
gacacctgtggcccccgcgctcacctgcctctgcccaggcggtgctggagggctggcccgcctgctcggcgagcccgtcgggccgacccccaccccgctcgccctccgcctgctcggtccccgcatcccggcccttacctcagctggccctcttggcccacgtcgatgggtccgtcggactccccgtcggagccgctcggctccttgggtcgcttcatggcgaacgcaggctgcctggtctcagccccgcggctaaggctcccagtcgggaagtcaggccccgccccggccccgccccggccccgcctcgggggcgccgccaccgccctttcccagggccctttcctgcgccgcagctccgggcgcccaggcgccccctcgcccccgcggtgacgcgccgccgagccgtgggaaggccctaggcggtcgccgccttcatcgacggctgggaggtccggctctgctccgctgtctcggctgccgcgcgctgggtggccttgggcaggtgccctgggaggccccgcggggaagccaggagtccccgtctgtccctgggtcgcctgggcgctgctggcctgtagaggcgccgcttcgatgcccgggattccgcaagg

SEQ ID NO: 26217 - DNA, 26 bp, Homo sapiens
  chr1:40137581-40137607
  hyper
gggtttcttcttgggcgcgaggttgt

SEQ ID NO: 26218 - DNA, 83 bp, Homo sapiens
  chr1:40137646-40137729
  hyper
cggtctccgctcctggcccgggctcgcggggctcctggggctcccggggctgcccaggttccatgctccggctctgacccggc

SEQ ID NO: 26219 - DNA, 169 bp, Homo sapiens
  chr1:40157762-40157931
  hyper
tctggcccttcattccggtccctccccagacgggccctcctcctttctcatggacccccaagaggcctctcgcgttctcccccgaaggacccctatgcctagccatggatcctccattccccaccctcccgttttcccgtcccgcagacggagccggtccccagccgcc

SEQ ID NO: 26220 - DNA, 30 bp, Homo sapiens
  chr1:40204397-40204427
  hyper
cttggtttaccactgcgcacctcacaaggc

SEQ ID NO: 26221 - DNA, 144 bp, Homo sapiens
  chr1:40237059-40237203
  hyper
gctctaggctaggcccgcgacccgcaacagggagggggccggctccgccctgggctgggggcccccgagtcagtcctccgtgtccagcgcacaggcccgggcgcaggacagagctgaggtcaggctccgcgagaagggcacagg

SEQ ID NO: 26222 - DNA, 488 bp, Homo sapiens
  chr1:40781403-40781891
  hyper
aagcgaccctgggagcggggtcctaggggcgcagctcttccgcgaactcccacgtattgagaatcttctgtatagcaggcactgtgtgccattacatgcattcattatcttacagaatactcagaaccgggaggcgggcgctattacgggccccagtttgcagtcgaagaaactggctcagaacgtgaagggtccatggtcactgagagtgggcggcggcgccaggagtccgccctggatctgcccgactccttccactgtgccagtttgcccttgcgcggtcgcggtggggaatagatggagacgtggacagctcaaataaatcacagatggaatgtaaggttgtgcctagcaggctgccggccctcagtgagcggtggctcgggttgttgttcttacgtgaacgacaggcagagacagcgcctcctcctctccccatggtgcgggaaaacccgacgggaaagtgggggaggcgcagagaaaggagg

SEQ ID NO: 26223 - DNA, 150 bp, Homo sapiens
  chr1:40782758-40782908
  hyper
cctggaccctggcagcggaggggctgcgaaacttacaatctgcgccagagcgagcactaccacctggaggagaacaaggaggctgcggggggaggccgtagcggcggccatggctggcggcgagaccaagggggacgggtgcgtgtccgc

SEQ ID NO: 26224 - DNA, 142 bp, Homo sapiens
  chr1:41267904-41268046
  hyper
tgtgaggtggaagggcgaggccgaggcggcggtggcgtcgcgtcccccctctccgcccctggcctcggggacgcggcggcaccttcacactttccgcttggcccgctgctcgcctttcaggccgccgcgttttcaattgtta

SEQ ID NO: 26225 - DNA, 503 bp, Homo sapiens
  chr1:41284150-41284653
  hyper
tgatctcgccgcccccgcccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaagccgcgcgcggagacccgagggcgtgtctggggcacgaccagagcgggcagggcggagagggcgaggtcagaggggctgtctccgtgctgggaaggggtgtggcctgcgggggttggagccctagcaggaggcgaggtctaagcgggtggggcgaagtggattctgaattaggtaggggcgggcctaggagtccggaccggatcagggggcggggccggagaggcggggcttgagggtttcccctggatgcttctgggtttgaagggaccactcgtaccacaaagtgg

SEQ ID NO: 26226 - DNA, 73 bp, Homo sapiens
  chr1:41327007-41327080
  hyper
gtctctttcactttacggccgaggctggggtcagagaagtgaagccaaactgtcctcccgcaggaggcaaggc

SEQ ID NO: 26227 - DNA, 39 bp, Homo sapiens
  chr1:41350136-41350175
  hyper
cgcgctcaccaccaccgcggaggccgggctgtaattagg

SEQ ID NO: 26228 - DNA, 92 bp, Homo sapiens
  chr1:41444864-41444956
  hyper
tgaaaccgtacttttcgggatcctagtccatccaaagcagccgccttcggggcaggtgtggggaggagggaggccgacgaggagccaacgcc

SEQ ID NO: 26229 - DNA, 657 bp, Homo sapiens
  chr1:41847296-41847953
  hyper
cggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaa

SEQ ID NO: 26230 - DNA, 56 bp, Homo sapiens
  chr1:41848262-41848318
  hyper
aatggacttcaacttcgattcggccctgcctccgccgccgccgggcctggccgggg

SEQ ID NO: 26231 - DNA, 33 bp, Homo sapiens
  chr1:41848943-41848976
  hyper
gcttctcccctcccccgtcggagtcagtccctc

SEQ ID NO: 26232 - DNA, 57 bp, Homo sapiens
  chr1:42128290-42128347
  hyper
ggaatccctggctgccggcggccgcggggagggtctgcgcgccggcctcctcggtga

SEQ ID NO: 26233 - DNA, 11 bp, Homo sapiens
  chr1:43533901-43533912
  hyper
ggtgtgcgccc

SEQ ID NO: 26234 - DNA, 131 bp, Homo sapiens
  chr1:43534114-43534245
  hyper
cgcccgctgagcaacgtgactgcgcgggctcgggtccccaccaggacaaggcggcctctgtgccgacccagctgattcctctcgggctgcaaatcccttccggctgacagccctgccggctggggccaggc

SEQ ID NO: 26235 - DNA, 124 bp, Homo sapiens
  chr1:43613496-43613620
  hyper
ccgggcagcactacccgagcgctgttgcctggagaccacgggacgccgttgcctggagacagcggggacgcgttgcctggagactgtggaaggcccaggcaagagggcgcgtggcagcccaagg

SEQ ID NO: 26236 - DNA, 156 bp, Homo sapiens
  chr1:44402104-44402260
  hyper
ccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgac

SEQ ID NO: 26237 - DNA, 265 bp, Homo sapiens
  chr1:44872458-44872723
  hyper
tgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttc

SEQ ID NO: 26238 - DNA, 141 bp, Homo sapiens; identical to SEQ ID NO: 28
  chr1:44872923-44873064
  hyper

SEQ ID NO: 26239 - DNA, 108 bp, Homo sapiens; identical to SEQ ID NO: 29
  chr1:44873065-44873173
  hyper

SEQ ID NO: 26240 - DNA, 315 bp, Homo sapiens
  chr1:44873509-44873824
  hyper
gggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttc

SEQ ID NO: 26241 - DNA, 146 bp, Homo sapiens
  chr1:44883069-44883215
  hyper
tggggccaggctggacgggagcagtccctgatggctgcagagccatctggcctggcttggcttggctcggcgcgccgctcgcctggcggctgggctcgctgtagttgtgctcccgctcttcccctgccctcgctccacgccgcgcc

SEQ ID NO: 26242 - DNA, 372 bp, Homo sapiens
  chr1:44883751-44884123
  hyper
cgccgtctgagcagaagagagtgggaaccggggtgacggataaggggggggcgcccacgcgacgtcggggtgcatgggagcgcgcgggaggcgctagtgggtgcacggggcgtgagggggacacagcgcgggcgtggggatggccactgcgcggggagggttctgcctggagaaggagggatgggaggaggttgggggagcagggcgcgtggaggagggaggttggacgtgtgtacagcgcctggggacctcgctggccccttggtgcccccaggactctgaggcttctcctttcggcttgaaatgtttttcccttcctgcttttcaaatctgtaaaaatgttccggggaatgtttccgaagtccagggctc

SEQ ID NO: 26243 - DNA, 154 bp, Homo sapiens
  chr1:45250008-45250162
  hyper
cggccgaagttccggaggctgatggccggggagggcgcccctacgcccaggaagcggccgagcaacggggtctgcgcggcgggcgcgggccgaccagatccgggggacgcctccacctgcaggctctgctcagggtcgtcgctcatgctgcggg

SEQ ID NO: 26244 - DNA, 173 bp, Homo sapiens
  chr1:45250192-45250365
  hyper
cgggagcggggacgcgggatcggctctcggggaaggaccgaggcatcggtgccccagaggctgagcgaggacccgcgtgccgggtcaggcccagtgcaagccactcaccgcaggttgaaggtggagcccaggaatgagggccgcagagactcggccgccgtggccacagtgta

SEQ ID NO: 26245 - DNA, 330 bp, Homo sapiens
  chr1:45251926-45252256
  hyper
agttgcaccctctgccgccaggggaggctgctgttccgccgtctggctcccctccctcgcgtccaccggctgtcccaggactcgcggttccgcgttcctgtcgcagtccagacccttccctggaggcccctgctcccaggactctcccaggcgccacctgcatccggctgtgggccggacccccagaggctcccggcgggcggcgcacctgcgtccaccacgtgctccatggtggggaagcgcttaagcacgcgggtgctgaccgagcgcagcaccagcacggacgccaggttcgcgtagcggatgagggtgcggcgcagcaggcggccc

SEQ ID NO: 26246 - DNA, 251 bp, Homo sapiens
  chr1:46632721-46632972
  hyper
cgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctgctgccaaagctccgaagctctggatgt

SEQ ID NO: 26247 - DNA, 42 bp, Homo sapiens
  chr1:46859934-46859976
  hyper
ccagtccgggttttgcggcggagcgggcgggctgcgcgtgcg

SEQ ID NO: 26248 - DNA, 91 bp, Homo sapiens
  chr1:46913786-46913877
  hyper
cgcccgcattcagttcgaaggaccagccagtaggccctgcgccgcccagggaccgcccggcctttgcgtccggcccagctcaagccccttc

SEQ ID NO: 26249 - DNA, 360 bp, Homo sapiens; identical to SEQ ID NO: 1693
  chr1:46913886-46914246
  hyper

SEQ ID NO: 26250 - DNA, 148 bp, Homo sapiens
  chr1:46914285-46914433
  hyper
cgcggagggccggacgggagccaaggcggctcagttcctcttctcccccgagcaggcgaggagaggtggggtctcaggacctccaaggccctgttccccttccattggcatttgtgtaaggacgcaggccctccgcactgctgactgt

SEQ ID NO: 26251 - DNA, 132 bp, Homo sapiens
  chr1:46951186-46951318
  hyper
gtgaaggggagtagccgtcggagggcggggacagagcggtagctgccttgcgctgggattgggggtgggggtgggagtggggagggctctttaagcggcggccgcgctaataacctgtccaggagatggctc

SEQ ID NO: 26252 - DNA, 118 bp, Homo sapiens
  chr1:46951644-46951762
  hyper
cgcccggaaggggcggggaggggccccggccctcaagccgcacagccaggtgttcccgctcttcgaggacatcccctgcccgcctggaggttgagagggcggccgcatggggcattcg

SEQ ID NO: 26253 - DNA, 356 bp, Homo sapiens
  chr1:46956260-46956616
  hyper
aaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttg

SEQ ID NO: 26254 - DNA, 155 bp, Homo sapiens; identical to SEQ ID NO: 34
  chr1:46956684-46956839
  hyper

SEQ ID NO: 26255 - DNA, 314 bp, Homo sapiens; identical to SEQ ID NO: 35
  chr1:46956840-46957154
  hyper

SEQ ID NO: 26256 - DNA, 437 bp, Homo sapiens
  chr1:47009449-47009886
  hyper
ccctcagccccctcccgccagcgtcccccagctccttcacttgcctgagcccgtccgtggacactcccctgcgggtccgaccaggctgacccttgagcaccctgggtcagcaggaaggaaagaccccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggca

SEQ ID NO: 26257 - DNA, 126 bp, Homo sapiens; identical to SEQ ID NO: 37
  chr1:47009910-47010036
  hyper

SEQ ID NO: 26258 - DNA, 28 bp, Homo sapiens
  chr1:47010104-47010132
  hyper
cgtccgcactttccgagagccaggcacg

SEQ ID NO: 26259 - DNA, 35 bp, Homo sapiens
  chr1:47691684-47691719
  hyper
ggcagacaaagttagcgccacgtggggctagggcg

SEQ ID NO: 26260 - DNA, 101 bp, Homo sapiens
  chr1:47694827-47694928
  hyper
agacaccgtttccaccggcaccattcccctgaaaactcacctggggcatatttagagagaccggcccctctgaataggatctccactccgccggaaagggg

SEQ ID NO: 26261 - DNA, 607 bp, Homo sapiens
  chr1:47694979-47695586
  hyper
cgctgagaggcctgcagttacgctgcggtgtggtcctgggcgatctgccgcgcccaaagcgagtttccaggaaagataggggtggagagaaagaggcagggcaagagggagggagagagagaaatgggggtcaatggctgggaattacctcctgtccccgaccaaccagtccagggaatcgcaaacagctttccgcccccaacctgcaggtgtttggagcctttcctctaccccctcctccccccacccgccttaaaaaaccctatacatgaccaatcaggaatagctatttagtccaacagcaacaacaacccctcccgacaggctgtctggaacattttcgaaccctccaactgggatcggtctggttcagtgtttgttttctaagcagggaggtgtctacgcggttgcctcctcagccaggtctccggctgccgctacaccgcgaagggatagtcccgggcctggatgggcggaggtccgtgttgggaaaggcgaatagtcttcagactctggtcggtgggacagaaccttgaagtcccccccacctcattctctctctgacccccatccacccacctccagcccaaagcgaaaccagaaccca

SEQ ID NO: 26262 - DNA, 625 bp, Homo sapiens
  chr1:47695896-47696521
  hyper
aggtaaaaacaaacccgacactactttcaaggatgtagcaggattgagcttgcttttattttttcctagtggattttgtttaatttgttttgcctaaatcgtcaggcttatgatcacacatcgaagtcttggattaactgcgaaggcctccttctatttgccgcggctttggtggacatataggaataattcttccctggattgcaatacaatgcggaagattttctttctcctcttctaatccaaaagaggggaggggaggaaagaagaggggaatccatccattcccggcgtgttcgcggggggttaatgttgcgtgttcgctgggggttaatgtttgccttatgaccaagtctctgtgtccgtgcctctctccattttctcttcctacctcaaacccagcaacttagaaaacggctgtagcggaaaaaaacccgctgctttgttctcccgccaaaggagccaaaagggacaaactgctgcgctctgggatgattattttaattaaaatagatgttaatgatgacgattgtgatggtgatggcattagcaattacaataattgacaaaacaaaattctttcaacccgagctagggccccactaacccggtccctcccagagcc

SEQ ID NO: 26263 - DNA, 345 bp, Homo sapiens; identical to SEQ ID NO: 40
  chr1:47696620-47696965
  hyper

SEQ ID NO: 26264 - DNA, 70 bp, Homo sapiens
  chr1:47696986-47697056
  hyper
cgcccccaccagcgcctcgatctctcgctcgccctccccccactcccgcccccagcgatttgcaaacgca

SEQ ID NO: 26265 - DNA, 606 bp, Homo sapiens; identical to SEQ ID NO: 42
  chr1:47697341-47697947
  hyper

SEQ ID NO: 26266 - DNA, 188 bp, Homo sapiens
  chr1:47698006-47698194
  hyper
cgaggcgcgccggggccgtgtgcgccgcagagataaggcactgccgcgggtccgcccgcccccgataagcgcctcggccattatgggccaaatgattcattttaatttggcaatttcaccggagggagtggggactggttgagcggcgctaggaccggctccggaacgcgctgcggggagcgttggac

SEQ ID NO: 26267 - DNA, 232 bp, Homo sapiens
  chr1:47882033-47882265
  hyper
tccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcac

SEQ ID NO: 26268 - DNA, 72 bp, Homo sapiens
  chr1:47882266-47882338
  hyper
ctggccgccatctaccgcttcatcaccgaacgctttgccttctaccgcgacagcccgcgcaagtggcagaac

SEQ ID NO: 26269 - DNA, 76 bp, Homo sapiens
  chr1:47882759-47882835
  hyper
ccccgccactctactcgcaggtccccgaccgcctggtactgcccgcgacgcgccccggccccggcccgctgcccgc

SEQ ID NO: 26270 - DNA, 55 bp, Homo sapiens
  chr1:47904617-47904672
  hyper
gggctggctctcccggcctacggcgcacccccgccggggccggccccgcatccgc

SEQ ID NO: 26271 - DNA, 484 bp, Homo sapiens
  chr1:47909535-47910019
  hyper
gagttgaggtgggggcggacacttcccctccatatccaatttgctcttgccacagcgggcgcgtcttcgtggttacaaagcgctttttccctgatgacttttttccccttttcaaaaacacttctttctccccccttcaactagcaaccctccccaggcccacccctcctccctctccgctccggtttatttaaacttcgcctcctccagcgccgccgcagcgcgcacttaatgaagttgaaggctcggtgagcccgggtgaagagggtttggaatctgttgaaaggggcgttttgtgacactgattggggcgggggcgggggcagtcgcggaccagacaatgaccgaccaggcgggttttcctgcgcacagggtcaggcgaataaaggcgccgacgctgtttaaacgaaggaccttgtaagagaaagggagaaaagattttgtgtgtggagcgtgcctcgtaaggtttcgtgcttaggagaag

SEQ ID NO: 26272 - DNA, 117 bp, Homo sapiens
  chr1:47910508-47910625
  hyper
cgcctccttccgtagcggagcgagagctgccgctcgaggctgaggccgctccggaggcctggaggcttcggactgctggactagtggggaaggaaggcggtttcctccgcagcgccc

SEQ ID NO: 26273 - DNA, 127 bp, Homo sapiens; identical to SEQ ID NO: 5466
  chr1:47910748-47910875
  hyper

SEQ ID NO: 26274 - DNA, 360 bp, Homo sapiens
  chr1:48058946-48059306
  hyper
cgccgccgccagcccggggctgacctctcagagcagggcggaggattttcacagcacagcttcccgagagagcgggattaagggggaactgctcgggtgggccagagccaggggctagggggaggccgggcggaaacccaaaacctccgcagctgtttccagtttgccgccctggctggaccgcggtggctgcgtgcagagcgagcaaggctgcgcgggcctggagcgcccacggggcgcgggacctctctctgtctccccccgccccgcggggctctctctcgtcctctctgtcttggtggggctcagtctgtctctcgttttctctccctgtttctaagatctcgtggaatcaaagac

SEQ ID NO: 26275 - DNA, 188 bp, Homo sapiens
  chr1:48190874-48191062
  hyper
gcccagcggccggagcgcgcggcgcagccatcgatcgcggctaatggcctcgtctaaatgcggagccgctgcctccgccccccgggtcagggcgcccccgccctcgccccccgctccgtgcaaaatggtgtttaccaaagtcaatattggccgcggcgcccgcccggggcacccgggagcccctctgg

SEQ ID NO: 26276 - DNA, 310 bp, Homo sapiens
  chr1:48462159-48462469
  hyper
gggagcgccccttctcgctcctggctgggagctggagccgggacaggcaggagcgaaggaagggcgcccgaggctgcgcccggggggtggaggtggagcgggcgggctaaggtgggtgcggaagcaggacccaaaccatggtcccacgggactagaatacccaggcaggcgggagagtggccgggcaggcgctcgctcaccgatccgggcggccggcactgtcctccgtccgggggctgcgggcgggcgcgagcggtggcgaggagggcggcgagcagcggccccgccagggcggcgtgcatcctgccag

SEQ ID NO: 26277 - DNA, 25 bp, Homo sapiens
  chr1:49242334-49242359
  hyper
cgcgcggggggctctcgggcccggc

SEQ ID NO: 26278 - DNA, 153 bp, Homo sapiens
  chr1:49242360-49242513
  hyper
cccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcgcc

SEQ ID NO: 26279 - DNA, 19 bp, Homo sapiens
  chr1:49242514-49242533
  hyper
ggggcgggccccggtcggg

SEQ ID NO: 26280 - DNA, 64 bp, Homo sapiens; identical to SEQ ID NO: 5472
  chr1:49242884-49242948
  hyper

SEQ ID NO: 26281 - DNA, 60 bp, Homo sapiens
  chr1:50489576-50489636
  hyper
cggttgcctgggcaacgggcggcaggcgcgcgggtggccggcgcgcggctgagggcggga

SEQ ID NO: 26282 - DNA, 515 bp, Homo sapiens
  chr1:50513687-50514202
  hyper
gtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcg

SEQ ID NO: 26283 - DNA, 665 bp, Homo sapiens; identical to SEQ ID NO: 1710
  chr1:50798652-50799317
  hyper

SEQ ID NO: 26284 - DNA, 221 bp, Homo sapiens
  chr1:50799393-50799614
  hyper
cggcggcagccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcc

SEQ ID NO: 26285 - DNA, 386 bp, Homo sapiens
  chr1:50880931-50881317
  hyper
cggcccgggttcgcatcctcccactgctcagaccgagtcggctccagcttgctttgggaagcattcaggaataaacgtggacagtagcggtcaggaaggagattcccgtttccccttctcccaggaggaaaagaggtaacgctgccgccactgccctctctttccagggtgggaacgccgcccgagaccggggtaccccacactcctccctagcgctgatcccagcggagctcaggccgcagtcccctcctgccggctgcggaagctcccagaagcggagactcaatcgcccccctgcccctgctaccaggccagagtctggagtacagatactggctccctggggcctgggtgtgcgaccccaggccggtcattgcaggtctctg

SEQ ID NO: 26286 - DNA, 531 bp, Homo sapiens
  chr1:50881426-50881957
  hyper
cggggcctgggccatggagacgctccgggcccaggaacgggggacctcgggtgccccactacctcactcctagaacgcccaccgctcacgaagccttcctgagctctacccgaaggtgctgacagcctggagctgaggccaaggcgcttgggggcacgctgcttctccctgggcctcctatgttcacggaaggagagtttccgcaaacctctcactctcggccagcagaccccgcttcatgagaggaggagacccactaggggcggtggagaggcgaagtgatccagggtcccggaaagttggacaattccctggaccagatggctctcagtttcctcctctgtaaaatggggccggtaataagcaactctctggattcaccccggtttgctgcgaggatgaactaatataatagtctttaagtctgtgacgctccagatgttcttgggaatgagtaacgcgggtccacaggccgccccctcgggtccggccagagcatcggcaggaaccgaggagcctcgggggacccag

SEQ ID NO: 26287 - DNA, 409 bp, Homo sapiens
  chr1:50882143-50882552
  hyper
cgctttctcccgcctgcctcttttctttctaactcttccctctcctgtctcctctcgccctcttttttctccttttttatccccttttcgtccatcgctcttgccggcatctttcttctctgggtccttctcccccactttcatctcatcgcgctcgcacttcatcaccagacagccaaaccccctttccaattaaagtggaattaggcaactcaatcaaattagttccccattaaagcccttctttattaaaccgttttcttgtcctgctattaagtttcactgcctggcggaactcgagccggccccagaagtttaccttgggatgtcgccggacccagccgaggggaggagtcattcttttcctggagcgggggagtcaccctgcggggagcgggagggactggag

SEQ ID NO: 26288 - DNA, 1211 bp, Homo sapiens
  chr1:50882766-50883977
  hyper
gccaccctgcccagccgtcgccttcgttgcctgtggttccaaatctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgcttcagtgcgcaccttgacggctccttagggacagaccagccgcaggcaagaggggcaggtgggcaggattcatcccgagtttccaatatatttaatctctaaacctgataagtacaatgcgcgcatagtctaatttttttccattttgtccctttttttgcttgttttgaatgtttttcacgttaataccgaggtcacctacagattacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaatttatatttgttagagcgaatatttaaattttttaaaagtgagggctggggagacacagaaaagactctcggattatcctgccatccactgagagc

SEQ ID NO: 26289 - DNA, 333 bp, Homo sapiens; identical to SEQ ID NO: 46
  chr1:50884020-50884353
  hyper

SEQ ID NO: 26290 - DNA, 198 bp, Homo sapiens; identical to SEQ ID NO: 47
  chr1:50884690-50884888
  hyper

SEQ ID NO: 26291 - DNA, 194 bp, Homo sapiens
  chr1:50885248-50885442
  hyper
cgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggtta

SEQ ID NO: 26292 - DNA, 1030 bp, Homo sapiens
  chr1:50886055-50887085
  hyper
gcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtag

SEQ ID NO: 26293 - DNA, 60 bp, Homo sapiens; identical to SEQ ID NO: 49
  chr1:50887175-50887235
  hyper

SEQ ID NO: 26294 - DNA, 30 bp, Homo sapiens
  chr1:50887723-50887753
  hyper
agagagatgtgaaggcgcagatgtgaaggc

SEQ ID NO: 26295 - DNA, 565 bp, Homo sapiens
  chr1:50888231-50888796
  hyper
gagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctc

SEQ ID NO: 26296 - DNA, 727 bp, Homo sapiens; identical to SEQ ID NO: 1721
  chr1:50889123-50889850
  hyper

SEQ ID NO: 26297 - DNA, 318 bp, Homo sapiens
  chr1:50890061-50890379
  hyper
tttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctc

SEQ ID NO: 26298 - DNA, 20 bp, Homo sapiens
  chr1:50890629-50890649
  hyper
cgcgcagactcggcccgggt

SEQ ID NO: 26299 - DNA, 689 bp, Homo sapiens
  chr1:50890795-50891484
  hyper
cgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatgatagcgataaaaagctggttactcgctcccagaaaatgccacttgctggagtctgtgaatgggtttaggagagagaagggtgtcagcccccgcgagggtctcccgcgtgaagtgaggataagggagtgcttcagggataatatgtcctctaggagcgcaggacccagaccccaccttccaacacctggaggttccgaggccaagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgcgtgaggaacttcat

SEQ ID NO: 26300 - DNA, 131 bp, Homo sapiens; identical to SEQ ID NO: 1725
  chr1:50892153-50892284
  hyper

SEQ ID NO: 26301 - DNA, 813 bp, Homo sapiens
  chr1:50892336-50893149
  hyper
cgtactcttagctcagaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccaggggcgccgatgggggacccgggaggcattgacttttgcgctgtttgcccgcggcctcggagcaagcagacgccatctgtttgccggctgcgacgcgtcccgtttaattaccctcccggcagcctaatagagatgatattaaactaaatctttctgacattaaaagtaattatccccaaaccggtggctccgggacggaatggcccctcccgcacccaccccttccctggccgcgccggattccgttagtttggctgatactctccgcccgggaatggggcgcagaggaaagggggaaagtgcctttgggagaaggaatctccacgggttgccctacacgcgttttcccgcacaaccacagactctcctgttcctatgtgaacacacgcacgtgtacacacagacacgtagcgacattttcctccagatcaactcatgagtcatgctgatgaagaccctcagccgcgcacaccctctgtggacagggagacgcgcagcttggtttcctgtccccgtcctctgacaccgctaaaatggtcattttcc

SEQ ID NO: 26302 - DNA, 273 bp, Homo sapiens; identical to SEQ ID NO: 5498
  chr1:50893150-50893423
  hyper

SEQ ID NO: 26303 - DNA, 359 bp, Homo sapiens
  chr1:50893518-50893877
  hyper
cgttggccgggaacccgctggtgctcagcttctatccggaccccggacctaaaggccgggcagaacaaccaactgaaggtggaggagcgagggcactggtgctgattgagcggcaggagcccccgaggcggagtcccagcggctgcagccctcctttggatcaagccctcgcgtcttccgggcaggcggaagggaggcgtctgcccagtgtcgccaggcttctcacgattttctggttgggagcatctaagcctgagacaaacgcatggagagcggtgttcaccgccccactatttgtttctatttgtgagcgtctactgagtacagccactctgataaacactcggtgtgtgctctct

SEQ ID NO: 26304 - DNA, 113 bp, Homo sapiens
  chr1:50896073-50896186
  hyper
cttcctggggcattgcggatggtgtgcaccggctacgtggtcttctttgggccatccttctcctggtttccatctcccaagaggaccccttgaaatagcgattccgagaatcg

SEQ ID NO: 26305 - DNA, 30 bp, Homo sapiens
  chr1:51442776-51442806
  hyper
ggagcaagaaaaggtcgtgctcacagcctt

SEQ ID NO: 26306 - DNA, 46 bp, Homo sapiens
  chr1:52456259-52456305
  hyper
ggacggtcggcgggacggcaggacctggcgtcgggagggcgcggag

SEQ ID NO: 26307 - DNA, 303 bp, Homo sapiens
  chr1:53067878-53068181
  hyper
tccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatcc

SEQ ID NO: 26308 - DNA, 463 bp, Homo sapiens
  chr1:53068182-53068645
  hyper
gggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgat

SEQ ID NO: 26309 - DNA, 370 bp, Homo sapiens
  chr1:53098683-53099053
  hyper
cgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttc

SEQ ID NO: 26310 - DNA, 312 bp, Homo sapiens; identical to SEQ ID NO: 5502
  chr1:53099054-53099366
  hyper

SEQ ID NO: 26311 - DNA, 352 bp, Homo sapiens
  chr1:53168843-53169195
  hyper
gggggctgcccagctcgccgtcctctgcagatcccctcgggactctcagcattttgtgggttagccgtggagacgccctgcccttcctgctttggccagtcaaccccctcaagcccgtgcccgtagagcctgcagcccttcctcacctcatcactccccatccccccaagatatagaaaggccgtgacagctgccagccctgcacatgctcttgtttcaacagcggcgattgcacatcacgtagtccccacgtgacctgtcgggcctagggcaagcgcaaagctttcggaaacccgaattattgcaaccttgacttcctgcctgtctctgaggctcccgggctgtgctttaa

SEQ ID NO: 26312 - DNA, 276 bp, Homo sapiens
  chr1:53308332-53308608
  hyper
ggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctga

SEQ ID NO: 26313 - DNA, 368 bp, Homo sapiens; identical to SEQ ID NO: 1728
  chr1:53308907-53309275
  hyper

SEQ ID NO: 26314 - DNA, 49 bp, Homo sapiens
  chr1:53527557-53527606
  hyper
ctgggaactaggaagcgtcgcggaccagacagcccgccttcccggtctc

SEQ ID NO: 26315 - DNA, 92 bp, Homo sapiens; identical to SEQ ID NO: 5507
  chr1:53527939-53528031
  hyper

SEQ ID NO: 26316 - DNA, 184 bp, Homo sapiens; identical to SEQ ID NO: 5508
  chr1:53528255-53528439
  hyper

SEQ ID NO: 26317 - DNA, 30 bp, Homo sapiens
  chr1:53528728-53528758
  hyper
caggttccaggtccccgagccacagcccgg

SEQ ID NO: 26318 - DNA, 838 bp, Homo sapiens
  chr1:54203828-54204666
  hyper
gtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaacaggagtcccaagctgggcgctgaatcctgcgacgcgaacccatcacgcgcagccgggacacccacattcctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgc

SEQ ID NO: 26319 - DNA, 168 bp, Homo sapiens
  chr1:54940331-54940499
  hyper
gctagaatgtgagatcgcggagggttgagtggcttttgccccacatcctgcggccagcagccggccatggctaggagaggcgcccgacgcctggcgctccccgtccgggtctccggccgctgcggggctgtgagggcccccggcggtaccggccgggggtggcccagc

SEQ ID NO: 26320 - DNA, 254 bp, Homo sapiens
  chr1:55462673-55462927
  hyper
ctgggaggggaggtgcggtcaccgctcagccgccgactcagccgagggagaccttggccagcccctgccactccgcaggctcggtttcctcgcctgtgaaatgcgggcgatgactcccctccccgccgcgactgctcatcaccgggtccgagcccagccgctgaccccgggggaagcgccttgctcagcgccgggcggcccacgaggccctgcaggaccgcggctgcggagaccgttcccgccacccgcctggg

SEQ ID NO: 26321 - DNA, 89 bp, Homo sapiens
  chr1:55505073-55505162
  hyper
gctgtttggggagggcgaggccgaaacctgatcctccagtccgggggttccgttaatgtttaatcagataggatcgtccgatggggctc

SEQ ID NO: 26322 - DNA, 30 bp, Homo sapiens
  chr1:55505516-55505546
  hyper
accgtcagctccaggcggtcctggtggccg

SEQ ID NO: 26323 - DNA, 522 bp, Homo sapiens
  chr1:57110923-57111445
  hyper
accccgcgcccgccccgcgcccctcgcggctcggggtccgccccctcgcccgcagggcccgctgcactgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagagttgagtacgcgctccggaccgctgtgcggggctgcctgacttgcgggaggccgaggggagaggcgggagccccgggcctccggcgggcgcggggctcggcggcaggtggagcggtcccgggtcgcgcggagctggggccccgggagggtggcgcgcaccgcctcgcctggcaccggcgcccgggccccacagggtccagggaagagggcgggggtgtgagctgaggatgggcgtcctgggttccaggttccgcgcccatctgcctttctggaggtcggagcaaggcactt

SEQ ID NO: 26324 - DNA, 36 bp, Homo sapiens
  chr1:57888031-57888067
  hyper
aggagggctcgcccccgggctcgcccccgtccagct

SEQ ID NO: 26325 - DNA, 70 bp, Homo sapiens; identical to SEQ ID NO: 5512
  chr1:57888327-57888397
  hyper

SEQ ID NO: 26326 - DNA, 255 bp, Homo sapiens; identical to SEQ ID NO: 5513
  chr1:57888780-57889035
  hyper

SEQ ID NO: 26327 - DNA, 568 bp, Homo sapiens
  chr1:57889036-57889604
  hyper
gtgcccgcgaaagggctgggattactgggatagagtcggtttttcgagaggtcgaagccgaatctcagcgctacggaggagtagggaagtgagaacggggttcggccgaatgaggaaaagggtctggccaccagcgagggagggagggagtttcgggagcccaggacagcgggagaaggcaggctcgaggtccgatatagccaggaccgcaggaggaaagagggcgcagggggtcttggagagagacgcgtgtcaggggtggacaagtctggagacaggatcgcgcgtggtcggaagtagggagacaggggcgcggggatggggggcaggacagagaaagagaagtcgcccttttcctcccagcaagtggagggagaaggcgaaaaactgctgcagtcgccatcctcccagcacccctagccaaactgctgagtggcgcgtcccaggagccctcctccgcgccccggggctccagcgaagcctcctggctccccggcgccctgtcctcgcggggcacctgcggcgctgaactcaagggttgccgcgcgcccccgccgcgcctcacctc

SEQ ID NO: 26328 - DNA, 427 bp, Homo sapiens
  chr1:57889605-57890032
  hyper
cctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgg

SEQ ID NO: 26329 - DNA, 327 bp, Homo sapiens
  chr1:57890258-57890585
  hyper
cttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 26330 - DNA, 174 bp, Homo sapiens
  chr1:58715153-58715327
  hyper
cagaaagaaagcatgcgtccggatggcgggagggttaaaattacagtctttgggtaagacccctggccagcttgcctggtttctagatacataagtggacagaaaagaaatgaagagaacgcggactgagcgaggaaatgctcaagaccacaggactgaaccccccggaagtct

SEQ ID NO: 26331 - DNA, 173 bp, Homo sapiens
  chr1:58715359-58715532
  hyper
cgacgcggatgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggc

SEQ ID NO: 26332 - DNA, 322 bp, Homo sapiens; identical to SEQ ID NO: 53
  chr1:58715533-58715855
  hyper

SEQ ID NO: 26333 - DNA, 268 bp, Homo sapiens
  chr1:58715978-58716246
  hyper
cgagcgggctccgcttttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagccc

SEQ ID NO: 26334 - DNA, 430 bp, Homo sapiens
  chr1:59042065-59042495
  hyper
gctccacctgcaggggttctccgcgcacgcgcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggcc

SEQ ID NO: 26335 - DNA, 271 bp, Homo sapiens
  chr1:59612368-59612639
  hyper
agggcacacagtgggcgcttagtaactgtagaaagaagtcgaacgaaatcggaagggggagaggcagaggccacaatcaagacacggaaacgacagtcagtcgaggcagcagagagggtttcacgcgggccagcggaggcgcagggcagttgagaagggaacttgccacggggcggaggggccgcgctccccaccagcgcggcgcgggggcgctaggccagggaccgccgggccagggaccgccggctgcgagcagcgggaacggacctgc

SEQ ID NO: 26336 - DNA, 259 bp, Homo sapiens
  chr1:61508695-61508954
  hyper
gagagggcgccgcagcgagtcccgagatccgagcccggcctcgacgccggagcgctcccggagctggtccttgcccgaagcgcattaaaacggcgccctctggtgtcagctcgcggcggccgggtaaaagcagtggcgctgggggtagagttctactcgccaccctgttcgcaaactgaaagatccccgagtttagaaagtgtcttgccgctctgcggacgctgtgtccgcggccccgctgtcgcgcagagctgggctg

SEQ ID NO: 26337 - DNA, 44 bp, Homo sapiens
  chr1:61519551-61519595
  hyper
cacgaaagtaaggatcggttctgccgcgtcgccccctccttccc

SEQ ID NO: 26338 - DNA, 102 bp, Homo sapiens
  chr1:61549208-61549310
  hyper
ggacgcgcgttcccccgcgccggccgggtggagcctgcgtcctcgccgcgcgccggtggcccgttggctctcccggagtgaaagtttcggggccgagacgag

SEQ ID NO: 26339 - DNA, 248 bp, Homo sapiens
  chr1:62784355-62784603
  hyper
ggctgcatcccagaccgcagcgcctagctcggaaaagctgggcgggggctgcaccacctgagtcgcaaggacagcacggcctccccctcctcaccagtgttctccacccccagaattggggcgcggagagccaatctgggctggaaagggagcggcgcccacctttgggcagcccgagcagccccgctccttttctgtcgcagaccccaggctgggaggcgggggcgccaggtcggcccaagctgccg

SEQ ID NO: 26340 - DNA, 276 bp, Homo sapiens
  chr1:62784870-62785146
  hyper
tccgggtgcactgtccgcgtcccaggcgcgcaccccggggctggcgcaccctggtcgtccgcggcgcgcacaccctccaggcgccctctggccgacggtctcggccctggccccggcgcacccctgcgggcacacccaccgcggcggatgcgggactggccaggcgccgccagccgcggcttcgccccgcgtcgccagctgccaacagcgcccgagtccccgccttcgctaggggagaaaaaaaagactcctgacgcggcgcggactttggtgtgt

SEQ ID NO: 26341 - DNA, 472 bp, Homo sapiens
  chr1:63539509-63539981
  hyper
aaaaacaaagccaagcgaagtgggcctgccagagttaactatgttcacagagtgcaattaagtgtttggaaggttctgtgccgtgtgctctgatttacggccgcgttcctgggacgcccctttagccgggcgaacgtggagggggccaggcccggccgtgcgcaccctgggagcggagccgggccgctggcgctccgggtcttgggcttggcaccgcggcgcaccgggtggcaagcacagcgcttagcggaggccacacctgcacctcatttgcttctgagcagtgccatgacccgcctgctgatggggcgccttccctttcatcctcgggattatgacaagttattaattgccaccattagccgcagcagcctgcccgagatctctgctgctctctggaggtgagaaaccgcgcatctgaatgccgagggaagaggcgctgagcagccagggcaaacggagcaacaatctg

SEQ ID NO: 26342 - DNA, 168 bp, Homo sapiens
  chr1:63784272-63784440
  hyper
agactttgattgttgcgggcgcgggggtgttggggagaaaggaggggaatttttctaatagtcccacccacgttttgctccctcttggacaaagagtaactactcttggtgggggacgcgcccttcactccgcggaacctggtcccaactccccgtattgtaagaaaa

SEQ ID NO: 26343 - DNA, 50 bp, Homo sapiens
  chr1:63784732-63784782
  hyper
cccctcccctggagacgtctcaatttccttcctatcgatccggactccat

SEQ ID NO: 26344 - DNA, 306 bp, Homo sapiens; identical to SEQ ID NO: 56
  chr1:63784987-63785293
  hyper

SEQ ID NO: 26345 - DNA, 149 bp, Homo sapiens; identical to SEQ ID NO: 57
  chr1:63785618-63785767
  hyper

SEQ ID NO: 26346 - DNA, 251 bp, Homo sapiens; identical to SEQ ID NO: 58
  chr1:63786078-63786329
  hyper

SEQ ID NO: 26347 - DNA, 593 bp, Homo sapiens
  chr1:63786656-63787249
  hyper
gcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactgacttgccttgcactccgcgtgcattggccacacatcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcc

SEQ ID NO: 26348 - DNA, 328 bp, Homo sapiens
  chr1:63787282-63787610
  hyper
cgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggt

SEQ ID NO: 26349 - DNA, 634 bp, Homo sapiens
  chr1:63788133-63788767
  hyper
caacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtc

SEQ ID NO: 26350 - DNA, 578 bp, Homo sapiens
  chr1:63788919-63789497
  hyper
cggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttc

SEQ ID NO: 26351 - DNA, 64 bp, Homo sapiens
  chr1:63789728-63789792
  hyper
ggctcacagctcggcccgggcctgcagctgcagctcaatagcctgggcgccgccgcggccgctg

SEQ ID NO: 26352 - DNA, 64 bp, Homo sapiens
  chr1:63789849-63789913
  hyper
cgcggccgtcgttcagcatcgagaacatcataggtgggggccccgcggctcctgggggctcggc

SEQ ID NO: 26353 - DNA, 26 bp, Homo sapiens
  chr1:63790252-63790278
  hyper
ggtcccggtcccgctgcccaatcctg

SEQ ID NO: 26354 - DNA, 100 bp, Homo sapiens
  chr1:63792549-63792649
  hyper
acttataaaattactcgctcatatttccgcgcatagcagcaataccggccgagcctgcgccagcagcgtgacactcagccacaagccaccgccggagact

SEQ ID NO: 26355 - DNA, 109 bp, Homo sapiens
  chr1:63792797-63792906
  hyper
cggacccagaccctcaagctgccagcggttgtttaaagtcctggcagatgtcaggaagatgggcccggccgtcgcaccctcaaaagctctttttcgtttaagcttttta

SEQ ID NO: 26356 - DNA, 156 bp, Homo sapiens
  chr1:63793435-63793591
  hyper
ggggcgacgagcagacggaaaacttcgcggtttgtctggaatggtccagccccagccccggacgcctctccttccctcccaggctctgagcctcctgacatccttgcttattctcaggccccggaagcctaggtcgaatctcgagaagctgatttc

SEQ ID NO: 26357 - DNA, 586 bp, Homo sapiens
  chr1:63795348-63795934
  hyper
aaagacagacacagacgcgccgggccggtggaactcagctccgggaaggctgtggacctggaccctggggctccccgctgcctgggcgcctctagcccggcgatgagtggttctgcggggaccgacggccccatttccttcttgcctcgtgatgtgggagggaagaaagaaggcggcaactgcaggcccgaagctcccctcgcccagcggcccaaccacagtgctgtcgtgtcggggatcggtccccaagggagcccccaaccccctgcccacgccgagatcacccccgtgccaacctcgagggctcggcctgcgggactccagctgcccctgcctggagggagggaagggagaagagaatacgaattaattacgaaggaaacccaggtgtgaaaggcacccgccgcggagctgggcgtgcagcggggcgcgcggtgggacctctgctcccgtccccgtcccgcggctactcagttgcccgctcatgggaggctcgcgacggaaaataaatcccctcagagtgaacctgggaggccgagaggacccagcctgggatctctgggggaaataggggcaagtttaccac

SEQ ID NO: 26358 - DNA, 565 bp, Homo sapiens
  chr1:63795935-63796500
  hyper
gtttaattaagccacagccctagcacgaggaccccggcgacccatccgggctgggggatggactggagtgccccccaccccaggccgcgaaccggcagcgagaagcacactctccgccatccccggccccgccgcttccgcctctgcggactccgcgtttgccatgctccttcccggggtccagggaccggagctgcggtgcacgtcttattgaaggggagagctttggttcttttcctccctgcatccctcccactttcctctcaacagatagtaagcaagactcaattttctccaaaaaagcccgttacccctttctgcaaggggcgcatgcctaggttcacagggagctctcttgtcagccccagaacaaccctaaactccaaatgttctgtttgctctcgaggtacccctgggatgcagcgtctcctccgcgaagccttcctgagcctccctgcccagaccagttgctccttcttgaagctcaccgtgccaattaatgagccattgtcattagtgttgccctctgagttcctggtgagttcctgaccgtctagcattgctg

SEQ ID NO: 26359 - DNA, 30 bp, Homo sapiens
  chr1:64240116-64240146
  hyper
gcccgccgctcctggcgctgctggccgcgc

SEQ ID NO: 26360 - DNA, 26 bp, Homo sapiens
  chr1:64240532-64240558
  hyper
cgcgccccagccggtgttcaggcaag

SEQ ID NO: 26361 - DNA, 30 bp, Homo sapiens
  chr1:65468348-65468378
  hyper
caccatccgaaagtgcgagcctggccggcg

SEQ ID NO: 26362 - DNA, 41 bp, Homo sapiens
  chr1:65468581-65468622
  hyper
gctccttccaggtcccggcggggaagcgatgctttcttggc

SEQ ID NO: 26363 - DNA, 275 bp, Homo sapiens; identical to SEQ ID NO: 5540
  chr1:65731231-65731506
  hyper

SEQ ID NO: 26364 - DNA, 14 bp, Homo sapiens
  chr1:65731781-65731795
  hyper
ggagctaagttctt

SEQ ID NO: 26365 - DNA, 64 bp, Homo sapiens
  chr1:65990955-65991019
  hyper
tgggggtgggagggacgggggaaccccagtgcctatctcaagcctgcggtcaccgacgcgggtc

SEQ ID NO: 26366 - DNA, 442 bp, Homo sapiens
  chr1:65991119-65991561
  hyper
cgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaact

SEQ ID NO: 26367 - DNA, 52 bp, Homo sapiens
  chr1:65991605-65991657
  hyper
cgggccgcttagggactgggagtccggggcagcttagcgggaccaccagagg

SEQ ID NO: 26368 - DNA, 386 bp, Homo sapiens
  chr1:66258265-66258651
  hyper
aaactcccctggtaccgtgcccgcggaatattgcaggaggtctgtgaggtaggtgggggaaaaaataacctgggagggcaatcagggagaggccagacgactggggacggcgtgctttgcaccctagaattgacaggtggtggcctcagcagttacaacctactacacagcatctcgtccgtgcgatacggtcacattgttattccccgcacccggctgaggagcgcagcgcggcagaccaagtggcaccggcgagctgtctctcttccggggggcgggggtggacagtagggagagggggtttaaagggccagaggacgagagaagagctgaggggcgcgtcgccagcgcctgtgtctccctggcgcgggttccccaggctagcc

SEQ ID NO: 26369 - DNA, 89 bp, Homo sapiens
  chr1:66258671-66258760
  hyper
cgcccccggcccgcgcgccccttcccggggctcctggcctcgcctcagcggctgcaggctcttcgtcgcgggccgggctgcacgcgagc

SEQ ID NO: 26370 - DNA, 71 bp, Homo sapiens
  chr1:66258761-66258832
  hyper
ccctccgggcagactttcgtcccccacccccgggagcgcggaaggctcactcgcagcgcatggtctacccg

SEQ ID NO: 26371 - DNA, 314 bp, Homo sapiens
  chr1:66259117-66259431
  hyper
cggcccctagcctttcgccctcatcttctctgcttcggcttccgcccttggacctcttgacaagtcactggggaggagaggatggagagaggctaagggagaatggagagaggcagaaggattcagggcttggaagccctggagtaggtgacggatgggcgcgcggtgcccagtgattgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 26372 - DNA, 623 bp, Homo sapiens
  chr1:66998790-66999413
  hyper
agctgcagccccagtcggttgcgagaaaagctccccacctggggaagcgaggccgctcccgtgtgcgctcggcggggaggacgcggtggcggcgggactcgaactcggtcgtcgaagggcgccccgcagggtcccgtctgtagcccggacggcgagcccaggttggagtgggagggagccggcgtgcacagctgtctttggtcgggctcaggcttccgctccctgcctgctcccctttccagcctcccgccccagaaacgatctcgagcgttgccagtttgattccagagccccactcgggtgggttcttttgtttctttgttttaatgacagttcccagcccttcagcatgtcatgcgcaattaattccctggctctcacgaaggcagctggggtgaaatttcttctgcatcatccttttggggatgtttatgatgtgacgtcagtcggattgatttttctctcttgaatgaaggatgggaggggagaaagagagacggagagagagagagacgcacagatgtgcacggaggccacagacactgacatttggaattccttcagggtaaaaggacaccggaatgggagcttagaagtgtgttgctaagatttccggctgcacg

SEQ ID NO: 26373 - DNA, 142 bp, Homo sapiens
  chr1:66999473-66999615
  hyper
ccccctccgcagcgagccacttaggtgctgctttcacgccagagtcccctgttaaggtggcagcccttgataactaatctcgggcacccagccgcttctgtaagcttaaggagacgacgaggaggggcgggggaagtgcgtc

SEQ ID NO: 26374 - DNA, 378 bp, Homo sapiens; identical to SEQ ID NO: 64
  chr1:67217965-67218343
  hyper

SEQ ID NO: 26375 - DNA, 646 bp, Homo sapiens
  chr1:67773134-67773780
  hyper
cacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctcttta

SEQ ID NO: 26376 - DNA, 30 bp, Homo sapiens
  chr1:68696775-68696805
  hyper
cattgaagtttgtgccgggatgtcccaaat

SEQ ID NO: 26377 - DNA, 128 bp, Homo sapiens
  chr1:70032971-70033099
  hyper
cgggggaggaaaccccgaggaggcgctcccggccgcctctttgctgagatagcaggagcagcagcctgaggagccacgagctcagcgtcactgagctagtgcgggtgcaggggcgctcaggcaggcgc

SEQ ID NO: 26378 - DNA, 111 bp, Homo sapiens
  chr1:70033503-70033614
  hyper
agctgcagctggtgtcgtcggaaaagggggtgggaaaaaagagagggggcggggagagcggtgagacacagccaagagccatgagcggcgcctcctcgcctgccaatcctg

SEQ ID NO: 26379 - DNA, 543 bp, Homo sapiens
  chr1:70033948-70034491
  hyper
ctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggc

SEQ ID NO: 26380 - DNA, 82 bp, Homo sapiens
  chr1:70034492-70034574
  hyper
gcgaagatgtggtaggttgcagagcatttggaaatggggtgctaactgggcgggtgcatgggagcaccgagtagcttgagct

SEQ ID NO: 26381 - DNA, 108 bp, Homo sapiens
  chr1:70035100-70035208
  hyper
ttgcgtcctcctctccgagttattaaggatgcaggacgtgtttcggattcgacgtggaaagagggagggaagcacattagcattaaggtaatcatggcaccctggctc

SEQ ID NO: 26382 - DNA, 203 bp, Homo sapiens
  chr1:70035209-70035412
  hyper
tggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccgg

SEQ ID NO: 26383 - DNA, 701 bp, Homo sapiens
  chr1:71513046-71513747
  hyper
gcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggtggcgaggcgcgcggaggtgccgagtcccctttataaggccgagggggcggggcgcccgtgggtgtggacagaaccgaggtgggaggagggtgcaaagcaactgagcgcctctcttggctgttgcctatcctgatcgcctgggttgggaagccccagacggtctcctctgaaacgccctgctcctggccggaccgggagcccactggggtctcctccagttctccgctaaagtgtcggtggacggcaagcagctaat

SEQ ID NO: 26384 - DNA, 76 bp, Homo sapiens; identical to SEQ ID NO: 5555
  chr1:72747951-72748027
  hyper

SEQ ID NO: 26385 - DNA, 67 bp, Homo sapiens
  chr1:72749731-72749798
  hyper
cgccgggctgttttcagccctgccctggcccaaggcagaaggagatactaggcgtggggccacccct

SEQ ID NO: 26386 - DNA, 481 bp, Homo sapiens
  chr1:72750097-72750578
  hyper
aagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctag

SEQ ID NO: 26387 - DNA, 15 bp, Homo sapiens
  chr1:75594000-75594015
  hyper
cgtggccgttttatt

SEQ ID NO: 26388 - DNA, 127 bp, Homo sapiens
  chr1:75595334-75595461
  hyper
cctatccccagaaaccgagaaaaccatctggtttttgcacttagataaagtttaactttcctgccacactggccgagttgggctttcagacatccctggggaagtgggaaaacggggatgtggaagg

SEQ ID NO: 26389 - DNA, 173 bp, Homo sapiens
  chr1:75595818-75595991
  hyper
cgcgccatagcttttagccgggaagctttccaggctgccctgcttaatttcggcgtggttcctaattttctctctcccatcctctctcttagactggaaacgcttcccctatttcttccgtagcggaccgggagagcttactggcgctctgcgaaccggctggaaagaaacac

SEQ ID NO: 26390 - DNA, 249 bp, Homo sapiens
  chr1:75596135-75596384
  hyper
cgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgc

SEQ ID NO: 26391 - DNA, 172 bp, Homo sapiens
  chr1:75596687-75596859
  hyper
ccactgtacccttggcgctggagccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccc

SEQ ID NO: 26392 - DNA, 444 bp, Homo sapiens
  chr1:75596929-75597373
  hyper
cgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccctctctccagcccggacctccaatcaa

SEQ ID NO: 26393 - DNA, 794 bp, Homo sapiens
  chr1:75597923-75598717
  hyper
cccagaccgacaggacgatcagccctgggattcatagcaaacacattcccctcttcttgcacactcgacccccagccaaaggcttataccgcccaggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttccccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgcgcgataaattctcctcgatagtagccagacagtaccccagattcactttaaaccctaacacacacacacacacacacacacacacacactgtaattaaatatccaaaccggacctttatgtttaattccactttcaacgaaatcctgctctatacacgacctgatggcgccaatgttctgcacgactctgactttccattcggaagagcggtctccacaacgatgctatttcatggaaaatgcattatgtgaatttctccaccacccccaataccgatttctgcatttgatgaaaaacacaagtctttctggttcccacgcacaagttagctt

SEQ ID NO: 26394 - DNA, 285 bp, Homo sapiens
  chr1:75599387-75599672
  hyper
cctccgccgcttccccgccccgcagtcagaacttgaggcagaagacaaggctgctcgggcttacattttgtctaggagatgaaagagcaatactcattagcaacatacttttgtctttcttgtagccttgatttcaaatctagtcgcaaatcataagcttttgtgttgctcagatgttccttctttatcttaatgagaaaacttttcggaaagggagcgcgaactgctagataagtcagctcccaggctgccaggagcggtggcattcctcggctacaccggaca

SEQ ID NO: 26395 - DNA, 482 bp, Homo sapiens; identical to SEQ ID NO: 5564
  chr1:75600203-75600685
  hyper

SEQ ID NO: 26396 - DNA, 433 bp, Homo sapiens; identical to SEQ ID NO: 5565
  chr1:75600686-75601119
  hyper

SEQ ID NO: 26397 - DNA, 89 bp, Homo sapiens; identical to SEQ ID NO: 5566
  chr1:75601187-75601276
  hyper

SEQ ID NO: 26398 - DNA, 151 bp, Homo sapiens; identical to SEQ ID NO: 5567
  chr1:75601277-75601428
  hyper

SEQ ID NO: 26399 - DNA, 536 bp, Homo sapiens
  chr1:75601929-75602465
  hyper
ctccgctatgattgacgtctggaaagaaagagctttgtgaggggatgattgttattaacttgttatccccggcgggggggcggggaaccgacgtgcccgggtgagcgccggagacccggagcccggggagcgcgggacgagctaccagcgctcgggtggcggccgccagcggccagcgaaggaggctgcgcgccagcccgcccgcggcgcccgggctcaggcgccgtgacggctgcacgcgctgccccgcactctgagggccttcattagctcgctccccgcgccgaggctggggcgggcagcacgctcggaacttctgatctgtttctccatactttctccccctcctactccgcagtgtcaggggctcatgtcagaggagtgcgggcggactacagccctggcggccgggaggactcgcaaaggcgccggggaagagggactggtgagtgcggaggggctcgcgtgctggcaagactggccgtggggaggcggcgcaggacgaagggccgctgtccccgcgctccttccagggc

SEQ ID NO: 26400 - DNA, 440 bp, Homo sapiens
  chr1:75602719-75603159
  hyper
tgggtaggtgggatgcgaaggggaggaggggtctagaaccgcctgcgcctcgcggtttcctgcaggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtaggatagggcctcgggtgcgaggcccaaggggagcgggcttagcgtgggagctctgggaaaagagtaatgttcctcccaccaacctttccgttcaagttctgggtgaaggttgtaggcttttgcagaaaatcagcccagtttagggcaactcatgcggtgggataaagtgagaagaaatcccagactcttctatgtcgttgcaaaacagct

SEQ ID NO: 26401 - DNA, 449 bp, Homo sapiens; identical to SEQ ID NO: 5570
  chr1:76080278-76080727
  hyper

SEQ ID NO: 26402 - DNA, 325 bp, Homo sapiens
  chr1:76080728-76081053
  hyper
cgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggagggggga

SEQ ID NO: 26403 - DNA, 59 bp, Homo sapiens
  chr1:76081342-76081401
  hyper
tcctgtcagtgtccccggaggccaggggaggtgcagcggcgccgcggtttcccccaccc

SEQ ID NO: 26404 - DNA, 70 bp, Homo sapiens
  chr1:76081756-76081826
  hyper
ccgcccctctgctctcggccgcgccgctggcccccctcttgcgctgctgtggacgcggtggctgctgcgg

SEQ ID NO: 26405 - DNA, 249 bp, Homo sapiens
  chr1:76082129-76082378
  hyper
cttcctctgggccttcgaagccccctctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 26406 - DNA, 40 bp, Homo sapiens
  chr1:76540210-76540250
  hyper
agcgcactctgcgcacgtcgagccgcgaaaggttcacaga

SEQ ID NO: 26407 - DNA, 76 bp, Homo sapiens; identical to SEQ ID NO: 5574
  chr1:76540498-76540574
  hyper

SEQ ID NO: 26408 - DNA, 13 bp, Homo sapiens
  chr1:76540575-76540588
  hyper
acttggatctgtg

SEQ ID NO: 26409 - DNA, 85 bp, Homo sapiens
  chr1:77333003-77333088
  hyper
gtgggtacactggctcggttaactctctctccccagaaatttcactactgaaaagattattatttgggggcggggaaggggatgt

SEQ ID NO: 26410 - DNA, 129 bp, Homo sapiens
  chr1:77333305-77333434
  hyper
aaaagtggccccggacgcgcgagcctgaggattctgcacaaaagaggtgcccaaaatgaagaccctgatggtgagtcagttgtggcaactccaccgggcaaagagggggatccccgggctcagggtcca

SEQ ID NO: 26411 - DNA, 43 bp, Homo sapiens
  chr1:77333881-77333924
  hyper
acccacccctgtcctcggccccggcgcgctccctccctcagcc

SEQ ID NO: 26412 - DNA, 218 bp, Homo sapiens; identical to SEQ ID NO: 67
  chr1:77334168-77334386
  hyper

SEQ ID NO: 26413 - DNA, 162 bp, Homo sapiens
  chr1:77334408-77334570
  hyper
cggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtg

SEQ ID NO: 26414 - DNA, 103 bp, Homo sapiens
  chr1:77334811-77334914
  hyper
agcgttcctctgacccggaaccggagggtgagcgcagccagcccgcggccactgctcgggatccagcgttcccctctgatctctccagcgcattgctttgggc

SEQ ID NO: 26415 - DNA, 83 bp, Homo sapiens
  chr1:77747299-77747382
  hyper
ttcctgggagttcctcggagacccggaggtaaccgtgtatgtgcgtgcgagtgtgtctgtgtgcgtacaaggtccggagaagc

SEQ ID NO: 26416 - DNA, 785 bp, Homo sapiens
  chr1:77747383-77748168
  hyper
aaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatga

SEQ ID NO: 26417 - DNA, 423 bp, Homo sapiens
  chr1:77748403-77748826
  hyper
aggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggac

SEQ ID NO: 26418 - DNA, 380 bp, Homo sapiens
  chr1:78354582-78354962
  hyper
ccggagggcgccgggcgccatacagctgtggtccgcgctggccccggcccgggcgaaccctgccttggagccgcatcctgcgggctcggcggggtgcctaccaggggctgccccagggtctgaaagtgtcggccggccttgggcttctggttgcaatgtctttgccctgctcccctgcgccttgtcggctgagtttcgggtgcgttccctactgtagggagggagccctctgtgagcggagtgggtgccgatccctcggctgaacccttggggtccttagggaagttcagtgccgtcccccaccacttgccccagccgcggtctccgtctctgccagcagtgccagttaagaaatcctttctgatcggtctctgtggaag

SEQ ID NO: 26419 - DNA, 406 bp, Homo sapiens
  chr1:78511450-78511856
  hyper
cgtattgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggc

SEQ ID NO: 26420 - DNA, 527 bp, Homo sapiens
  chr1:78511857-78512384
  hyper
cgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggaggtaaggcgccaggtgctcaggctctcccgcctctccgccgcgccgcgccgcgccgcgcgtatttctgtgggcccaggagggttgagcggcgtttcccggagcgcgaaatccgatgccgtgttgagtccgccgggggcgtcccgggggaaagtgagtgtgccttccctggaagggaaaatttaacttggcaggaccgcagaaagtcacagtcccccttgctccgagatctggcctttgggaagcgggttgagggaggcaacctttcttccgcttgcaaatgtgtttgctccagatgtcccggattccgccggccgttcaaggcgtgagcaccttcccagactcgagatctggcggggcagattaata

SEQ ID NO: 26421 - DNA, 335 bp, Homo sapiens
  chr1:78957218-78957553
  hyper
ttcctcacccgggcacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctgctcgggaaacgccaatcgaattagctcagagaagagtggccgtggccttgtgtat

SEQ ID NO: 26422 - DNA, 35 bp, Homo sapiens
  chr1:82266147-82266182
  hyper
tcggggcctctggctcggtgcgtggagaaaagaga

SEQ ID NO: 26423 - DNA, 86 bp, Homo sapiens
  chr1:82266769-82266855
  hyper
gctcctcctccccgccgcttgggcgcacagccgcagcagctgctcaaatggagtggaaaacggccattgggcgacaatgagttata

SEQ ID NO: 26424 - DNA, 30 bp, Homo sapiens; identical to SEQ ID NO: 5588
  chr1:82267630-82267660
  hyper

SEQ ID NO: 26425 - DNA, 49 bp, Homo sapiens; identical to SEQ ID NO: 5589
  chr1:82267942-82267991
  hyper

SEQ ID NO: 26426 - DNA, 83 bp, Homo sapiens
  chr1:82268226-82268309
  hyper
ttaggatgaggctcccgtagccatgcattttttaatttcataaaagcttggggtcgcaaggttccgcccgtcctttcactggg

SEQ ID NO: 26427 - DNA, 140 bp, Homo sapiens
  chr1:82268744-82268884
  hyper
ctgcgggagaagttacggagtgtatgctgctggagtggctgtggggcagggagcctcgggagcttggtttgtgggatgggggtgccactggggagtggcgacgagagaaaggcgtgggaggagcgcgagggaaggggaga

SEQ ID NO: 26428 - DNA, 30 bp, Homo sapiens
  chr1:84158496-84158526
  hyper
cactcctgcaaagaacgtctcattggcttc

SEQ ID NO: 26429 - DNA, 33 bp, Homo sapiens
  chr1:84544390-84544423
  hyper
cctgctttcccccctcgccgactctttgggagc

SEQ ID NO: 26430 - DNA, 132 bp, Homo sapiens; identical to SEQ ID NO: 5591
  chr1:85358461-85358593
  hyper

SEQ ID NO: 26431 - DNA, 218 bp, Homo sapiens
  chr1:85358751-85358969
  hyper
cgcatgccctcggggtcgagcgcgacggggcgaccgggcgccgggctccagccgggcgcggagaagcagcggaggacgcggcgggcgggcggagcgcctcctctccagcgacccctgcgacgcgtccagagccaaaggaaagtttggcggtgcgagggagggacctagggacagcggcccctccctgccccgccccgccccgccgggtgcgttcgacg

SEQ ID NO: 26432 - DNA, 122 bp, Homo sapiens
  chr1:85359218-85359340
  hyper
tgtttgaagtggctgcgggaagtgcagcccacacccaccacccccgtgggaggcaggctctactccaagcccgacctaacgctggaaacctcaaccccaaagctacccgagggtgcggacag

SEQ ID NO: 26433 - DNA, 121 bp, Homo sapiens
  chr1:85463327-85463448
  hyper
tgtctgccggagaagcgccttacagagggacccgggcggtgggccctgcggcaaagtggcccacgcaccctccacaccgctcccgggcggccgcacctggcactcccggccctctggggtt

SEQ ID NO: 26434 - DNA, 69 bp, Homo sapiens; identical to SEQ ID NO: 5594
  chr1:85463878-85463947
  hyper

SEQ ID NO: 26435 - DNA, 30 bp, Homo sapiens
  chr1:85527927-85527957
  hyper
gatactgttagggagcggacactgtattgg

SEQ ID NO: 26436 - DNA, 44 bp, Homo sapiens
  chr1:85774021-85774065
  hyper
tccgcgctcaaaggccggctgagaaaacgcgagtgactacccga

SEQ ID NO: 26437 - DNA, 610 bp, Homo sapiens
  chr1:86621335-86621945
  hyper
cccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctc

SEQ ID NO: 26438 - DNA, 26 bp, Homo sapiens
  chr1:86622526-86622552
  hyper
tccttggaaacagcccgcgcccgaac

SEQ ID NO: 26439 - DNA, 64 bp, Homo sapiens
  chr1:87617774-87617838
  hyper
cttgcagagtggccccgccgccgtcctgaactttctcgggaggggaaggcggctgtgtacagaa

SEQ ID NO: 26440 - DNA, 168 bp, Homo sapiens
  chr1:88928334-88928502
  hyper
gctgccctttctctgcgtgtctctgggcgcgtcctgcccgctccccgcgccgcccgcgctcctctcgccgcagctgccgctggggctgccgcgggcgccgctcagccggagcgcgcctccgcccggcccgcccgcgccccgcagcagcgcgctcgctccttaaccact

SEQ ID NO: 26441 - DNA, 700 bp, Homo sapiens
  chr1:91172012-91172712
  hyper
ggccatcccaagtaccgtccttgaaagcgtctggattcccgtcccaggcctatagagcccctgtcctgatgcgcccatgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagtatgtgccagttagaagggttccgccggccacctcgt

SEQ ID NO: 26442 - DNA, 85 bp, Homo sapiens
  chr1:91172959-91173044
  hyper
ttgcttacctccccccgggcgccgccgacccttcctagacgcctccgctgcggccgcctaggcttttacccggaacccgccagcc

SEQ ID NO: 26443 - DNA, 198 bp, Homo sapiens
  chr1:91176399-91176597
  hyper
ggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccgg

SEQ ID NO: 26444 - DNA, 262 bp, Homo sapiens
  chr1:91176691-91176953
  hyper
cggaccctcgctgccccaggaagacccctagaagaaggaggaggggaggacagagggatcaccacaccggtgaagctggggcctctatgcaggtcaggacggcagcaaagttggccgccgacttagccagcacccgcagcctgcaagtacagattttctcccacagcctcctgggttgctttgaaaccatccatttaaaaagaaaggaactcatacatatcaaataatggttcggaagaggccagcacgaaaaatggagctg

SEQ ID NO: 26445 - DNA, 101 bp, Homo sapiens
  chr1:91177391-91177492
  hyper
cagacggaatgtcctcggcaacgccctttgcctcagcacttgaggctgtccatatatagttcactctgcctgtgctgtttccgctccgtgcccttctttct

SEQ ID NO: 26446 - DNA, 417 bp, Homo sapiens; identical to SEQ ID NO: 69
  chr1:91177840-91178257
  hyper

SEQ ID NO: 26447 - DNA, 34 bp, Homo sapiens
  chr1:91178960-91178994
  hyper
ctaggaagaagagagcgggcgtttgctcaaatac

SEQ ID NO: 26448 - DNA, 213 bp, Homo sapiens
  chr1:91180075-91180288
  hyper
tgcctcccttacctgcggttctggtaccaggtcttgacttgggtgtcagtgaggttgagcgctgcagccaggtccatgcgatcctgcacgctcaggtacttctgccgctcaaagctacgctccagttgattgagctggtggtcggaaaaagctgtccttgcttttcgaggcttcttggctctcacagggggactctcacggctactcgtaatc

SEQ ID NO: 26449 - DNA, 1011 bp, Homo sapiens
  chr1:91181807-91182818
  hyper
catcccttttatcaacgaaaagtatttcctgtcggatgccctccgccgcccctcaacccccagtagattaaaattaaataaaacaaaggaaggagctggatggccgtgaaggttgtggggtagaacaataaacagaacttcgaggagtccccacatcgcacgcccaggcctcccttcagctgcagtcttttgaccgtcgcccagtcgcccgagaagctcctggaatcgctccccagcagagatctgctgaaggctgaaggggagattgggaaccaggaggacaagctagacggccgagagcgccgggtggcgggactcaccgtggcatttgatgtcgctctgggaatcctcccgcttgtcgagtttggtcttgctgtcctcctgctcgagctttggcctgaagctctcgtgcactgcgttgctctcctgcttcggggtgtggtggggagaggatacgctggtgctgtagggtgcacatgccgccagaggtttgctgtcgcccaagatgtccttaattaaaaaagaagacgtggaagtcctgggggccgaggcggccgagcccagctgctgggggggcggcggcggcggctgctgtggcggcagcggctgctgctgttggggcaaaggctgcaaactttgcgtcggggccgcggccggcggcggcggctgctggctgtggtggaggtggtgatgatgctgggtcgcgtctgctaccagatgcggctccgggggctccatggtgactgagataggagaagaaggcgccgtccctacggtatcaatctccgaacagggagatggggtggcctgactcctaaaatccgcggtcctggcctcaccgagcgggcggaaatctccattcatcatgcctgggctgcctgaactggcactggacaaaatcgtgtctattccaaaactcgacccgctggccccttccattgtcattgctacatgaggtccacgccactccgccgttcagcagccgccccgaaccagcgaagaaagctatcg

SEQ ID NO: 26450 - DNA, 247 bp, Homo sapiens
  chr1:91183272-91183519
  hyper
ctcccccgcggctcccgaggtggcagccgcgcgccactcggcagccccgtagccgagtttctgaactttcttggaaagttgcggggcagacacggccgcagcggttgcggcaacccgaggaggaggaggaagaggaggacgacgagaaggagcaggcacagaaggaggaagcggcggagacgcgatgccgggcgactccggccgctgccgggcgcgttcgcttgtaatccggctgctggcgggcggc

SEQ ID NO: 26451 - DNA, 91 bp, Homo sapiens
  chr1:91183520-91183611
  hyper
ccgaccccctcccgtgacgtcacggccactaccgccgctccccgcgccgcgccgcgccgggcccgcgcccccgccaccgaggccgcgcgtc

SEQ ID NO: 26452 - DNA, 211 bp, Homo sapiens
  chr1:91183775-91183986
  hyper
cgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggacttacctttaggctccagcgcggcggccctcgcagcct

SEQ ID NO: 26453 - DNA, 139 bp, Homo sapiens; identical to SEQ ID NO: 1759
  chr1:91184274-91184413
  hyper

SEQ ID NO: 26454 - DNA, 139 bp, Homo sapiens
  chr1:91184414-91184553
  hyper
cccctgccgcgccccgcggcagtccgtccacctctgtcccccggcccctttcggcgagcgctcatttggaaaggaaacagtcactgcggatccacttgggacccggagcatgactgtaacgcctcgttggagtgtatca

SEQ ID NO: 26455 - DNA, 129 bp, Homo sapiens
  chr1:91184791-91184920
  hyper
gtctggaatgatgttcgagtggcctttaatgtctccaaaggctgggccgaaatctggagtttagttgcagttctggaggtcactttctgggccacagcttttatctgttgaggacgaagggaggggtgt

SEQ ID NO: 26456 - DNA, 119 bp, Homo sapiens; identical to SEQ ID NO: 1761
  chr1:91185190-91185309
  hyper

SEQ ID NO: 26457 - DNA, 280 bp, Homo sapiens
  chr1:91185347-91185627
  hyper
cgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcgcagcctaaatatcctgcgcctctgtcacagttgaccgctgtggggaggac

SEQ ID NO: 26458 - DNA, 35 bp, Homo sapiens
  chr1:91185961-91185996
  hyper
acagcttgtgttgggcggttcgacagggtcttttt

SEQ ID NO: 26459 - DNA, 1444 bp, Homo sapiens
  chr1:91188983-91190427
  hyper
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctgggcgtcggggacgaggacgcacgccagccaagacgtgcctcccacccagcccacgcgcgcttccccacccccctggccctccaaaatcggtaagagaattaagatttcgaatccctattttgaggagccttccgcatttcctaattgttaaattcctgcttttcaccaaattcccgggggagaaacatttggcaataagaagggactgtgaatttaaatgctaattgagtgggtcctttttccgcagctccacctgcctggcagcctctgttgaaaccaaacacactcggagcgcccagtgcaacattcttggggtgccgagtagaagcgcagtaaagagagaccctagcggactcctgtctggtttgctttttaccgactcttacagaaaaaaagagaatgccattggaagaagctcttttgcgtggtgggcgatgtgtgggtgggggacttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtccctaatggtgcgtaatgtgctcaca

SEQ ID NO: 26460 - DNA, 320 bp, Homo sapiens
  chr1:91190629-91190949
  hyper
cctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccagggtgggcttgtaaaagacgcttccgcagagcaggtcccgtcagggtctttttcctgttcctggtgccagcggtcggcccggg

SEQ ID NO: 26461 - DNA, 17 bp, Homo sapiens
  chr1:91190984-91191001
  hyper
cggagagtgcccctccc

SEQ ID NO: 26462 - DNA, 233 bp, Homo sapiens; identical to SEQ ID NO: 1767
  chr1:91191002-91191235
  hyper

SEQ ID NO: 26463 - DNA, 249 bp, Homo sapiens; identical to SEQ ID NO: 1768
  chr1:91191289-91191538
  hyper

SEQ ID NO: 26464 - DNA, 34 bp, Homo sapiens
  chr1:91191752-91191786
  hyper
tccagcactgggccgcgcgcgtgattgatcggtg

SEQ ID NO: 26465 - DNA, 233 bp, Homo sapiens; identical to SEQ ID NO: 73
  chr1:91192344-91192577
  hyper

SEQ ID NO: 26466 - DNA, 136 bp, Homo sapiens
  chr1:91192681-91192817
  hyper
cgactctgggccaggccccaaggaccgccccggcctctccggctttgcggggagaatctgaggaaccgagtccaagatagccgacctaggctgttttcacccagaccctgcgtccccgacccgctggagtgaatct

SEQ ID NO: 26467 - DNA, 281 bp, Homo sapiens
  chr1:91194539-91194820
  hyper
aaatgcttaaagttgcggatgtaatttcacatgcgtccgggttgatgtgatatgaccgtatcagggaaacaaagctaagtgcagtcaggatctgttagtacagtggcttttgatggaacagctgaggcacacatcgcccgtggcatggactccggggccgaacgctcacgaccaagacttttgcccttttgaaatgaaatagaaataggggagctgcaggaaaaccgaatcgcgcttagggtcaggagcaagacaggagctttcagcgaagatctgaacat

SEQ ID NO: 26468 - DNA, 272 bp, Homo sapiens
  chr1:91195133-91195405
  hyper
gggtccccagccaggcgggggactgcgggccgcccgcgctgcagggccgcgggtcaccgcagggggcgccggggcgctacgggtcctcgggcctggtcttttccggtccctgcccgagcccgcgcctttcccgcctttcgggggagaaacctgcctggacactggaactgggagaaagcagcagcctaattgctcttccgatcgtcgcttgggaaaggggggcttcacatttagaaacttctcgcacctttctctctcggtctctgcctttt

SEQ ID NO: 26469 - DNA, 316 bp, Homo sapiens; identical to SEQ ID NO: 5622
  chr1:91195879-91196195
  hyper

SEQ ID NO: 26470 - DNA, 292 bp, Homo sapiens
  chr1:91196225-91196517
  hyper
cgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaaagctggcagatgcagcaaaactaatatgtgtaaatgctttaaagcaataatctgcttacagcgacacttccccgaacggcggcaggactga

SEQ ID NO: 26471 - DNA, 1121 bp, Homo sapiens
  chr1:91316241-91317362
  hyper
ctaagaaccgccgtgcgatggccggctttgggcaccgggggtgggggctacgctacgcgtgaagggcctcagtcctcgggctttagttcaggaagaaaatgaaagctggaggtctcgtgggcgggactggaggcggccagataggcaagaacccgcaacaggagtagggacattttttcttcaaattccaatcccatccagcgatagacaggcgcgtgggtctccctcctccacgaccaccacacaatggcacacacttttgctggaaactgaaatcgaagtctctgaggcaggctggggcccaggccggcagcggggaggggcagggtccagccacctcggcgtggccttggcgagcgctccggggtcagaggccgtcgttctcgccgcgctccacagcgcgtcacccgctgccctagcgacccccgggcgaccccggcatcgcctggctgcgccgtcccggcgggccggccctctccacgccctctcctggggtttgcggtgggcacagctccctccagactgggtctctccactagcctcctccccaactgcaacgtgggaaccagagctatccgagtcacgagccccaagtgcacacaaagcccccaacggggccacggcgcctccacgcctcgctacctccagctccaggagcgcagaacgcagcgccctgggtcaccgcgtctgccctgcggagcagccccactgaggggaagcctcgggcaggaggtgagaccccgcgcacgcaagcacccccgccccaagcagggccctctgcccgagggagactctcacctcaaataaacgggcgctgccgcctccagggggaggacagcgggcggagaatactcacgctgggcccagccgcgcggggacttcgctgggaaccacgcgcgggctcccgccggggagcggagccccagcctgcagtcctgcgcccgccccagcaccgcctcctcggaagggaggcctctaccgtccggcggcggacctgcagccgccgcgggagacgctgccccgccccccggccccgcccttcggcccatccccgccccgctggcctccttttcccctgccccctccctccgctcctcaacgcccgccgggtgcaatctgct

SEQ ID NO: 26472 - DNA, 281 bp, Homo sapiens
  chr1:91870046-91870327
  hyper
agccgactttaggggcgggccggacgcccagccggtcccacctcgcggggagctgggcccgccctgcgcccgagcgcgccgcaggcctcaccgctttctgactggaaatgcggctgaggcgctggcgcgggccggcggcctggagacgcctggtgaccaacaactcgccgcgcccgtccgctgcctgcccggcagacggctctagagatcgaccgctgcccggacggctcggctgggtccccacttccccgcgggcgtcgggcccccgtccccaccttccc

SEQ ID NO: 26473 - DNA, 128 bp, Homo sapiens
  chr1:92495704-92495832
  hyper
ggtctactgctactgcgggctctgcgcctccatccacctgctcaaacttttgtggagcctcggcaaggggccggcgcagaccttccggcggcccgcccgggagcaccctcccgcgtgcctgagcgacc

SEQ ID NO: 26474 - DNA, 932 bp, Homo sapiens
  chr1:92948324-92949256
  hyper
ccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacg

SEQ ID NO: 26475 - DNA, 394 bp, Homo sapiens
  chr1:92949786-92950180
  hyper
gaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagc

SEQ ID NO: 26476 - DNA, 1908 bp, Homo sapiens
  chr1:92950636-92952544
  hyper
ttgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatcaccggcccgcggtgccgccggcctggagcccggcgagtggccacggcgtccgcagagcgaaacctgccccgcaggccccgaaatagcttgttgtggaaacacttggggataaatacgcccaacgaggctgaaaataccttgacacccaatccgagaggtttgctcatttcccttcggatttaggtaatggttaaatttggaagaggtgggcgagcgccgagcccccggcggagagggccctggcggcgcgtcccgcgggcgcccggcgggaccggtgggcgcaccctccctgcgcggagctcgccggctctcgaccgggtccgctcagccttcgactaatttccggtggtcggagctgcaaaattaaaggccgcgcgggggcagcgccggcggctgcta

SEQ ID NO: 26477 - DNA, 88 bp, Homo sapiens
  chr1:95392536-95392624
  hyper
gccgcgggggatgctcgaactccctcctctgggaggcgcaggagacggccgcggggcgcgggcggtgcctgggcgactgggtccaact

SEQ ID NO: 26478 - DNA, 39 bp, Homo sapiens
  chr1:95393028-95393067
  hyper
ggcccgccgctgacccgccgcctccgtctgcctcctccc

SEQ ID NO: 26479 - DNA, 30 bp, Homo sapiens
  chr1:95428544-95428574
  hyper
ttcagttcctgttatcgtgctttgaggtgc

SEQ ID NO: 26480 - DNA, 299 bp, Homo sapiens
  chr1:98510732-98511031
  hyper
tctctcttgctcccacgccttcgcagctgacctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttcc

SEQ ID NO: 26481 - DNA, 30 bp, Homo sapiens
  chr1:98511032-98511062
  hyper
cggggacccagcccccgggcccccgccccc

SEQ ID NO: 26482 - DNA, 547 bp, Homo sapiens
  chr1:98511321-98511868
  hyper
gtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatcc

SEQ ID NO: 26483 - DNA, 315 bp, Homo sapiens
  chr1:98513940-98514255
  hyper
gcttcagcacctggacgaatggacagctcaacccgggccgactgccggcagcactcgcagcagaactgacgctctgagctctaaccaaagctctctcgtgcttgagcggggcagcctgacttacgagaacaccatttcctacgagaccactgccgctgggtgcatattcaattcaagcctccttaagctgtcggatttcccccacccatccaccctcccccccttctccaccctccacacaaaaacaaaaaagggaaaaagcccaataccatcagggcgtttgttgatcaacttacacttcgcttttgaatattt

SEQ ID NO: 26484 - DNA, 19 bp, Homo sapiens
  chr1:98515068-98515087
  hyper
cttgggaagggacctcggc

SEQ ID NO: 26485 - DNA, 103 bp, Homo sapiens; identical to SEQ ID NO: 5637
  chr1:98515088-98515191
  hyper

SEQ ID NO: 26486 - DNA, 297 bp, Homo sapiens
  chr1:98519221-98519518
  hyper
tctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccaga

SEQ ID NO: 26487 - DNA, 179 bp, Homo sapiens
  chr1:98519817-98519996
  hyper
gaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaac

SEQ ID NO: 26488 - DNA, 133 bp, Homo sapiens
  chr1:99469564-99469697
  hyper
cccctctctcctcgccggcccgcccgccgctgctcttcttccaggcacaatcgaagaggaggcagtgagcgagtcaaggccacagagtggatggaatcaaggttcacccccaaagctcacctcctttgcaacc

SEQ ID NO: 26489 - DNA, 215 bp, Homo sapiens
  chr1:99469759-99469974
  hyper
cgctgaagccaccgcggggtgtgggggggtgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcga

SEQ ID NO: 26490 - DNA, 315 bp, Homo sapiens
  chr1:99470215-99470530
  hyper
cagcaggggcatgcacgcctcccgggccgggccgagccgagccgagcgggcggtcgacgcggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccggg

SEQ ID NO: 26491 - DNA, 36 bp, Homo sapiens; identical to SEQ ID NO: 5642
  chr1:99470582-99470618
  hyper

SEQ ID NO: 26492 - DNA, 166 bp, Homo sapiens; identical to SEQ ID NO: 5643
  chr1:99470619-99470785
  hyper

SEQ ID NO: 26493 - DNA, 361 bp, Homo sapiens; identical to SEQ ID NO: 1776
  chr1:101004456-101004817
  hyper

SEQ ID NO: 26494 - DNA, 92 bp, Homo sapiens
  chr1:101004842-101004934
  hyper
cgctgggggcagctaccgcctgctacggggtgggctgctgggcctcggactcacggtgtccctcctctcccactgcctcgtggccctgaacc

SEQ ID NO: 26495 - DNA, 850 bp, Homo sapiens
  chr1:101004935-101005785
  hyper
ctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccg

SEQ ID NO: 26496 - DNA, 78 bp, Homo sapiens; identical to SEQ ID NO: 5646
  chr1:101702524-101702602
  hyper

SEQ ID NO: 26497 - DNA, 193 bp, Homo sapiens
  chr1:101702603-101702796
  hyper
agccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgca

SEQ ID NO: 26498 - DNA, 30 bp, Homo sapiens; identical to SEQ ID NO: 5648
  chr1:101703188-101703218
  hyper

SEQ ID NO: 26499 - DNA, 76 bp, Homo sapiens
  chr1:101703566-101703642
  hyper
gggcgcggggggaggcggggagaataagaagaagaaagaaaaggcagtcgcttcacggaggcgctaagctttcctg

SEQ ID NO: 26500 - DNA, 394 bp, Homo sapiens
  chr1:101775094-101775488
  hyper
gacttcaaaaggctgcggtatcaaagtggcagttaaagagaaggcaacgctcagagttgcaggtggagcagcggcggctgcatcagcgtctcaaattgcgaaaacattttgggctgaagtatttctttgtagcatttcgtggagcccctttcctttgatatacactagccttccgacttccctttgttcttttttcacacgtcaggttttatcgctgacaagctccaacgcgtcaaaggcgttagatctgagggctgcagcagccttcgcggttccgcattgagctccttcctgcagccctctgcggaggtcacggccacgtgtgggcagggaaggccccctacccacttcctcattcggacccgtcacctttagccggcgaccaccttttgat

SEQ ID NO: 26501 - DNA, 88 bp, Homo sapiens
  chr1:103572677-103572765
  hyper
gagggagggagaaggcggaggggaggagtgaagtcgctctccctccgtgggtactgacagggttgcagacttccgagcaggtctggcc

SEQ ID NO: 26502 - DNA, 145 bp, Homo sapiens
  chr1:103573555-103573700
  hyper
aagtggggggaggggcgcagaagcagtaggaccgacggcaatctcccacctccccaaatccattttttcttacctcctctgacctctctagcttggaagaggaaggtcaatgcgagggttgttacggtgaaatcccagagccacc

SEQ ID NO: 26503 - DNA, 467 bp, Homo sapiens
  chr1:103573701-103574168
  hyper
tttcgttttccacctagaggaccacggctccatctccgagccccgcactcacaactgtgaactcaacccacgaaattgcgactgcagaccaacttcgtcctttccaaggtatcgccagggatgtttgctacacagccattggggagggagagggggaaaaagtcaaagggctttttcttctaaatttgatggtttgcgttcttcgtgtctctagccctttcctctccctctgagttggccccaccggccgggaccctccggccgcgaccctctgatccttcctctgccgggccctgccttcagaatgaaggcagatgaggggcttccaccaacaagctgagagtactgtgtgcccctaaaggcttcatgccgtcagtgggctggacgagtggctccgggcagccccctcctccgcccactcccctccctgctcccagctccccctcccagggcgaaactgacaagca

SEQ ID NO: 26504 - DNA, 1154 bp, Homo sapiens
  chr1:107682621-107683775
  hyper
gaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgaggtagtataaggtttgctatccttccacttgctggcagttgcagaagaagatctgctttttaagtgaaacgtacatgccacccctccgagggctgcggcttccccgggcttgcttctttgccgctcctctttccggctctcgcgctcactctttaattggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggc

SEQ ID NO: 26505 - DNA, 719 bp, Homo sapiens
  chr1:107683776-107684495
  hyper
gggagtggcgggccggcgctgggttctcggtcctcggggtcctctcccgccggcggccgggcgcgatcggaatccccgggctgcggcggtggcggcggctcgggtcctcacgcccacccctcccgctccgcccgctcccgcctggggaggaggctccgcgggagctgccgccctccgcccgtacgccgcccgcgggctccgctgctgcggccgccgcccgaggcggaccaggctggctgcgcagggccgccgccccgcgccgtcggctcggctcccgcccggcgcaagggcaaacgagccacacggtaagtgcctgcggctcgcctctcctactgcgacccgagcctctcgcccgtgcccctctcccccgggtttccccaccccccgccgccccccgccccacccgctgcgatgcacaggcgggagggaaggctccgggtgggcgaggaactttgtaaagcgccccgaggaggcagcgcgcggagccctacgcgcacacacagcggcacacgctcacacccacacacaagtcttcccgggggtgcgccccgggccggtgatgcgtcctcttgttgtgtccggagcccaggcgtggggtctgagcctccatccgccgactgacaggggccccgcgctctccctctctcacgcacacctggccacacacatcgctcaggcggcttgtcgttattttttctttctttcgccaattatatttg

SEQ ID NO: 26506 - DNA, 450 bp, Homo sapiens; identical to SEQ ID NO: 76
  chr1:108506627-108507077
  hyper

SEQ ID NO: 26507 - DNA, 228 bp, Homo sapiens; identical to SEQ ID NO: 77
  chr1:108507148-108507376
  hyper

SEQ ID NO: 26508 - DNA, 113 bp, Homo sapiens; identical to SEQ ID NO: 78
  chr1:108507494-108507607
  hyper

SEQ ID NO: 26509 - DNA, 550 bp, Homo sapiens; identical to SEQ ID NO: 79
  chr1:108507657-108508207
  hyper

SEQ ID NO: 26510 - DNA, 340 bp, Homo sapiens; identical to SEQ ID NO: 80
  chr1:108508208-108508548
  hyper

SEQ ID NO: 26511 - DNA, 38 bp, Homo sapiens; identical to SEQ ID NO: 81
  chr1:108508549-108508587
  hyper

SEQ ID NO: 26512 - DNA, 615 bp, Homo sapiens
  chr1:109203594-109204209
  hyper
gcttctgtctttgtacgggccgtcgcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcgg

SEQ ID NO: 26513 - DNA, 71 bp, Homo sapiens
  chr1:109656220-109656291
  hyper
tccaggagtggccttcgtaggagggaacacgtactggggcctcttccaggcgacgacgtctggagggtgat

SEQ ID NO: 26514 - DNA, 179 bp, Homo sapiens
  chr1:109656891-109657070
  hyper
gctctgggctgggaccgccttccaggtgacccagggaacgggaccggagcttcatgcctgcaaagaggtactgccgcccccctacccgatcccgctttggtcacaaaagtcttggatccaggcggagaccttggggacccaggcgcagagagtttcagacgccacggagtttagatttc

SEQ ID NO: 26515 - DNA, 235 bp, Homo sapiens
  chr1:110009583-110009818
  hyper
atcccacccctggaccgcgtgtgagtggggcaaggggaccagcgccttcccagggttccccaccgccctgaccccccggccggctgtgtctccgcaggtggaccgcctactcgtggggctgcgctggcggcggctggaggagccgctgggcttcatcaaagttctccagtgggtgagtcgctgccccggccccgggctatttcgggagcctgggctgtgacgctgacctgaagca

SEQ ID NO: 26516 - DNA, 137 bp, Homo sapiens
  chr1:110282667-110282804
  hyper
cggcgtggtctcctccgcccctccccacagggcccgcgatcccagaggctgggcaggggtcgacatccgtggctcggcagctcgaaaaggctcccgcgtagagctgctcctgctggagatcgcggacccagagaccc

SEQ ID NO: 26517 - DNA, 174 bp, Homo sapiens
  chr1:110283065-110283239
  hyper
aggcgcgactaatgccggcgttggggttcagggcctggcgaccccgaggcgggacccgggcaggagtgctgcaggagagcaaaggacccgaggttgaggctcctcccttccccgcgggtgggagccagacttcattcattaatggtgccagtgaagacgcgaaaagcaccacta

SEQ ID NO: 26518 - DNA, 363 bp, Homo sapiens
  chr1:110610535-110610898
  hyper
atcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaac

SEQ ID NO: 26519 - DNA, 232 bp, Homo sapiens; identical to SEQ ID NO: 83
  chr1:110611045-110611277
  hyper

SEQ ID NO: 26520 - DNA, 80 bp, Homo sapiens; identical to SEQ ID NO: 84
  chr1:110611434-110611514
  hyper

SEQ ID NO: 26521 - DNA, 141 bp, Homo sapiens; identical to SEQ ID NO: 85
  chr1:110611653-110611794
  hyper

SEQ ID NO: 26522 - DNA, 97 bp, Homo sapiens
  chr1:110612445-110612542
  hyper
gggccaagaccaggccgcagtccccagccgaccccgatttgaccactctaggttgaggcccagcctcagggccctcaaagggcgccagacacaaaag

SEQ ID NO: 26523 - DNA, 21 bp, Homo sapiens
  chr1:110613458-110613479
  hyper
ggagcccgggaaccccctccc

SEQ ID NO: 26524 - DNA, 840 bp, Homo sapiens
  chr1:110626790-110627630
  hyper
ccctcgcgtggccgggcgcagatccccgtgcacgggtcctccgcacacccttgccagcccgcagggattgttcgccgcgttggtgactccttcccaaaatgggaataaaagatcgaaatagctagtaagcatgcaaagtttattgtcaacctcaagtctctataaaaccagatcaaagggaacaggcgtttggtttcttcccagatcgctggggggcctcggggctcaggaagccccaggagtccagcccgctgccgctcactgcgctcttctctccagccgggtccaagggctcgagcatcgcaacctgcggcctgagttggccccgggcgcacgcgagggaaatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcaggacgggatgaaactcct

SEQ ID NO: 26525 - DNA, 249 bp, Homo sapiens
  chr1:110672833-110673082
  hyper
ctgtattttcagcctcggtttgacgtcaggctctcacggtcccaaaggatgggctttgtacatttccaggccgcagaccggagcctcccatccctttgggcctcttgggcggtccctacggccacctcccgcagctccctgggggcgggggaccgctggatgagggaggaggggaggtactggggggaaagggcggttggcgggaaggaagtccaggtgagacaggcccgcgttgggactatcgtgcgc

SEQ ID NO: 26526 - DNA, 269 bp, Homo sapiens
  chr1:110673083-110673352
  hyper
gtatgtcggccggcaggtggggctggtccgggcgcaggaggcggtagagcaggagcagcagggggagccaggctggccgagctggggggtgagcacgtttgtctcaggcagctcatcgcctgacacccccgggaacgggctctgccccaaggcctaaaatgagggaagatgaggaaatgggggtggggacgatggagaggatggaaggggcggcgggggggtgcggtggtctgcgcggtacagcagcgtccctgcgggttcccctcatt

SEQ ID NO: 26527 - DNA, 613 bp, Homo sapiens
  chr1:110692884-110693497
  hyper
ggccccattcctctccgagggcagaagccctggcgagggctccagggtctgcatcccctgaccaggggcctcaagaagctaagcccccttgcaactccctctcccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacg

SEQ ID NO: 26528 - DNA, 526 bp, Homo sapiens
  chr1:110693736-110694262
  hyper
cgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcg

SEQ ID NO: 26529 - DNA, 208 bp, Homo sapiens
  chr1:110754149-110754357
  hyper
accgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcgg

SEQ ID NO: 26530 - DNA, 622 bp, Homo sapiens
  chr1:111097796-111098418
  hyper
aggaatcagcattcccgttgtagagatcggtggaccgatgctctcagaggcttccacaagcgtttgtattgtttggggcggtcggaactcagcgctgcggaagccggtgtatctgagtctctccacgtggctctacttttctgcagccctgtagaaataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgcaaccaaagggaggcccgggtgccagtgggcggccgccgcggtgtggagggcgccagggcggtacggcgcagcgggccgcactcttgggacgccccgcctgctctgcggagcctgcctgggatgccctttcctggtcacggactccgccggcagccggggcgggacggaccagaggctaccaactgggggcttctgctgcctgggacacggggatccacattg

SEQ ID NO: 26531 - DNA, 290 bp, Homo sapiens
  chr1:111149588-111149878
  hyper
ccaccagctcctctccgtgccctccgccccgcgccacgcaaaccccagagggtcccgagcccattctgtgcactcttcttgagcagggtgcaagttccccttgatctccccggtctgggacctgccgagcagacggcagtggtcggcaagggcttgccgccgcggactcagcccaagcctgctgcgctgcaggctgcgccgccgggtgccccgcagcccctctgggcgccgcagccgggcagggaaggcagcacgcgccgcgcaacgccccgacacggatttacccttcc

SEQ ID NO: 26532 - DNA, 123 bp, Homo sapiens
  chr1:111150355-111150478
  hyper
accccaggcccacagcgggatccagccccgggagagacgtgttgctattattgtggtgcctccagacaggatctgcagacccctttcttgccctttctcccgccagcgcgaccccttctccag

SEQ ID NO: 26533 - DNA, 266 bp, Homo sapiens
  chr1:111216707-111216973
  hyper
gcacggacacgatggcgatgccccgggccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggc

SEQ ID NO: 26534 - DNA, 381 bp, Homo sapiens; identical to SEQ ID NO: 89
  chr1:111217194-111217575
  hyper

SEQ ID NO: 26535 - DNA, 136 bp, Homo sapiens; identical to SEQ ID NO: 90
  chr1:111217576-111217712
  hyper

SEQ ID NO: 26536 - DNA, 179 bp, Homo sapiens; identical to SEQ ID NO: 91
  chr1:111217713-111217892
  hyper

SEQ ID NO: 26537 - DNA, 145 bp, Homo sapiens
  chr1:111217923-111218068
  hyper
cggcccgtgggccgggagagctcccgccgcggccccgcgggcgccggccccctggcctccacacccctaggtacagcccggggagggcaggcgggcccagtgtccagggagggagtgcaggccaggcgggcgccctgggccagag

SEQ ID NO: 26538 - DNA, 521 bp, Homo sapiens
  chr1:111505931-111506452
  hyper
tgagtcacataagagcgtcggccatcttggttttcatctcccgtggagatctactcggtccgcctattaaacttgagacgctggggtcccgcggagccgctgtgtcaggctctaaagaggttttacatttcccagaggaaagcgctctatgggctttaagcgccgcggagacaagcgcttcccgcctgggtggcgcactctgcgggctccaactcctctcaactacacagcgtccggaaacgacggccgactccacatccctaagacggacagaggggcagccgtggggaggattcgaaaccggtacttaccaacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagg

SEQ ID NO: 26539 - DNA, 41 bp, Homo sapiens
  chr1:111813546-111813587
  hyper
cacccacacagcctgcgggaaggatccgacaaggtgagggt

SEQ ID NO: 26540 - DNA, 264 bp, Homo sapiens
  chr1:112283059-112283323
  hyper
gctgctccctcccagcgcggagacgccgcgcccggccgggacagccggggacggtggcggagagcacggagagtaattaagcaattagcgacgtgttgttaaaaggtaattaacggggaaaagtttgccccaggcaggattagaggtctctgagtgggacaactgtaagaacaccagagaaggcacgaacggtgccggcgccgccatcggtccgtccgtggcagccaaaagtgccagatatgctaactattgaaagatgcgcgg

SEQ ID NO: 26541 - DNA, 256 bp, Homo sapiens
  chr1:112531573-112531829
  hyper
ttcgatccctctccccggggccgcgacggcccttggcgtcacgtagagacctttcccagagctcgcggggtggaagtggcgtcgggcaggaccagatggactggcccccagcctctggtagacacaccgccggctcgccgagctggagaactttgcgaagcgccccaaaccgctccgggtttccactttcagccatttctctccttgtcccctcaccaagagcggggacggagcaagccttcgccacctgtctctg

SEQ ID NO: 26542 - DNA, 43 bp, Homo sapiens
  chr1:112533373-112533416
  hyper
cagaaggtcgagattcgccctcctctcccgccacgtctaccca

SEQ ID NO: 26543 - DNA, 67 bp, Homo sapiens
  chr1:113051618-113051685
  hyper
cagaccccctgacaccgcacccggtcctcaggcagcgcgccccagaccccgggttcggcacgccgtc

SEQ ID NO: 26544 - DNA, 32 bp, Homo sapiens
  chr1:113392524-113392556
  hyper
ggggcttctcacagccgcgcgcacagactggt

SEQ ID NO: 26545 - DNA, 135 bp, Homo sapiens
  chr1:113497971-113498106
  hyper
ccatgagtagaagggcgctgcggcggacgctggcagccacaggttgaatgacaaagagcccccgtcagcaccactcccaggagtctgcgggctgccccgtcccctccgcaaagtctactcgaaccctgcagtcac

SEQ ID NO: 26546 - DNA, 41 bp, Homo sapiens
  chr1:113498107-113498148
  hyper
ccttggctgtggggaatgcggctctccgcaccactctcgca

SEQ ID NO: 26547 - DNA, 383 bp, Homo sapiens
  chr1:114695312-114695695
  hyper
cctgccgcgactccccggagacgccgcagctgcgcgccagggtccagcccggcggggatcgggctcgggactcacccgctccggcgagctcgactcagctcgggctcccgcctcggctaggcagccgcctggggctgcgtcccgcgcagggtcagcgcggatcgggcaggaggcgccctcttggcaaagtcggctagaggcgccagctcagtcgcgcaccggccccgagtccgagtccgagagggacggagggagcgagttataggggcgagagggggtgggggaaggacgccgcaacaccctcataccctcccccaccccgccccctgtcccccgccccccagcggagacgcggaaaaccactcgcagccggagagacaccc

SEQ ID NO: 26548 - DNA, 41 bp, Homo sapiens; identical to SEQ ID NO: 1801
  chr1:114695696-114695737
  hyper

SEQ ID NO: 26549 - DNA, 310 bp, Homo sapiens; identical to SEQ ID NO: 1802
  chr1:114695799-114696109
  hyper

SEQ ID NO: 26550 - DNA, 44 bp, Homo sapiens; identical to SEQ ID NO: 5691
  chr1:114696420-114696464
  hyper

SEQ ID NO: 26551 - DNA, 239 bp, Homo sapiens
  chr1:114696540-114696779
  hyper
cgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccgcattcactgcctggtgtgaccttgggcgtctctgagcctcaattttcctctccgtaaaggaggtgta

SEQ ID NO: 26552 - DNA, 65 bp, Homo sapiens
  chr1:114697062-114697127
  hyper
cgcatgttgctatggcgacgggaggcagcggccgtctctctccatggcaacgggagggaaaagtt

SEQ ID NO: 26553 - DNA, 30 bp, Homo sapiens
  chr1:114697835-114697865
  hyper
ccctggctctgtccacggtgctgaagaccc

SEQ ID NO: 26554 - DNA, 26 bp, Homo sapiens
  chr1:115632012-115632038
  hyper
aggtacttgatgcaccgcaggccccc

SEQ ID NO: 26555 - DNA, 250 bp, Homo sapiens
  chr1:115632104-115632354
  hyper
ggggagcggcaggctccggcggggagggggcggagcggggaggaccggggcggggcctccggggggcggggcggggcccggcggggaggggcgcgtggaccccaagcggcgtggctggcgacgggtgggggcgccagcgggtggagatcgagcagcccgagggagcacgttcgctcttctcccggacccagggaccaccttccttccctccagtgggcgcaccgccgccggctatcggagcacctgcagg

SEQ ID NO: 26556 - DNA, 83 bp, Homo sapiens
  chr1:115632554-115632637
  hyper
gagtgtccagggctgcggctccgcggcgcggagcaagcacacaagcagcttctaggggaccctccctccggcccctcccccct

SEQ ID NO: 26557 - DNA, 155 bp, Homo sapiens
  chr1:115880052-115880207
  hyper
cgccctaaccttccacgcccgcttctcccacacctggcagcagacagctggagatgaagcgtgtgacccaagtggcagggctgaaccttggcgacctctacctgaggttgtccaacgcggctccgtggagggccccggtacgccggacggacccc

SEQ ID NO: 26558 - DNA, 194 bp, Homo sapiens; identical to SEQ ID NO: 5694
  chr1:115880208-115880402
  hyper

SEQ ID NO: 26559 - DNA, 117 bp, Homo sapiens; identical to SEQ ID NO: 5695
  chr1:115880678-115880795
  hyper

SEQ ID NO: 26560 - DNA, 15 bp, Homo sapiens
  chr1:115880872-115880887
  hyper
cgagctgctctcaca

SEQ ID NO: 26561 - DNA, 151 bp, Homo sapiens
  chr1:116371036-116371187
  hyper
cgcccactggtgtggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacac

SEQ ID NO: 26562 - DNA, 341 bp, Homo sapiens
  chr1:116371188-116371529
  hyper
tcagtcaattcagtggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatccc

SEQ ID NO: 26563 - DNA, 128 bp, Homo sapiens
  chr1:116380300-116380428
  hyper
agaagtggctcatctcgggtgtctccacgaggttctcctggcctggaaaatcccccctgcgagcccccgggctcgccagacaaccccacctgcctgcgtcggaaaccttccctcgtcgccctgctgac

SEQ ID NO: 26564 - DNA, 251 bp, Homo sapiens
  chr1:116380724-116380975
  hyper
acgcggatgcgctcgcgggtggcgtgggccgagcggtacttggccgtggcgcgccggcggcggcgcttctcctcgcggctcagctgctgcgggtgcgggtagagcgcggctcggctgccgcccttgccgtcgccctcggcctcctccaccggctccaggtccgacacgctgccgagcaccttggtgtccgtgccgcccagggactccggatccgagtgcgccgagctgggatggtccgaatctgctgcttg

SEQ ID NO: 26565 - DNA, 410 bp, Homo sapiens
  chr1:116381534-116381944
  hyper
gggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtg

SEQ ID NO: 26566 - DNA, 111 bp, Homo sapiens
  chr1:116382387-116382498
  hyper
aaggggatgggtgatcggttcccagcaccgcacttgcagaggagcgaattgggccaaaacagctttaatttccctgcgaggaaatcaggtcctctacggcaaaataaaaac

SEQ ID NO: 26567 - DNA, 33 bp, Homo sapiens
  chr1:116710587-116710620
  hyper
gggtcagccagggcacgccgctgagatgtcttt

SEQ ID NO: 26568 - DNA, 281 bp, Homo sapiens
  chr1:116711011-116711292
  hyper
agtagaacaaagaggcgggagcaccccgccaggggaccgggaagggtcgaggaaaactgctgccgcgccccactgggttttaacaacgcccgggatgggggaagggctcccacttgcgccccaagcgcatgcggagaaggttcggcagcgcctcctgccggccgcccggagggtccgcggtggcgccagccccgatcgcagccgcgcaggcccgagggcccctacccgcacggtgaattgtcttccacgcactagtattttctcctcgctttcaactgaat

SEQ ID NO: 26569 - DNA, 160 bp, Homo sapiens
  chr1:118727930-118728090
  hyper
ccgtctccacagcaacggagtttcagagcgcgcggcagcttgggggcggggttcccagtcccccggtcaaattttaggacttttcagcaggaaagctgcacaactggaggagggcaggacgaggctggcctcgcaggtcgggctacgttcttctacggtc

SEQ ID NO: 26570 - DNA, 15 bp, Homo sapiens
  chr1:119521978-119521993
  hyper
cgtcacgatcccaca

SEQ ID NO: 26571 - DNA, 138 bp, Homo sapiens
  chr1:119522297-119522435
  hyper
tcaccagggccttcccggttagcccagggtccccacatttctccaggatgtaattagagctaagaacagccgccatccctcagggttccgggtcccgggtttccagggtcccgggtttccaaggccccgcgataaccc

SEQ ID NO: 26572 - DNA, 289 bp, Homo sapiens
  chr1:119522565-119522854
  hyper
cgttccggccccgcggcgcctccaaggccgggccgaggggccgaggggccgagggcgggcagacgcggccacggcctaattctgacttctgaaggtcaccgaaactgcgctgtttttccagagatgggttgaagagaagagatgcaatcccagttccttctgcggcgaaacgggatctgaaattcttggagagggggaagaattggacgttttcatcgtgcgtggaggaaaattgggggaggggaagtgagtggcaagtaagggggttaactgcttcccggaccctatc

SEQ ID NO: 26573 - DNA, 15 bp, Homo sapiens
  chr1:119522925-119522940
  hyper
cggttcatccagttg

SEQ ID NO: 26574 - DNA, 159 bp, Homo sapiens
  chr1:119526773-119526932
  hyper
ttgagctgacgggtgcgtgcgagaatgcgagacctgccacgtgtacacgtgtacgcggagtgtcgatctgcctgcgtgtccttggatgtgcctgtctaggtgcccacccgcgcgcgccaccacatccccaggcctctggaacgcagctgctgtgtggcc

SEQ ID NO: 26575 - DNA, 416 bp, Homo sapiens
  chr1:119527236-119527652
  hyper
cgagagccaggctcctccgaggctggtcttgaggcacttctctagtagcttctccaaaagactgagagtgccggcgtaggtatgacagtgagggtacctcacagacccttctccaaagtctggcgggccttggggtttttcggggccaccaggctcggtggaatttttgaaacgctttcgaaatacatagtttcctctgtggagtgagtgcctacaacgcgcaggccggactgatcccccgttgctgcaggttggtgccccaagctgcgggtgctcgggcgccaactaaagccagctctgtccagacgcggaaagaaaaatgggctgtgaaaaagcaaaaggcctcgtctttgaatgaaagttaaacattaaaatctgaccctagagttgtctaaagatcgcggaattttgaagct

SEQ ID NO: 26576 - DNA, 140 bp, Homo sapiens
  chr1:119528015-119528155
  hyper
cgcgcctttcgctaccgcctgagtctggagccgacagctccacctcttctgctccctggaccgccgcgtctccacgccacggcgccctttttactaaaagatcttttctcatcctatcagcaaatcgttaagaaaggctt

SEQ ID NO: 26577 - DNA, 684 bp, Homo sapiens
  chr1:119528653-119529337
  hyper
aagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaattgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtc

SEQ ID NO: 26578 - DNA, 51 bp, Homo sapiens
  chr1:119529378-119529429
  hyper
cgttgtatgtgcgcgcgcgcacactcaagattcttccgacaacagctgttc

SEQ ID NO: 26579 - DNA, 108 bp, Homo sapiens
  chr1:119529804-119529912
  hyper
tattggattggagaacgccgcgccagtcctcccgagttctcagaagcgagtcctagatctcggctcccgccgttgccttcggcccgcgcccctcccaatcccagggac

SEQ ID NO: 26580 - DNA, 144 bp, Homo sapiens; identical to SEQ ID NO: 1805
  chr1:119530005-119530149
  hyper

SEQ ID NO: 26581 - DNA, 307 bp, Homo sapiens; identical to SEQ ID NO: 1806
  chr1:119530201-119530508
  hyper

SEQ ID NO: 26582 - DNA, 47 bp, Homo sapiens; identical to SEQ ID NO: 1807
  chr1:119530553-119530600
  hyper

SEQ ID NO: 26583 - DNA, 124 bp, Homo sapiens; identical to SEQ ID NO: 1808
  chr1:119530601-119530725
  hyper

SEQ ID NO: 26584 - DNA, 116 bp, Homo sapiens
  chr1:119530998-119531114
  hyper
gcccccaaccaatagcgaggagggaacaagagaaactccgagagcgcgaaccaatgagaggaagggagagactgaggcccgggccaaagcgcagcgccagtcgtcccctggatgct

SEQ ID NO: 26585 - DNA, 132 bp, Homo sapiens
  chr1:119531865-119531997
  hyper
gatctcccccctggccgccccctgccttttgcgatctctaaggactgcattcaacatggatttctaaggaattaaaaaatccaacgctcctggccattcttaattcccacacctcttcccaagttacgccac

SEQ ID NO: 26586 - DNA, 37 bp, Homo sapiens
  chr1:119535303-119535340
  hyper
agtcgcagagagctgcgggacccgcataagtcgttaa

SEQ ID NO: 26587 - DNA, 148 bp, Homo sapiens
  chr1:119535573-119535721
  hyper
tcataaatttatctgcgttctatcggcattggggcaagaggagagcgaaaaggggggggaagccccgattttatatttgtgactataaaaaagcgccacccggtttcctcgccttcggccgccgcggtgtggccggcagagccggggc

SEQ ID NO: 26588 - DNA, 30 bp, Homo sapiens
  chr1:119536719-119536749
  hyper
ccacccagttcttggcggtgactaggactt

SEQ ID NO: 26589 - DNA, 3 bp, Homo sapiens
  chr1:119542991-119542994
  hyper
acc

SEQ ID NO: 26590 - DNA, 127 bp, Homo sapiens
  chr1:119543069-119543196
  hyper
cgaagagcgggtagatgccggccaagcaaagtgctcgaaagtgtagctgggacgcccacgccggaagcctggagaggcaagttgcgagttcgcagggcttgggagttttttgcggcggaagaagctg

SEQ ID NO: 26591 - DNA, 1078 bp, Homo sapiens
  chr1:119543408-119544486
  hyper
cgcggctgtctttcccggaaagacccaagtgcgcgatgtcagcccgcctgcacttcatctgagttgtccttatgtggccatttctgtttcaaatttcagatttttctactaaaaaaggatgggttaaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgagggggcaggggagggggaacagggctgggaaactgccgtcagcgggtcccggccccgcctcccgaacgcaacgtccaggaaacctcagaactttctattgtctgagaagcttcactgaacaaattgtccctaaaactttagagctgcgaagagcggatcagggcaggttctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctgg

SEQ ID NO: 26592 - DNA, 606 bp, Homo sapiens; identical to SEQ ID NO: 1811
  chr1:119549129-119549735
  hyper

SEQ ID NO: 26593 - DNA, 392 bp, Homo sapiens
  chr1:119549914-119550306
  hyper
cgtctaccccaacccgggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggactgggcccaaggctcccgggaccgggtcgtggttaacgccgaggccaagcccttcgaagaactctgagttctctgcctgacgttttgtccctcaggaagtgtcccttcccgacttttgagggtgtcttgttctttgacggggtggccctgtg

SEQ ID NO: 26594 - DNA, 29 bp, Homo sapiens
  chr1:119550692-119550721
  hyper
acgcgcctagcagcccggcggccccggcc

SEQ ID NO: 26595 - DNA, 304 bp, Homo sapiens
  chr1:119551013-119551317
  hyper
cggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgtcctgcgcattcacatgggg

SEQ ID NO: 26596 - DNA, 43 bp, Homo sapiens
  chr1:119869950-119869993
  hyper
tccctgccaggtgtccgaggcccgaccgcgccccgcccccacc

SEQ ID NO: 26597 - DNA, 30 bp, Homo sapiens
  chr1:119870224-119870254
  hyper
agcggagctgtgcaccggcctgtgtactgt

SEQ ID NO: 26598 - DNA, 43 bp, Homo sapiens
  chr1:120190546-120190589
  hyper
caacggtccactttacgaggcacaacttcgcccagccgttccg

SEQ ID NO: 26599 - DNA, 30 bp, Homo sapiens
  chr1:120254554-120254584
  hyper
gcccagttactctagcgcgccaggccgaac

SEQ ID NO: 26600 - DNA, 51 bp, Homo sapiens
  chr1:147775362-147775413
  hyper
tcaggcccagggagtcgcggacccgggcgtttcctgggatgctgggtctga

SEQ ID NO: 26601 - DNA, 87 bp, Homo sapiens
  chr1:147775510-147775597
  hyper
ctcaggttttccgaggctttggagcctgcacaattgttctacaaaaggcagtagctccgccgaacgttggatcgtcccttggtctgg

SEQ ID NO: 26602 - DNA, 121 bp, Homo sapiens
  chr1:150185824-150185945
  hyper
taagaatctgacccacgagtttcagtccaagtaacctggacctgcccagaggaagcaaagcggaagtaggatccaaaacgctttcagcaggccgcctgcgcccccgcgcatgcgcaggtct

SEQ ID NO: 26603 - DNA, 78 bp, Homo sapiens
  chr1:151118621-151118699
  hyper
caaataatcccttttcgcgcttcccagtccagcgggatgcgactcgacgaaagcccaattgaacgaggtgcccagact

SEQ ID NO: 26604 - DNA, 40 bp, Homo sapiens
  chr1:151445937-151445977
  hyper
ggggacagctggagccgcgaaggcgcgggggcccgcggcg

SEQ ID NO: 26605 - DNA, 30 bp, Homo sapiens; identical to SEQ ID NO: 5725
  chr1:151689335-151689365
  hyper

SEQ ID NO: 26606 - DNA, 382 bp, Homo sapiens
  chr1:151694024-151694406
  hyper
ccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatatt

SEQ ID NO: 26607 - DNA, 60 bp, Homo sapiens
  chr1:152083305-152083365
  hyper
ctctcccgctgctcccgcaatgggggcctggccgacagcctctgacggcccctctcgctc

SEQ ID NO: 26608 - DNA, 119 bp, Homo sapiens
  chr1:152083590-152083709
  hyper
atgcggctcttaatccgctcccgggcctgttcctgctcctcctcagctagctcctgctcgcgcctctcttcctcatgctcgcgcttcagccgctgctcgagcctctcttcctcctcctc

SEQ ID NO: 26609 - DNA, 435 bp, Homo sapiens
  chr1:152083710-152084145
  hyper
cgcttcagccgctgctcgcgcctttcctgctgctcgcgccttagttgctgctggcgcctctcctcctgctcctcgctcttcagcagctgctggcgcctctcttcctccggctcctcgcgcttcagccgctgctcgcgcctctcctcctgctcgagtctctccacctcctcgcgcttcagtcgctgctcgagcctctcttcctgctcgcgcttcagccgctgctggcgcctctcctcctcgcgcttcagcagctgatcgcgcctctcctcctgctcgcgcttcagccgctgctctcgcctctcctgctcgagcctcttctcctcctcgcgcttcagcagctgctcgcgcctctcctcctgctcgcgtcttagttgttgctcgctcctcaaccgctgctggagcctctcttcctcctcctggcgcttcagccgctgc

SEQ ID NO: 26610 - DNA, 984 bp, Homo sapiens
  chr1:152084564-152085548
  hyper
ctgctgctcgcgcctctcctcctcctgctcgcgcctcagctgctgctcgcgcctctcctcctcctgctcgcgcctcagctgctgctcgcgcctctcctcctgctcgcgcctcagctgctgctcgcgcctctcctcctgctgctcgcgcctctcctgctgctcgcgcctctcctcctgctgctcgcgcctctcctcctcctgcttgcgccttagttgctgctcgcgcctcagcctttgctgctgctgctcttcctcctggcgctccctcctcagctcttgccgctccagcttccgtagctgctcttcttcctcctggagctctctttgccgctgcggctcctcttcctgcaacttctcttcttccttccggagcactgtctcgcgcttcctccactctttctcttcttcctcctggaacactctgtcttgccgctctcgcctttgctgctgtttctcctcgcggcccttcctcctcagctccagcagctcccgccttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgcttctcctcatccagtcccgtggcctggccgagagcatagtaacaagcttgagccactttgaaaataaataggaggaattcgttgaaatcgacacgcccattactgtcaagatccagaagttccaggatcagatctaccgtcttagggtcatg

SEQ ID NO: 26611 - DNA, 168 bp, Homo sapiens
  chr1:152487789-152487957
  hyper
gtggaaagaaaaagccggctcgcctttgaaaggctgcctttcttccaggtttgtcgtgaggagctccgcgatgtcctctcaacagagcgccgtttccgccaaaggcttttccaaggggtcgtcccagggccccgctccgtgtcccgccccggcgcccaccccggcgcc

SEQ ID NO: 26612 - DNA, 225 bp, Homo sapiens
  chr1:152487999-152488224
  hyper
cggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgct

SEQ ID NO: 26613 - DNA, 79 bp, Homo sapiens
  chr1:153438376-153438455
  hyper
tcccaagcttccacacggtggcgccaccgagcacccacctcgccagagttgcgaggcggttccacgtggctgggccgtc

SEQ ID NO: 26614 - DNA, 590 bp, Homo sapiens
  chr1:153651798-153652388
  hyper
tgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgaggtgagacgctggcacaccccgtcccgccgcttagccgcagggcctcccctctgacctgccggaggcatcgggactttctctct

SEQ ID NO: 26615 - DNA, 8 bp, Homo sapiens
  chr1:154298145-154298153
  hyper
cgccgggg

SEQ ID NO: 26616 - DNA, 221 bp, Homo sapiens
  chr1:154298253-154298474
  hyper
cgcggggctggaggggccggggagcgggtgtagactggggagcaccgggggccaagatttgggagctgcggccagacggggcggggatggcggccgactggagacgaggggctgtcgggttcccggggacggggcagagcgggggtctgcgtacaggatgggaggatggggtgccgaaggggcgcgtggagagcaggagagcggcgcgagtgccaaggaga

SEQ ID NO: 26617 - DNA, 15 bp, Homo sapiens
  chr1:154474763-154474778
  hyper
tgctctttcctcctg

SEQ ID NO: 26618 - DNA, 81 bp, Homo sapiens; identical to SEQ ID NO: 95
  chr1:154474987-154475068
  hyper

SEQ ID NO: 26619 - DNA, 173 bp, Homo sapiens; identical to SEQ ID NO: 96
  chr1:154475371-154475544
  hyper

SEQ ID NO: 26620 - DNA, 68 bp, Homo sapiens
  chr1:154540186-154540254
  hyper
gaagactatcccagccggggaccccccttttttttcctgggacccagcgtttccgcctccggggcgca

SEQ ID NO: 26621 - DNA, 47 bp, Homo sapiens
  chr1:154733207-154733254
  hyper
ctgaagagccagtggcgcctgcctcgatcacacgtcccctgtggagc

SEQ ID NO: 26622 - DNA, 285 bp, Homo sapiens
  chr1:155043397-155043682
  hyper
tgtgggggtctcacccggctcccagcggccccaggccagcctccttttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctggggaggtt

SEQ ID NO: 26623 - DNA, 15 bp, Homo sapiens
  chr1:155147247-155147262
  hyper
ccgctgaccgggttg

SEQ ID NO: 26624 - DNA, 372 bp, Homo sapiens; identical to SEQ ID NO: 5737
  chr1:156215329-156215701
  hyper

SEQ ID NO: 26625 - DNA, 80 bp, Homo sapiens
  chr1:156339180-156339260
  hyper
gagcaaccacagtaacgcggacaatgaattttactttcgctacccaagtgagtgcggggtgagggcgcgcgggaagcaaa

SEQ ID NO: 26626 - DNA, 721 bp, Homo sapiens
  chr1:156357855-156358576
  hyper
tgagggaaggttctccggaagcagccgctgttctggcttggcgcaagtgcgtgtggacgacagcaggatttcctgcccagggacatctggataagaggcccaaggtccccaggagcccccaggtgcttctgccctgtgtggccagagccccctcggccaggagttagaagctgctcctctgacctctggaggacccggcactccgaaccccgcgcagcctgggaaaggcctgagattccccgctattgggattcacatcacgacgcggcggccccaactcggggaggaattagacacggcgtgagtgtcccaagtgcggggcggtggccgtcccggggcagacgagcgcggctgccgcgtccccccacctcaccccgatattccgctcccaccgtcgggaactcccccaccgccgcctccggccctgcgcgccccttctcctttgtctggcccgcccactcccagccggtccgccgcgccgccccgcgcgccccggcccgtgcgcccgccgccgccgcccaggaacaatgcgggccaatgtctccgggcgggcgagccggctatgcaaatgcccaacggcctgtgagaatccccttcgccgccgcctgggcttccacggcctgaaaagggctggcggccgggcctgggtgggggaggcggccactgcatagggatgagctgttgtcccggagcgcccgggacagagcgccattgtctgtgc

SEQ ID NO: 26627 - DNA, 1108 bp, Homo sapiens
  chr1:156390108-156391216
  hyper
ccccgggcccctctgcgcagtgtatggggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtg

SEQ ID NO: 26628 - DNA, 286 bp, Homo sapiens
  chr1:156391242-156391528
  hyper
cgaagagggtgggggctcggccggcccctcgtggcggacgcgcgggcacgccggattccgaggcgctcgcccacctcgtgctccacgctggccaggccacttacatcgagcccagggtgcccatccgtgctctcccgcgcggtcctcccggccagttcccgcccctggagcgccagggccctgagttccagatgccggggctcagcgggcgccgggcagaggaggctgccctgctcttagcctccgccgagcctaggcgagcagggtggagcgggtctcacctcct

SEQ ID NO: 26629 - DNA, 48 bp, Homo sapiens; identical to SEQ ID NO: 1821
  chr1:156405367-156405415
  hyper

SEQ ID NO: 26630 - DNA, 437 bp, Homo sapiens; identical to SEQ ID NO: 1822
  chr1:156405634-156406071
  hyper

SEQ ID NO: 26631 - DNA, 493 bp, Homo sapiens
  chr1:156406104-156406597
  hyper
cgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaagccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcag

SEQ ID NO: 26632 - DNA, 30 bp, Homo sapiens; identical to SEQ ID NO: 5745
  chr1:156468873-156468903
  hyper

SEQ ID NO: 26633 - DNA, 51 bp, Homo sapiens
  chr1:156474407-156474458
  hyper
acctggcatagaatgcgctcagcaaatgtgttaacacgaatctgtatttgt

SEQ ID NO: 26634 - DNA, 212 bp, Homo sapiens
  chr1:156594433-156594645
  hyper
ctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctc

SEQ ID NO: 26635 - DNA, 203 bp, Homo sapiens
  chr1:156594850-156595053
  hyper
cgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtg

SEQ ID NO: 26636 - DNA, 104 bp, Homo sapiens; identical to SEQ ID NO: 5748
  chr1:156595080-156595184
  hyper

SEQ ID NO: 26637 - DNA, 44 bp, Homo sapiens
  chr1:156595221-156595265
  hyper
cgtggcgggggtctctcgccacccctttccggagagcctcccct

SEQ ID NO: 26638 - DNA, 169 bp, Homo sapiens; identical to SEQ ID NO: 5749
  chr1:156611775-156611944
  hyper

SEQ ID NO: 26639 - DNA, 126 bp, Homo sapiens
  chr1:156611993-156612119
  hyper
cgtgcacccggaggagacccccggaggaggcgacaaacttcgcagtgccgcgacccaaccccagccctgggtaggtgagtgcctccgcagccccgccgcccgccgtggggtcggggacagggagaa

SEQ ID NO: 26640 - DNA, 544 bp, Homo sapiens
  chr1:156626475-156627019
  hyper
gatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccctgccatatgctctcactctctctcactcgcctaaccgccttcctcattaacccatgcacttattccttggttttctcaagcgtgcattccctcactcatt

SEQ ID NO: 26641 - DNA, 166 bp, Homo sapiens
  chr1:156646634-156646800
  hyper
cgtagagcctctagctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctctt

SEQ ID NO: 26642 - DNA, 199 bp, Homo sapiens
  chr1:156814754-156814953
  hyper
gaggggcaagcaaagcgaggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggttgcaggcatggatgtcgatc

SEQ ID NO: 26643 - DNA, 210 bp, Homo sapiens; identical to SEQ ID NO: 1825
  chr1:156815030-156815240
  hyper

SEQ ID NO: 26644 - DNA, 480 bp, Homo sapiens
  chr1:156815273-156815753
  hyper
cgcctccaaaagcacccacaacccgggacccgcccacacaagcaaggccccacccacaaaccccacccctcccgcaagacccgcccctcacaggccccactcatcagaccctcccaggccgcgcgcgctcttcgcacatggggatggtgatcgcgttgtgtagaaagttttcaaacttcttctggaacgaggcctcttgcgcctccagcgggggcagaacctgaccaggaggtgggtgctggcaagggcagcagtcggactccatctcggcctcaggatccccgtcttcgccgtcgaagcgcggatcgttgttgctggtgggcagccgcaagcctggcgccgcagcgggaagacactagtaagacaggcggtctacccgcctctgatcccccccacctgccggggccctgcgcctccatctccccttccccacccgccccgcggccggcctgcgcgtcgtccctgcgcaccgcggtggca

SEQ ID NO: 26645 - DNA, 467 bp, Homo sapiens
  chr1:156818562-156819029
  hyper
acctgggccctaccacggagtacaacttgcgggtcctggcttcctgggtcttcatagcctcgctgagctccgccctcacctgcctgtggtcccgaagaaattggcctcgtccggtcccgcccccgctccggccccgcccccggcactcacgactccttgtagtacacgatgaagctgagcaggtcgcgggcctccagtggctcatagcgctcccagcgtagcaggatgcggtctgcctccgtcacgttggacacgaagcgcagggtgcgagtctggcctgggtggggcgaggggcctgctcgcaaccgcgcctgccagctgcttgagcgcccaccctgaccccgcggcatcccattcccagtgagacctctgaggagaacttctcagagtgtccccctcgagctttctccctcccccgggtgtgcgtgtctagtgtgtggccgcgtgtccaccggcactggggttgg

SEQ ID NO: 26646 - DNA, 54 bp, Homo sapiens
  chr1:156829171-156829225
  hyper
caagtggggctgcaccgccggaggggcagccagcgcgcccgggcttctggggag

SEQ ID NO: 26647 - DNA, 30 bp, Homo sapiens
  chr1:156829545-156829575
  hyper
cttggcggagagaaccgtgagcctctagga

SEQ ID NO: 26648 - DNA, 83 bp, Homo sapiens
  chr1:156830265-156830348
  hyper
cgcgccgcgaggatggagcgctgagcctggggctggctaggatgacctggacagcaacctttcctcaacgcagtcatcttccc

SEQ ID NO: 26649 - DNA, 96 bp, Homo sapiens
  chr1:156830979-156831075
  hyper
ggcattgcagtgccccgagggcgcggactcgctgcttgtttgctggtcaggcaggacgagcacggcggaaggctggcaccacgcagccttcggcgc

SEQ ID NO: 26650 - DNA, 425 bp, Homo sapiens; identical to SEQ ID NO: 99
  chr1:156863061-156863486
  hyper

SEQ ID NO: 26651 - DNA, 84 bp, Homo sapiens
  chr1:156863640-156863724
  hyper
cgcgccccctggcaggggaggcccggtggtgcggccccggagaccaccctgccccggggaaagggcttgcggtccctgaggtcc

SEQ ID NO: 26652 - DNA, 30 bp, Homo sapiens
  chr1:156890393-156890423
  hyper
cctttccctcgggcccgcccgcctcgcgcg

SEQ ID NO: 26653 - DNA, 85 bp, Homo sapiens
  chr1:156890711-156890796
  hyper
gaccgttctgcctcccgtgggggaggaggagcccaaaagccctggtacgctggcgccggggtttggggatcgggcttccaggctg

SEQ ID NO: 26654 - DNA, 142 bp, Homo sapiens
  chr1:156893837-156893979
  hyper
cccccacccgcccttcgtcccctccgcctctttgtcggaaaaggccaccttaggtgagtgacagtggagctccccggtgcctgccagggccgcctagtccatcctcagcctcccttcccacgccgggccaaatggagggacg

SEQ ID NO: 26655 - DNA, 40 bp, Homo sapiens; identical to SEQ ID NO: 5761
  chr1:156894252-156894292
  hyper

SEQ ID NO: 26656 - DNA, 41 bp, Homo sapiens
  chr1:157963385-157963426
  hyper
ccctcctccccagcccgctcctctggctcgctcgccaactc

SEQ ID NO: 26657 - DNA, 52 bp, Homo sapiens
  chr1:157963443-157963495
  hyper
cgggcgcacggcgggcggacagcatgctgagcctcctcgtctggatcctcac

SEQ ID NO: 26658 - DNA, 154 bp, Homo sapiens
  chr1:157963737-157963891
  hyper
tgtttcctctggctgcgcgggagaaccgagcaatggggccgcgagggctggaggtccgagtaaaacggggaaccgaacgctttctcttgagcttctggcagccctaccgaccctcgccctctgaggccggggttccggacgcctgagtccagcc

SEQ ID NO: 26659 - DNA, 401 bp, Homo sapiens; identical to SEQ ID NO: 5763
  chr1:158083182-158083583
  hyper

SEQ ID NO: 26660 - DNA, 44 bp, Homo sapiens; identical to SEQ ID NO: 1828
  chr1:158150605-158150649
  hyper

SEQ ID NO: 26661 - DNA, 147 bp, Homo sapiens; identical to SEQ ID NO: 1829
  chr1:158150650-158150797
  hyper

SEQ ID NO: 26662 - DNA, 161 bp, Homo sapiens
  chr1:158150798-158150959
  hyper
gaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtg

SEQ ID NO: 26663 - DNA, 110 bp, Homo sapiens
  chr1:159141434-159141544
  hyper
ggctccgaagcggctcgggggcgccctttcggtcaacatcgtagtccaccccctccccatccccagcccccggggattcaggctcgccagcgcccagccagggagccggc

SEQ ID NO: 26664 - DNA, 132 bp, Homo sapiens
  chr1:159141599-159141731
  hyper
cgcctgctgctgggcgcccggcggggccaacctctcccaggacggtgagtgagggagggggcggcgcctggggaggtggggagtgacccgaggcgggggctgggatcgggagtctcgcggaaggagcctgtt

SEQ ID NO: 26665 - DNA, 64 bp, Homo sapiens
  chr1:159158305-159158369
  hyper
cagctggctctgagtcgcgctgggacgactggcgaagttcacccgggactccaaagcccggaca

SEQ ID NO: 26666 - DNA, 40 bp, Homo sapiens; identical to SEQ ID NO: 1832
  chr1:159158471-159158511
  hyper

SEQ ID NO: 26667 - DNA, 76 bp, Homo sapiens
  chr1:159750570-159750646
  hyper
gtggaagtaaccccccgcccattatgatgatccagccaatcaccgcgtgatctgctcggacggggcgggatcgcgg

SEQ ID NO: 26668 - DNA, 52 bp, Homo sapiens
  chr1:159750677-159750729
  hyper
cgcgttccagccccgccccaggttctgggccaatccccgcggctgggcagag

SEQ ID NO: 26669 - DNA, 114 bp, Homo sapiens
  chr1:159751133-159751247
  hyper
gacgaggccaacgcacggggagaggtcagcgggcggggtcagcgcagggagggaggggcctggaaggtcagcgggggacacgggcggagctggggagaccgggcctgggataac

SEQ ID NO: 26670 - DNA, 30 bp, Homo sapiens
  chr1:160039721-160039751
  hyper
gaggatctgggaccccgatgtctctggaga

SEQ ID NO: 26671 - DNA, 129 bp, Homo sapiens
  chr1:160040345-160040474
  hyper
aggcggtcctgtcagcgatgggttacgagagctggagccggggggcgggactgggaccgagttaacgaagtggaaatgaattcaggaccggcccagtggccctgcaggcagcgccgaaggcggcgcctg

SEQ ID NO: 26672 - DNA, 158 bp, Homo sapiens
  chr1:160370097-160370255
  hyper
cattcccctgcccaccgttcgggacccgagtgtcagccccaccgcggattcccaggatcggggagggccgctgggcatctgaaggcgcagggctgggggagcggcgactccgggaagagcggggccgcagacaatggacgcggcggtaggaggggcgg

SEQ ID NO: 26673 - DNA, 30 bp, Homo sapiens
  chr1:160370599-160370629
  hyper
acaaaggcgacgggccgagcggggcgcccg

SEQ ID NO: 26674 - DNA, 114 bp, Homo sapiens
  chr1:161068047-161068161
  hyper
ggtggcaccaccatacggttcccgatagccacccaggtgtcctgtctccacggtaactgctgctttgcgaccttcggtttgcagcggtcgcgctgcagccgctgcagtggttgc

SEQ ID NO: 26675 - DNA, 179 bp, Homo sapiens
  chr1:161068380-161068559
  hyper
cagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccg

SEQ ID NO: 26676 - DNA, 15 bp, Homo sapiens
  chr1:161275564-161275579
  hyper
ctctgctcatccttt

SEQ ID NO: 26677 - DNA, 484 bp, Homo sapiens
  chr1:161275639-161276123
  hyper
cgatcccccgcccggcccgctaaccgctatttcttatccttgcgagactcccccagccccttggccttcttctcactgacagctttggtgcttctgctgtggtccagcattgcatacagcactggcgtctgggggaggggcgcacacatcagtcaccgagcgactggggcttgactgttcccatcccacccctcactgctgcccggcggctcccagggttctccttcccatcttgtctaggccccaagtcccgctaacctgccgcccgcgcttcgacgcgtcctttcctggcttgtgcaatttccccttctccatagcactgcaagaagagagactgctgtacgtttggcctcgccggaaccccttgcaccgcggacacagcttcctcttccccttggccctcccacccactggagtagtctccgcccagatgggggatagtggggagagggggaggggagctaggctccgccccttacctgag

SEQ ID NO: 26678 - DNA, 97 bp, Homo sapiens
  chr1:161409851-161409948
  hyper
acaccctccaaacaccgcaagcctccttccccggcgcacaggcacgcagccacaggccaagctgcgacgcgagctccgcgcgcgggatctccgcaaa

SEQ ID NO: 26679 - DNA, 171 bp, Homo sapiens
  chr1:161494827-161494998
  hyper
gcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcg

SEQ ID NO: 26680 - DNA, 94 bp, Homo sapiens
  chr1:161509954-161510048
  hyper
caatttttttggagacgtgagtgctgagcattttttcttcagtgaagtgacttggcagccaaaatcgccaacgcccgtctctgtggcgcaatcg

SEQ ID NO: 26681 - DNA, 154 bp, Homo sapiens
  chr1:161510108-161510262
  hyper
tcgcattttgtgaaccctgggtttttgaaactttgactgaaaaaactgcgtgcgatgctatccgctgggagcgctggggccttggcgctcaaaaccagccgcggtgctaaccgcagggagctctggtagcagacctccgcgttgtgtggttccc

SEQ ID NO: 26682 - DNA, 128 bp, Homo sapiens
  chr1:161581762-161581890
  hyper
ctccagcggagggtgcgatttgaacgcagcgccttaagactgctcggccatcctgacacacgttttgctaaacttcctaatttctcctaattttatcatatactgatggtgcacgctatcaggtcaca

SEQ ID NO: 26683 - DNA, 168 bp, Homo sapiens
  chr1:161582427-161582595
  hyper
aagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttcc

SEQ ID NO: 26684 - DNA, 30 bp, Homo sapiens
  chr1:161591283-161591313
  hyper
ctaggcaagtgctagcgcggaaaaaagacc

SEQ ID NO: 26685 - DNA, 112 bp, Homo sapiens
  chr1:161591628-161591740
  hyper
gctctcaaaaccagccgcggtgctaaccgccgggatccctggcagctgacctccgcgttgtgtggttcccaatgtcctcttctgccttagtgctgtacgggtaattttgagg

SEQ ID NO: 26686 - DNA, 180 bp, Homo sapiens
  chr1:161695643-161695823
  hyper
tgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgca

SEQ ID NO: 26687 - DNA, 185 bp, Homo sapiens
  chr1:161697126-161697311
  hyper
ccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctg

SEQ ID NO: 26688 - DNA, 477 bp, Homo sapiens
  chr1:162792076-162792553
  hyper
gcatttaaaatgaggcgaaagaacaaatggaataattatagaaaattttagcctctagcaaaacactgtgaagcagctccagcctgtggtggaagatgtgcgaaagggatgggggaacgctgtggaccggtgtggagtctaggacgacaggtggtgggctctgtccccacgcgcctcgcggccagcagaggccccctcactgcggccgccgggcgggactggcgcgggcggcgctgggctgggcccgggaggctggcatccctgggtgctccggtgcggtactagggggcgacggctgagccgtgggtggagccgctgggtcagtctcggatagaaataaactgggaaactgctgtggtctctgttgcttgcgtgctcggttttcgtgcttatcacgctgatgatgaggaaggtggttttggttacggagtgagcaggtgaacgcctccccgtggaccccaccggactgggtgggga

SEQ ID NO: 26689 - DNA, 148 bp, Homo sapiens
  chr1:164290524-164290672
  hyper
cccctctgttgtgtgcgccgcgtccggggagcctgggccgtgcctccctggcgtatgcaggtcgccggcgcagccgccagctccgggggccgcgcttccagccacccgcagccggcggggcccgccgggcagcacgggaatcgcggag

SEQ ID NO: 26690 - DNA, 67 bp, Homo sapiens
  chr1:165086960-165087027
  hyper
taattggctgtgacacgcgggccagctgttgtgagaggtggagcgcggcgggcgttttccaggacgg

SEQ ID NO: 26691 - DNA, 189 bp, Homo sapiens
  chr1:165204385-165204574
  hyper
agagcgtatagggggcgatgcagtcgatggtatctgtagcacagtacccagaagacccgggagctaggaccaaaccaggagtcagctcagtccaaaggaaatcagggttcaggtagcgacggtgtccgtgcgtttcttcactagtgcatgtgcgaggagggctggaggcatgagcgaaagagggaaggc

SEQ ID NO: 26692 - DNA, 69 bp, Homo sapiens
  chr1:165204838-165204907
  hyper
gacgtcacctgggaacgcgcggcggcgcggggcggcgcggacccgggacgacctcgccgcgacctggcc

SEQ ID NO: 26693 - DNA, 45 bp, Homo sapiens
  chr1:165205298-165205343
  hyper
cgcccccagcctgagcgctgagagggaaaacgagagctagaaagg

SEQ ID NO: 26694 - DNA, 126 bp, Homo sapiens
  chr1:165321661-165321787
  hyper
aaaagcccctgcatccgagggttctgcagaaaaccaggaaggcgacagtgaaagggcgaacgggctgtgcgcttagctccgaatggcagcagagccatttccgagcccaaactgtccggactccag

SEQ ID NO: 26695 - DNA, 30 bp, Homo sapiens
  chr1:165323752-165323782
  hyper
aagtccaaaagttcccgaaaggggggttca

SEQ ID NO: 26696 - DNA, 1179 bp, Homo sapiens
  chr1:165324178-165325357
  hyper
tccagttaattaacgcggagcctagggcccagccgcgcggtctaatccccgcgctgcgttgcctactggcccagaaaagtctctctcggccttgcccatggctgaaattggggctggagttggtgggggagagaagcctcctcgaacttgggcgctccaggcctcgggtctcggatgctattgcctctaggccgcgagaagagggcggcatttatgagacgtcgatcagctccgagattaaaaatccagccctgggtatttttaatcacttgccactcagacgcctacgaacaagctcgcccgcccctcgcggctttggggaattcggtgcccagtgcgtgaggcctggggcggcttgttggatttatttgggtagggacgacccacaagcactgacggacagatagtgatggggctcaatttagtgtatgaagaggggcgctagcttccctatcgcggaccaggtcccagagagcggggctccagagctcagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgccccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgcgggacgatggggtttgcaatcccgcgtcccagccgccccgttgcggccctcacctgccccaggtcgagaaggggcactgtaagggacccggagggcgtcccgcc

SEQ ID NO: 26697 - DNA, 26 bp, Homo sapiens
  chr1:165325394-165325420
  hyper
cgcgcaggagccggtgtgcggggcgc

SEQ ID NO: 26698 - DNA, 559 bp, Homo sapiens
  chr1:165325646-165326205
  hyper
ctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccc

SEQ ID NO: 26699 - DNA, 173 bp, Homo sapiens; identical to SEQ ID NO: 1836
  chr1:165326296-165326469
  hyper

SEQ ID NO: 26700 - DNA, 209 bp, Homo sapiens
  chr1:165345473-165345682
  hyper
agggagggaacagcccgagaagggagggggctgggaagggtttgttgttgctttttctgaattaaaagaaaacagggactagagcaaggaagagagcgaagttcaagggagaatctggcaagtcaccttgggcagcccctggaccgccgccagagctctcttggagagggtgaggacgccgagcgtgtgatgagcgcctagtgagtatt

SEQ ID NO: 26701 - DNA, 132 bp, Homo sapiens
  chr1:165414298-165414430
  hyper
aatctgcctctagatcggagagtccacatagtgcgtttgagacggctgtggcggcagcagctggtgcctgtcagtaatcacgcataatgctgccgccgccgccgccgccgccgtcaccgctactcttgccac

SEQ ID NO: 26702 - DNA, 79 bp, Homo sapiens
  chr1:166134203-166134282
  hyper
agttctgaaaggaggcgggtgcggagttatgaaaatttggtaaatataaaagtcccggacgcgaccgcccgtagcctgc

SEQ ID NO: 26703 - DNA, 608 bp, Homo sapiens
  chr1:166134283-166134891
  hyper
gcccctggcggttgaggagccgcggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacgg

SEQ ID NO: 26704 - DNA, 653 bp, Homo sapiens
  chr1:166134933-166135586
  hyper
cgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgc

SEQ ID NO: 26705 - DNA, 57 bp, Homo sapiens
  chr1:166853653-166853710
  hyper
tagaggaagaagagacggccctgagcgcagcatcacctcggccggttggagtctgcc

SEQ ID NO: 26706 - DNA, 71 bp, Homo sapiens
  chr1:166916850-166916921
  hyper
gctgagccaatttctcggtgccacccactctcgcgcctgcccccagcccccgtttcctcccccgctcgggc

SEQ ID NO: 26707 - DNA, 14 bp, Homo sapiens
  chr1:166916936-166916950
  hyper
cgactacaatgcag

SEQ ID NO: 26708 - DNA, 196 bp, Homo sapiens
  chr1:166945272-166945468
  hyper
ccaggcaagaggctccgcagaattgaaaaaggtaggcgggaatctcgcgtcattactttttcctgttaaaatatgaggtagaataagggcatccggccctttaacagaaaatatgtaaaaccagaatgagataaatgattataacggcttaaatccatccaacactttatagattccagcacgcattcacatggat

SEQ ID NO: 26709 - DNA, 673 bp, Homo sapiens
  chr1:167599179-167599852
  hyper
gaaaaagaaagaaggcgcattaagggagggagacgttgagaaggactgagaccgtggcaaagcccagggtcctgagaaacttcgcgagacagaggggcccggtggctgcccatccccatgtttgggcacatggagtcgtggctcccgctcttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccac

SEQ ID NO: 26710 - DNA, 349 bp, Homo sapiens
  chr1:169396286-169396635
  hyper
taagctactctcagacgagtatccttcatacatagtgaagaaaggtgttaccagacttccccaccagtgccagactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctcc

SEQ ID NO: 26711 - DNA, 53 bp, Homo sapiens; identical to SEQ ID NO: 102
  chr1:169396636-169396689
  hyper

SEQ ID NO: 26712 - DNA, 193 bp, Homo sapiens; identical to SEQ ID NO: 103
  chr1:169396730-169396923
  hyper

SEQ ID NO: 26713 - DNA, 237 bp, Homo sapiens
  chr1:170630365-170630602
  hyper
tgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatccc

SEQ ID NO: 26714 - DNA, 207 bp, Homo sapiens; identical to SEQ ID NO: 105
  chr1:170630603-170630810
  hyper

SEQ ID NO: 26715 - DNA, 30 bp, Homo sapiens; identical to SEQ ID NO: 5798
  chr1:170631084-170631114
  hyper

SEQ ID NO: 26716 - DNA, 264 bp, Homo sapiens
  chr1:170631315-170631579
  hyper
gtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaa

SEQ ID NO: 26717 - DNA, 33 bp, Homo sapiens
  chr1:170633073-170633106
  hyper
tatctctttggaccgcgccggacttggcctcag

SEQ ID NO: 26718 - DNA, 46 bp, Homo sapiens
  chr1:170633432-170633478
  hyper
tcgacaccctgcaggcgaaaaagaacttctccgtcagtcacctgct

SEQ ID NO: 26719 - DNA, 381 bp, Homo sapiens
  chr1:170633902-170634283
  hyper
cggctcggttcatcccgcacgcggggcggcggggctgggctgggaaaaggtcttagcggggtgcaaactcagagagccagcgctgtttgggaaagcagcaggttaaagatgctgagtcgggttggaagggcttctctcgggcagcgtatgacggcttgagggagggcaccaggcacagggagcaggacttggcgctgctcaggctgcactctccacgcgggcaccgtaaggccgggcgcgaccgggaggccccgagagaacgcccggccccagacgctggagctgctctctgccccctgctgttgcctctaccgcaaatgggtttgagactggcagagtcaaaagcccggctggcttgggaaaactcgggccaagcaaagg

SEQ ID NO: 26720 - DNA, 44 bp, Homo sapiens
  chr1:170637766-170637810
  hyper
ctcgggaccttgccccgccaacttctcttcgccagagaaacgcc

SEQ ID NO: 26721 - DNA, 190 bp, Homo sapiens
  chr1:170640121-170640311
  hyper
agaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaag

SEQ ID NO: 26722 - DNA, 108 bp, Homo sapiens
  chr1:170640517-170640625
  hyper
gtgtggtctctgcctcggcaaagaaacaaacacccccaccccatcttcgcagttctcctctctgctgtagcgacgccaggcgctgctttccgccgggtaaattagcgg

SEQ ID NO: 26723 - DNA, 15 bp, Homo sapiens
  chr1:170640664-170640679
  hyper
cgaaagggggcgcgc

SEQ ID NO: 26724 - DNA, 1087 bp, Homo sapiens
  chr1:171810200-171811287
  hyper
cctgggaggagtcatcgcggattctggagaagggcgtgacagaggagatttcctttcgggaagtgtagtctggcagcggtgccccggtggtggcggcggcggtgctgctgttgctggtgatcgtgtggtggtgttagcggcgatagtgctttccactgggctttggcttggtagccgctgaaagagaacaacgctgccgctgctgctgatttcatgccatttcctgacccggcgctgtaacttggcctctgagccttggccacagaacgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtg

SEQ ID NO: 26725 - DNA, 238 bp, Homo sapiens
  chr1:171811320-171811558
  hyper
cgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtga

SEQ ID NO: 26726 - DNA, 411 bp, Homo sapiens
  chr1:173638647-173639058
  hyper
tacagaaagtggcagcgccgccaggtgatccaggaggtcccgcgagggggcaacggacacttcagggcaccagagtttgctcttcggcctgaattccctagggaccttctgcgatcccttgcggctgccggcggggtaggagaccggtgcgcaaagctctggacagaagcagtgtgaggacgctgagattgaagcccactcccctccagccctgcccgagcagcctggagggaagatgtccgtctaccccatcgcactcctccccaagtgcccaccccggcccacagcgccaggacccctagactcaccacacccgggccccggcctcctcggttaccatagcaacggcgcaacacgcgaggcagcgcctcctcctgcgccgcggttccggcagcgcgggaaggttattct

SEQ ID NO: 26727 - DNA, 142 bp, Homo sapiens
  chr1:177133445-177133587
  hyper
agtgggtgtgtagagcgagctggagtggggggtgggggcgccggtccagcgcctccggccgcctcgacctcccccgggactcacccagcacgaagtagggcagctccgtgttctccaggtcgtccaccacgaccatttctcc

SEQ ID NO: 26728 - DNA, 372 bp, Homo sapiens
  chr1:177133689-177134061
  hyper
cgtgatgcttttgagcttgcactccagctccttggatggatccacgtcgccggcggccgtggccagcaccgccgccggcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggag

SEQ ID NO: 26729 - DNA, 40 bp, Homo sapiens
  chr1:177140105-177140145
  hyper
gacactgcttaggtacggagcgcggagtcggagcggggac

SEQ ID NO: 26730 - DNA, 28 bp, Homo sapiens
  chr1:177140146-177140174
  hyper
cgccgggctgcagctctgggatgcaatc

SEQ ID NO: 26731 - DNA, 390 bp, Homo sapiens
  chr1:177140304-177140694
  hyper
cgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacacgctgagggggaggc

SEQ ID NO: 26732 - DNA, 481 bp, Homo sapiens
  chr1:177150773-177151254
  hyper
tgccaccccctcactcggtgttcagccatttatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggggagggacagttgcatttgcagaagcaatcctgtctggaactaagctgattagtcctggtgccgtccctccctccct

SEQ ID NO: 26733 - DNA, 30 bp, Homo sapiens
  chr1:178063661-178063691
  hyper
aggcgctgtcctggccggagatgttcccgg

SEQ ID NO: 26734 - DNA, 306 bp, Homo sapiens
  chr1:179544785-179545091
  hyper
ctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggc

SEQ ID NO: 26735 - DNA, 88 bp, Homo sapiens
  chr1:179545092-179545180
  hyper
tgcccgggggaccctaaagaccgtcgggtgggggctgagggcgaggggcgggacaccggggccgcgggcggggcgcacccggaacccc

SEQ ID NO: 26736 - DNA, 397 bp, Homo sapiens
  chr1:179711942-179712339
  hyper
gatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaagtcccctgtactgaggcgttcccagggcgcccgcctcccgcgtttacatttcttaggcaaaaaggcagcggagctaagcaggggtgtttggaaggcgcccgttgcgctgtttgactgcgtggcttcacttggcccgcgtgcatcagcctctctggcgggggattctccccggactc

SEQ ID NO: 26737 - DNA, 144 bp, Homo sapiens
  chr1:179712410-179712554
  hyper
cgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagc

SEQ ID NO: 26738 - DNA, 24 bp, Homo sapiens
  chr1:179712567-179712591
  hyper
cggggcctcatcgtgcaggggagc

SEQ ID NO: 26739 - DNA, 142 bp, Homo sapiens
  chr1:179712592-179712734
  hyper
agcggaggggcggggcggggcgcgggcgggctgaggagccgccgggctcgggctccgcgcggggatgtgtctggccaccgcgtactttcgagggcgcctcaacacccgggtaagcgcgccccggctgcctccctctgcccac

SEQ ID NO: 26740 - DNA, 345 bp, Homo sapiens
  chr1:179712830-179713175
  hyper
cgactcgggggcatctccggcctcgtggccagaccgcgggtggcggtgctcgcgcctcggggccggacttgccgggtccctgcccccgggccgtgccgaaggcgctctactcagcgtgtctgcagcgacccgcttctctgcgctttcagccgggccggacctcacgcggacgccgctgctgctgctgcgcctcgcgcccgccgccacccggggagcatgaggccggggcaggggacccgggtagggtgggggccgaccggcggggtctgctgggccaatgcgccgccgtcggtcagtgagtccggattcgtgccggcaactgtgggcagccttgagaccggggct

SEQ ID NO: 26741 - DNA, 300 bp, Homo sapiens; identical to SEQ ID NO: 5815
  chr1:180198156-180198456
  hyper

SEQ ID NO: 26742 - DNA, 158 bp, Homo sapiens; identical to SEQ ID NO: 5816
  chr1:180202237-180202395
  hyper

SEQ ID NO: 26743 - DNA, 646 bp, Homo sapiens
  chr1:180202648-180203294
  hyper
cgagccgcctccaaaactctccccgcggacctcagcagtccctccacgcgtcggggccctgctggccggccatgccctctgaggagacgcggaaaagagcgaggcatataggaaggtggggcgttttatccgcctcggttttgacccatctgccatgtagtctccccaggcaccgagggaaaggacgacggaagcccgccgcccggatcgctggcgggagagagggcagcccgcacgggagaaggaggagccccgcggggtctccgctgggggtggtaattggaatgcaggcctgggggtctctgtccccctccttgtctcctaaaatgcttccggcaagctctggcgaaccccgaagctgtaggaaaaaggtattttattttgtgtttggtagggtcggggtaaaggttttccctgggacttcctctcctggggctcctccggggtgcgtggggtaatgtcccagcgcaggtcgagttgcagatccgagtccccggggttgttgactgtccttcttgcaggacatttcttaagggggtgagatggattcactgtccaagacaggagttcactcaaacgctggtgctgttcgctcttctttccattcctgccttgtctcctagtgcgagaaacagacacacacaac

SEQ ID NO: 26744 - DNA, 254 bp, Homo sapiens
  chr1:180203354-180203608
  hyper
taatagattgagattctatcatattccgaacattccgatatagcagctgtaggcaccatagacctccctccctgcgtcgcgagaatatattctcaggcaggagacaatttttacagatgaggtcagctgtccccgccggccgattcgggcctgatgggttgggggttccgatgtcctaactgctaggatcccgttccagcccctggccagagctgtgtaccacaaagaagggagtttggagaaacccgggtaag

SEQ ID NO: 26745 - DNA, 588 bp, Homo sapiens; identical to SEQ ID NO: 1847
  chr1:180203633-180204221
  hyper

SEQ ID NO: 26746 - DNA, 398 bp, Homo sapiens; identical to SEQ ID NO: 1848
  chr1:180204222-180204620
  hyper

SEQ ID NO: 26747 - DNA, 474 bp, Homo sapiens
  chr1:180204897-180205371
  hyper
cgccggggaaggcgaggtggcgcgggccaccgggtgcactcaccgcacgagaggccgcggctggactgggaccgagcgcatccctgtgtctcagggggtttgctttgtgcaggatgggaccttattatttttagacagtggggcaaacgtgtcttttaaagagatccgaagggtgaaactaatgaaaaaggaaatgaattactagaaaagccgtgaagggataaaaccgggagcagcaggaagttgaaggaaggacgaccgaagctaggtgtatctgcacctgcctcttgacacgccaaaaacaaaggggggttaaggcaagaatgtagactaaatgctgtgaggattagggtaacgcgagccctcaagacgtctcggagaccgcctacagggctgcaaataccagggtccatttttaaaaatcgagtgctcctagaggtggggtgggggtgggagagccgggaaaccagcaaa

SEQ ID NO: 26748 - DNA, 60 bp, Homo sapiens
  chr1:180206312-180206372
  hyper
tagtgcaggaattcacgacacaggggttttactcggcggggggggcggggaggagggcgg

SEQ ID NO: 26749 - DNA, 118 bp, Homo sapiens; identical to SEQ ID NO: 5824
  chr1:180881433-180881551
  hyper

SEQ ID NO: 26750 - DNA, 428 bp, Homo sapiens
  chr1:180882004-180882432
  hyper
cgcgggccgggaaggcgcgggcttggccgctcttcccctccacggcaaagccgtgaacggacagctgatgccacttccttccctgccagcgccctccctgcccgaccccgcttcccgtcctctcgccgggagggagtgcggcccgtggggcgctgcgccggccagacccacccggggcccgggggctgccagcagagccgggagctggcccggcctcggcgccgtcccggacccccagtcggccgcgccccgaggggcgaggcctgcgggccgcactccctccggccccggattcggggctggaagtccctccccgaacccagcagctggcctgggagggagaaggggctggagagggcctggcctctccgagggatggaggggacagaggcggcggcggccaaacccgcgggcggcagcccccagtg

SEQ ID NO: 26751 - DNA, 30 bp, Homo sapiens
  chr1:181286935-181286965
  hyper
tggtgggcatgtatgcgagttctctttctg

SEQ ID NO: 26752 - DNA, 871 bp, Homo sapiens
  chr1:181287331-181288202
  hyper
tgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctcgagccgctgggttttcgcaagccttggggcctctggccgcccttccatgcctccgggcgcgggcggctcagcaggtccccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtaggggaggaaagagcacagaggaagccaggctgcatagggtgacttgctttttgatccggcttgagtctccttgtgcgagagtggttgtgcgtcctttcccagggatggaacatccagttttctgtgcttttttgctttgtgcccatgtcttggagagaataatgggagacactaacccaccgacgtctcccttgagatcgcggcttcctccttgcgcagaggactgagg

SEQ ID NO: 26753 - DNA, 1039 bp, Homo sapiens
  chr1:181451320-181452359
  hyper
ggagcctgggaggtgcggaggagcggcgacgcggccatggcgctaggcgcgcaaaggccccgacaccttactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 26754 - DNA, 295 bp, Homo sapiens
  chr1:181452691-181452986
  hyper
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcagg

SEQ ID NO: 26755 - DNA, 60 bp, Homo sapiens
  chr1:181453050-181453110
  hyper
cgtccggcagaactgtttcaccgtcaacagatccctgttcatcttcggagaagataacat

SEQ ID NO: 26756 - DNA, 645 bp, Homo sapiens
  chr1:181454704-181455349
  hyper
attgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctgggccctcctttctcactcggcttctacggttctctaaatcttcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtcttactcctccctttccttgtctttggccaaaaatggaccaaagagagtcaaacgggagactctcgagggagttgattt

SEQ ID NO: 26757 - DNA, 163 bp, Homo sapiens
  chr1:182584177-182584340
  hyper
cgcggctcgccgccccgggctctgtggcaccatcagcagcttgcgcaggacacagacgtcggctcacgcgccgcagccctcggccccggaagagccgcggccgcggagcagcgaacgcgtgcctgccagggaaaagcagtcaccaggaacgcggcgttttggt

SEQ ID NO: 26758 - DNA, 35 bp, Homo sapiens
  chr1:182584403-182584438
  hyper
cggcctgcggctccggaaggcgaagctcttccagg

SEQ ID NO: 26759 - DNA, 334 bp, Homo sapiens
  chr1:183385985-183386319
  hyper
ctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaagccgcgtggcttcccac

SEQ ID NO: 26760 - DNA, 229 bp, Homo sapiens
  chr1:183386598-183386827
  hyper
cggctccggctcgcgcagggcctcccgcagcctccgcccggccccctccccgtcctaggcagcgggtccctgaggccgaacctaggcggaaaagggccccctccctattcactcagcatccacctcgcgcgggcaatacacggcccacaattcccaaacactggtccctgggccgcccagaatcaccagccaaatccgaaattaatcttgaagccccagcccctgtcac

SEQ ID NO: 26761 - DNA, 677 bp, Homo sapiens
  chr1:183386946-183387623
  hyper
cggcgccccaacctctgcccccatcccggtcttcgccagcctggtagccgaaccaccgcaccgccacactccagttctggtatctcgaacccctgcccagccccaaatgatactcatctctagtcccctcccatcccccacctttggccccctgcgagccgggtctggccccggcaagtgacgcctcggaaacgcagtctgcgtaccctcccctgagtccaaaatgaaggggccgacctccaccagctggatgagccggcccacccctccgaaggggcacacgccttcccgttcgatcgccctggaaaacacaggtgcctgggaaaggagaggagcggaagcggcttccagaggtgggcgggaggactcaccaaacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgtattgctctgctctcttctctcct

SEQ ID NO: 26762 - DNA, 6 bp, Homo sapiens
  chr1:183387662-183387668
  hyper
cgcctg

SEQ ID NO: 26763 - DNA, 331 bp, Homo sapiens
  chr1:183774098-183774429
  hyper
tcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgcgctccctttgtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactga

SEQ ID NO: 26764 - DNA, 1161 bp, Homo sapiens
  chr1:184005477-184006638
  hyper
caagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccagcctggagcaggagcccggcaccggaaagtcagagcagcgcactgcggcgccccagccactgcggagcccctggccaaccgcagttacgttccatctgtcgtatctacatgggaatacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactgg

SEQ ID NO: 26765 - DNA, 34 bp, Homo sapiens
  chr1:184633316-184633350
  hyper
tccccgaagtgagggcgctcgctgcggagctggg

SEQ ID NO: 26766 - DNA, 71 bp, Homo sapiens
  chr1:186649956-186650027
  hyper
ctccaggaatctgagcggccctgaggtccgggggcgcagggaatcccctctcccgccgccgccgccgtgtc

SEQ ID NO: 26767 - DNA, 429 bp, Homo sapiens
  chr1:190444251-190444680
  hyper
aaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacgttaaatatagctcattaaaataaataaatattaacgcaaaaaggtactaagagactccagagatcttaagtctattctctcatacagaagaggtttgctcaagtttggcttaggaaggttggaaatggagcattctggaaggatggaaaccccctggcgcaccccactctatggggctgcaaatgcccacaccaagcacacgttcgctgcaggggctgagtgcagagcctgagctagcaggtcagagtaggggacacctttcctacacgcatgggttattcc

SEQ ID NO: 26768 - DNA, 36 bp, Homo sapiens
  chr1:190445161-190445197
  hyper
gggcgccaagtggtgcggaccacagtctcaaccccc

SEQ ID NO: 26769 - DNA, 456 bp, Homo sapiens
  chr1:190445198-190445654
  hyper
ttccctctcggtgggagtcaagggggaaaagcccttgaatcccgagacggggggatggggcgacgctgcagctggagtacttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtga

SEQ ID NO: 26770 - DNA, 5 bp, Homo sapiens
  chr1:190447285-190447290
  hyper
cgacc

SEQ ID NO: 26771 - DNA, 9 bp, Homo sapiens
  chr1:190447291-190447300
  hyper
gtcacatta

SEQ ID NO: 26772 - DNA, 326 bp, Homo sapiens; identical to SEQ ID NO: 5843
  chr1:190447388-190447714
  hyper

SEQ ID NO: 26773 - DNA, 64 bp, Homo sapiens
  chr1:196577371-196577435
  hyper
cctagcagcaaatctcgaaacctgtacctgggaggcagagggggcacttcgctctccaaatcaa

SEQ ID NO: 26774 - DNA, 587 bp, Homo sapiens
  chr1:196577773-196578360
  hyper
tataaaaagttacttcgccgaaaaagacgcgcggtgcctagaaagaggggagaggggtgggagtgagcgccgcttgatggtgaagcactttccttaaaggcagttgccagatcctcccagagggcagcctcccggctactgttccctcgggcgggcttgcatccggcacagccctgagctggcgggaatcgggggcggtgggtttcggccccagacgcggccaacccggctctccccgcaatctccctgtggagatggagctggaggcccagccaatgagactccccctcattagcatagcacagtgacggcacgggggtgccttggggacaaccaatgggggcgagctaattagcggattgcggggctccagacccttctctgggaggaggggggccagggtgcttggagtgttccactatgccacgagctccctcgctttgattgccttcagtccaggtgggcgggatgaaaaaattgcacgtttctggaaagggaatccccactctcagccccaggaaaatcccatttttttctcacattctgaaagaagggaggtgtttccctgaactcggggaaaaagaagg

SEQ ID NO: 26775 - DNA, 177 bp, Homo sapiens
  chr1:197879484-197879661
  hyper
ttggaagatccttaacgaccacatcctcctagcagaaatttgtattctaaagtgtgagctttggtgcgcgtttcagtgtgcgtgcgcctgcgtgtgtgtgtgtgtgtgtgtgtgtgtatagaatgcatgtcgttaccaaatacctagaacggtattggaccgcaaagaggttaaacc

SEQ ID NO: 26776 - DNA, 1355 bp, Homo sapiens
  chr1:197879716-197881071
  hyper
cgccgtccatccattcgatggcctcgctgatgagcatagaagatgaacccgggaggactgtcccttcctggctgcgaaacctgaccgatataggggagattctagaagaaagagctaaggaggccagggcggaaagaggaaagtcaggtgtaggggagattaaaaggtaaactggtgggactgaccgggctggtgggactagttagcgaagccaagtgtttgggtagaaacagagatcttgtaggaggtgctccgagctacatttcgggatttgggatgaaaagagaaagccagggggttcgccgctcctggtttgttccttaccgaccctaaactgtatggcggagcttgtgggtcaggcgtggaggcggcatccactcccacgtgccccacatgcagcagcaatcccacgcggttttcgcaagcggctgggaggcaagcgggcgtccccccacaccccccccccactgcgccctggacccacgccacgcaccgccaaggagtagctatggtggcacgtggaggaggggcgggtaggcagggcggcaccatcaccgggaccagcatcttggaacggtcaatctcactgctcatactctcctccctaccggcgcgggagccttgctgtaatcccctgccaccccatctccgactgtgaggggcgcaccgggtgggggaatgggtaaataactggcccaaggcccagcttccaggtcctccctccactttcccgcggcctgactgcgccccgggcaacacagccccttgggaacctgcgaccaggtaatgtggcctccgccccgtcccgggtctggctgcatcccctctaacccctgcctgcccgggtccaagtgagggttttctcccggaaggttaatcaccacccccatcccctagccgggtcccgggaggaagagatgccccggctctctcgttgacccggcctcgaacgccgacctcgagcgcagaatactcccgagtgctgggttcctgatacccagcccgggagcgaggggagtgaaggagggaccgggacaggaaggcggggacgcggtgggtgaacaatcaatggcttagcctagtttccccgcaggagctaccgcccattcaccgtctatgcaagcaccagctggcggcagcatcttttaggtacaagctgcagggaggcaaaagctggctggggggccgggagcccagggcacgccgcgggactccagtccccctgctgcgccccagcctcaagacgctctgggctttatgaggttcagttaccgccgagtcctccattaacacctcctctgattattgagaggctggaagggctgaacgcaacctcagagcgtttctctgggcac

SEQ ID NO: 26777 - DNA, 192 bp, Homo sapiens
  chr1:197881412-197881604
  hyper
tctgccctcggagtgcgcccggacgcccgggagtttcagggacttcttgggagcctaccggaggaaggcccggctttgctccaagccgcgtccctacctgaggtctccacgggaggagcggtttggacgcgccccaccggatgggaggaggtgcttggggaagccgggccgtaccgccggtctgactcccgg

SEQ ID NO: 26778 - DNA, 68 bp, Homo sapiens; identical to SEQ ID NO: 5849
  chr1:197882140-197882208
  hyper

SEQ ID NO: 26779 - DNA, 30 bp, Homo sapiens
  chr1:197882427-197882457
  hyper
ttggccgggaagtaccgcccagcgaaaggc

SEQ ID NO: 26780 - DNA, 60 bp, Homo sapiens; identical to SEQ ID NO: 5850
  chr1:197885234-197885294
  hyper

SEQ ID NO: 26781 - DNA, 216 bp, Homo sapiens
  chr1:197886851-197887067
  hyper
ctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggag

SEQ ID NO: 26782 - DNA, 311 bp, Homo sapiens; identical to SEQ ID NO: 110
  chr1:197887146-197887457
  hyper

SEQ ID NO: 26783 - DNA, 416 bp, Homo sapiens; identical to SEQ ID NO: 111
  chr1:197887706-197888122
  hyper

SEQ ID NO: 26784 - DNA, 60 bp, Homo sapiens
  chr1:197888180-197888240
  hyper
cgtggggaagatcaacccatttctgctagtcgtgagggaaatgtccggaggttaactcct

SEQ ID NO: 26785 - DNA, 949 bp, Homo sapiens
  chr1:197888681-197889630
  hyper
aaaataacctgtgctcgttgaaatttccttttcactcccttatcatttccgttgttttattttgtgtgcgtcgaaaaccacaatttttagcttgtaattatttgaattcggaaacgatcaccaaactgtagtcaatattttcctagtcctttttaagcgaggctccggatggctgggatgtctttaggttagtagtcccgggaggacgcgaacgccggttcaggcagacacggaagaaagcaagcgggccgcaaagagagaaatcacaaatgtttcccctgacttttgcctttgtgcagtggaccctggcccctgccgctctccctgcacaccctgggcttggtctgcctgggggagaaccccgcgtcgtgcggctacaccgcgcgccctcctcagccttgcggtgtgctttctttgcagggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattggg

SEQ ID NO: 26786 - DNA, 71 bp, Homo sapiens
  chr1:197890716-197890787
  hyper
accgtgcagaaagggcggccccggaagcggaagagcccagcgctgggagtggacatcgtcaattacaactc

SEQ ID NO: 26787 - DNA, 240 bp, Homo sapiens
  chr1:199998199-199998439
  hyper
agcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgcccgcgcgggcggtcttgggctcctgctgcgcgcagccccagctggccgctgccaaaataga

SEQ ID NO: 26788 - DNA, 30 bp, Homo sapiens; identical to SEQ ID NO: 5860
  chr1:199998758-199998788
  hyper

SEQ ID NO: 26789 - DNA, 50 bp, Homo sapiens
  chr1:200008515-200008565
  hyper
cctcgccaccgccgccgcctgcgcccttgcggagccgaaccagagggccg

SEQ ID NO: 26790 - DNA, 401 bp, Homo sapiens
  chr1:200009750-200010151
  hyper
gctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggtctccccaagcctctaggtagggctgtgagagtcccctagagctgaagccccggaggctgacctgtgggtctggctgctatgggaacccggttggtccaaaga

SEQ ID NO: 26791 - DNA, 361 bp, Homo sapiens; identical to SEQ ID NO: 1862
  chr1:200011323-200011684
  hyper

SEQ ID NO: 26792 - DNA, 419 bp, Homo sapiens
  chr1:200011685-200012104
  hyper
ccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgaggtgtttatatt

SEQ ID NO: 26793 - DNA, 266 bp, Homo sapiens
  chr1:201252527-201252793
  hyper
agtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctc

SEQ ID NO: 26794 - DNA, 42 bp, Homo sapiens
  chr1:201437622-201437664
  hyper
tctgggcgttccagccgggatcttccagggggcagcggaagt

SEQ ID NO: 26795 - DNA, 105 bp, Homo sapiens; identical to SEQ ID NO: 5866
  chr1:201437682-201437787
  hyper

SEQ ID NO: 26796 - DNA, 73 bp, Homo sapiens
  chr1:201438552-201438625
  hyper
tgaagggggagatggcggggaagggagggggaaggcgcatctcctcgattggagagcgcgctgctagcaaggg

SEQ ID NO: 26797 - DNA, 218 bp, Homo sapiens
  chr1:202183428-202183646
  hyper
gcaggacccagaaaccgacgcgacgggtggggcgctacccgggccggccctaatccccttccattgttctgggagccgaggccgcctccccacttccggaccctttcagccatggagcgggcggcgcgggcaggggcgggcaggggcacggccaggcgggctggggtgggcaggggcgcgcgcgcgaggctggtccccgcccccggggccgccgctta

SEQ ID NO: 26798 - DNA, 234 bp, Homo sapiens
  chr1:202611761-202611995
  hyper
catctcaaccctggacggctgcggcaaggcgggggcgctcagaaaggcagccagtcctgcaaaccgcccgtgcctccggcacacccccctctgcgccaggggctccccagtgtcgcgcgagcatggtcttccagctcctcctcagcgaggcaggcgctgcagggtcccatgcgccccgcacccacttctctccgcacgcccacttcatgcacctccccgcgcccttcccacggc

SEQ ID NO: 26799 - DNA, 127 bp, Homo sapiens
  chr1:202613418-202613545
  hyper
agaagggctctgccacggacccgacacctcccacctccacaactctgctttctcccacttgggaaaagcgaggctgacacccacggtgagcaccaggaggggcagggaggaccgagagcctgggcag

SEQ ID NO: 26800 - DNA, 133 bp, Homo sapiens
  chr1:202678970-202679103
  hyper
accttccttggagaccgctagggctggcgggggctgggctagacgcgagtgggttcgtcccagggaaaggagagagggacgggggcgcagagccggccggtgcaggggacgcgtggcccgcccctctctgcag

SEQ ID NO: 26801 - DNA, 369 bp, Homo sapiens
  chr1:202679339-202679708
  hyper
ttggagagggaggtccgtgcccccaccggcgggggtatggacttaccggagagcgacccgaaggaggcgggagagatccggggtctccaatgtgagggggcgtcggacggcaaggacgcgtggctggcgacggtttcgcaggggcgcccgttcccctgggggcgcgaagtccccgctccaccgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 26802 - DNA, 23 bp, Homo sapiens
  chr1:202936931-202936954
  hyper
atcgcgcccggccccaagatctt

SEQ ID NO: 26803 - DNA, 136 bp, Homo sapiens; identical to SEQ ID NO: 5870
  chr1:202996095-202996231
  hyper

SEQ ID NO: 26804 - DNA, 15 bp, Homo sapiens
  chr1:202996304-202996319
  hyper
cggtggggtggaagg

SEQ ID NO: 26805 - DNA, 179 bp, Homo sapiens
  chr1:203087019-203087198
  hyper
gaacccagcacctagcgcggcggagcagggaactcaggctgcgggactggggtctggccctgcccagctcctcgcccacgcccaggcttccgttaggccagcagggggaccccgagccccggacaacagccctgagctgggcggctgcttctggctctagatcccgctgctcagccgat

SEQ ID NO: 26806 - DNA, 135 bp, Homo sapiens
  chr1:203096868-203097003
  hyper
cgggggcgacagagccgcaggcgcccgagtcgagtcccagccagctaccatccctctggagcttaccggccggccttggcttccccaggaatccctggagctagcggctgctgaaggcgtcgaggtgtgggggca

SEQ ID NO: 26807 - DNA, 161 bp, Homo sapiens
  chr1:203097280-203097441
  hyper
ccttgtcctgggctccgtccccagacccacgtctgccaccccagtcccaggtgcgaaacaggggcgctacctctttaaaagcgtccggggctgagtctctgccgtaccatgtgattgcttgaaaggccgggctgggagcgctgcggcgggagccggaggac

SEQ ID NO: 26808 - DNA, 130 bp, Homo sapiens
  chr1:204653466-204653596
  hyper
aacagatgggagctgcggcagcctgaggaacagagcacaaagcccagctgacattttccttcctgttcgtttgggtgggggaggaagggtagggagcacagtgctacccccggggcccctccccaggttc

SEQ ID NO: 26809 - DNA, 227 bp, Homo sapiens; identical to SEQ ID NO: 1864
  chr1:204653792-204654019
  hyper

SEQ ID NO: 26810 - DNA, 83 bp, Homo sapiens
  chr1:204654686-204654769
  hyper
gccctgggcgcgtcgcggccggaggctggcgggcgagagccaggcgctccttgagagcgccgcgcgttcgcaggtgcccggag

SEQ ID NO: 26811 - DNA, 145 bp, Homo sapiens
  chr1:204797791-204797936
  hyper
gtctctgccctaatgcggcggctggcggcgagaggcgctgcaggggacgcgggggaagtggcggcgccggcagcggacagctcggacagcgcccagggccggagcccgagcccttggaggtaggcgagcgcgaacaccggagaga

SEQ ID NO: 26812 - DNA, 129 bp, Homo sapiens
  chr1:204798148-204798277
  hyper
ttctatctcgttggccgcgtcccctcccccttcccgcatcctcaaccctttccctttcctctctgtccccgcctcatccgtgagccctgcctgcccttgtacttctgtttacctcgacaccccactttg

SEQ ID NO: 26813 - DNA, 405 bp, Homo sapiens
  chr1:205312507-205312912
  hyper
ggtgacggccacccccgcccgggctgtgggcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtcca

SEQ ID NO: 26814 - DNA, 45 bp, Homo sapiens
  chr1:205312961-205313006
  hyper
cgcgccctccggcgggcagcggatgggctccgcagcccctggtca

SEQ ID NO: 26815 - DNA, 453 bp, Homo sapiens
  chr1:205399652-205400105
  hyper
tcctggaatgggatgcgtggttcccatgagacaggagaaagccgcccatcaccgtggagaaccaggaatggcagaccacgcggacgccaacagtttacgcagctccccagctaggtgcaaagtggccaaaggaagagccggtcttccacacgcacacctccgcgcccacactgccccaggagcttcccactcagccgggggacccccaagcagccggcgaggcgcactgcgcacgcgcactcaggccgcggctccagccgccctccctccgcagtggggcgccccgcccccgcgccgctcagttttaaactcgcagcagacggaactcgacttaaaaataactattttgacagttcagatgtaaatatgtgagtgacgcgtggggctgtttttccttcacacttcccctcacccctcgctccctaccccagctcaattcggctgaggctgaga

SEQ ID NO: 26816 - DNA, 367 bp, Homo sapiens
  chr1:205424654-205425021
  hyper
ggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggcactttctgcct

SEQ ID NO: 26817 - DNA, 535 bp, Homo sapiens
  chr1:205425423-205425958
  hyper
ccctccatggccccacgagccacctccacagcctcgcgccttcccggggtcgcaacgcctatcacaagcttctacccgggtttcagggggcccctgtagtggcgtgggcgccgcgccggtgccgggagaccccctcgtgcgccctctgcggtcggggcagaccctcagccggagcttcttcctcccccacccctgcaggccgggcccaagctgcgacacccccagcacgggctcagcctgtgaacaaactccgagctcagtactcggaggaactggcgagagcgggacggctacctgcccgcacgcccgatttccgggcacagctagaaagaccgggacgcgattcaactcccaatccggtgaatccgcctagcgccttcgggtcctgccgcccccggccagtcccgacccgcacacatatgcaggcatttgcacacacgcgcgcacacacatgcacgcacatgcacacacacatatgcacaccctcgcgcacacagacactcccgcgcgcgctcacgcccgcacacactcaggg

SEQ ID NO: 26818 - DNA, 493 bp, Homo sapiens
  chr1:207627640-207628133
  hyper
cactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcggtgagctgggagggggagcacggaggtggggacgcgtcccgggcagggaaagtttctgtgccgcgatgcaaagcagggggccaaaagcgagacggtgggggcagtgctcgacgcgtgtccgcctcccgctagctttgagggaccactgcaataaaccgcctggtcctgattgtccccactggcccctccgggagctgggacctccagaattggaggctgcgccacagaggggcgctgtctggtcggcccggtgtggctggcggcgtgcgggtgctcgcggtctcctgccgggctccccgcccccaggattct

SEQ ID NO: 26819 - DNA, 467 bp, Homo sapiens
  chr1:207669321-207669788
  hyper
cgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccc

SEQ ID NO: 26820 - DNA, 232 bp, Homo sapiens; identical to SEQ ID NO: 116
  chr1:207669828-207670060
  hyper

SEQ ID NO: 26821 - DNA, 15 bp, Homo sapiens
  chr1:208083989-208084004
  hyper
tcctccccagtctcc

SEQ ID NO: 26822 - DNA, 652 bp, Homo sapiens
  chr1:208084031-208084683
  hyper
cgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccctgcgcgcgcgcccctgcggaccagcatccttcccgcgcggctcctagagagacgcaccgagtggaagacactactcggcttggccaggacgcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 26823 - DNA, 64 bp, Homo sapiens
  chr1:209381523-209381587
  hyper
ccattgccctcagcccgcagttcacggccagccccagtgagcgcccttgcggaggagctgtggc

SEQ ID NO: 26824 - DNA, 139 bp, Homo sapiens
  chr1:210111283-210111422
  hyper
cgtggctctccgggccgggcacctgtttcgaatcgaggcgcgaggcgcggtggggcggtggggtggggtggggtaggttggggtgggggcggggtggcgtcacgtgccagcggcggccccgggaaggttccatttcttc

SEQ ID NO: 26825 - DNA, 127 bp, Homo sapiens
  chr1:210111796-210111923
  hyper
cgctgggacgccgggcccgactggctcgctcgccccggccttcgtggttttgccggcctcccggcggccgcacgcggggcaaagcgggctggcgggcaggtacagcgtccgggccgccgcctcctgc

SEQ ID NO: 26826 - DNA, 31 bp, Homo sapiens; identical to SEQ ID NO: 5883
  chr1:210112036-210112067
  hyper

SEQ ID NO: 26827 - DNA, 30 bp, Homo sapiens
  chr1:210405727-210405757
  hyper
aaagacaagatatctcggaaggttccagag

SEQ ID NO: 26828 - DNA, 48 bp, Homo sapiens
  chr1:211306737-211306785
  hyper
cccattctgaggcagcggggacctggagttgcccgtctctactgctgg

SEQ ID NO: 26829 - DNA, 267 bp, Homo sapiens
  chr1:211307126-211307393
  hyper
gctggctccgagcggcgagaggttctgcaataaaggcacggataaaacgcccgggtaatcgaaatccgaatgcacctcttaccattggaccgccgaacaatattctccagaaacgtgttttgaggggccactagtcccctcctgcccccagccatggtcatcctcccagcagctcggggtccggcgggcgtcctggcgcggcttcttacgacagcaggaaactggcctcggggcccgcacgcagtcccggctcgaagcgccccatgc

SEQ ID NO: 26830 - DNA, 86 bp, Homo sapiens
  chr1:212874013-212874099
  hyper
ttggggatctggacccgccatgccacggttaaacggcccagatcatttttctttttcaagatttatctgctcgtgccaagctgggg

SEQ ID NO: 26831 - DNA, 1034 bp, Homo sapiens
  chr1:213123589-213124623
  hyper
cgcggggtcacttctcgggtggttttgtttctcctctgcttccacagttgcaaaccctcgaagtgccacgacccctggggaaactcgatcttaagtcccatggccaaacgctccagcccgcggggctctcaggacaccacagcgatcggatttcgcgtggccgccaggctccccctactcctgtcccctcccgccagagaacccctggagccaatcagagcgtcgcggagcccggggttgtagagtcccgagcccgggacccgcccctctttgttgcggtggccaatagacgcattcggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggtaggatcttggagctgccgcgcgcccttcctgcgcgccgcccgcctgcagccagtccctcccggtgataggcgctggaactcggggaaaagggggcggatggagctctttccactagatccccgccggggtccgggagggcttcctggaagaaagcgggccgccttgcaagccaaggctgctgcagcgccctcgcgccagctctgggcgctcacatgccagcacgttcgtggctcccctcctctcttggccacatctgaggacccaggaatgtgtggagccttgcgggaacctcctgttccttcatgctacacaagctgtctttcttctccccacatcttgcgctccgcatcccccaagctccttgtgcccctccatccccaaccccccgggtttaggtgtgtgtgaagcttcgtggcacattttgagctgcctttctaggtaatcgcagggctggaagcccgtcatcgattctcagggaggctgtcagcgtgcaggggggagcggggagtgtcgtggagacactccgggacccctcact

SEQ ID NO: 26832 - DNA, 365 bp, Homo sapiens
  chr1:213124668-213125033
  hyper
cgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttcca

SEQ ID NO: 26833 - DNA, 30 bp, Homo sapiens
  chr1:214155741-214155771
  hyper
cttctcttttcgctgcgtcaggcaggcacc

SEQ ID NO: 26834 - DNA, 98 bp, Homo sapiens
  chr1:214155985-214156083
  hyper
ttccatcccttcaaacgtgcacgcccctcccgcggtcccgggagggagtcccccctcccaggtcgagcgcgtccaccggctgtccccacagcaacagg

SEQ ID NO: 26835 - DNA, 60 bp, Homo sapiens
  chr1:214156134-214156194
  hyper
cgaaatcccccggccaccacgacgttccccggctctgcggcgcgccgggagcaggtggtt

SEQ ID NO: 26836 - DNA, 241 bp, Homo sapiens
  chr1:214156417-214156658
  hyper
ggccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacac

SEQ ID NO: 26837 - DNA, 57 bp, Homo sapiens
  chr1:214156893-214156950
  hyper
actccccttgagttgcggcccgagactgcctttgtacttaagcgacagcaaaagata

SEQ ID NO: 26838 - DNA, 109 bp, Homo sapiens
  chr1:214158802-214158911
  hyper
atctcgctcgcctagcgtggcgcgcgctcctatttcaagtcgccgctcctgcgccctaatgcgggctgcgaaccgccgcggcagagcgtcgcgagccgggagcctctgc

SEQ ID NO: 26839 - DNA, 110 bp, Homo sapiens
  chr1:214159571-214159681
  hyper
tgcttccgtgatagacgcgtggggggagtgtgtgggggcggcaaaaggggaaagaagaaggctggggatgctcccgcaatctcttttcttatcgccgacacctaacctga

SEQ ID NO: 26840 - DNA, 186 bp, Homo sapiens
  chr1:214160132-214160318
  hyper
gcccggtgaaagggacgttctagctgcggctgaggctcgcttgcatttgtaacttgcaaagcccaaggagatctttaagagccacattatctaaagaaattttgctggttatttttcaagcaagaaatgtcaaaccaaagtaaattttctagggctttattttagagcctgcgatttatgcgtttg

SEQ ID NO: 26841 - DNA, 353 bp, Homo sapiens
  chr1:214162457-214162810
  hyper
accccagcagaggaccgggaactgggaggaggagagagggaggtgggggggcgctctgttactttcgtctcaaaacgctgtcgaagccgaattgtggaaatccggcttggaggggagcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcgggccgggtaagagtagggggttcttgggcagcagaaatgggaggcgatgaatctcccagccatcgctggcagactatg

SEQ ID NO: 26842 - DNA, 245 bp, Homo sapiens
  chr1:214360508-214360753
  hyper
aacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagtggggagctggtgcccgctcgccgcggtcgcctcgcgggtcacagacaagagagcggcttgttttctctctgtcacatc

SEQ ID NO: 26843 - DNA, 105 bp, Homo sapiens; identical to SEQ ID NO: 5895
  chr1:214360754-214360859
  hyper

SEQ ID NO: 26844 - DNA, 114 bp, Homo sapiens
  chr1:214360926-214361040
  hyper
cgcgctctgctcagctctacccggctccgctctcaggcgtgtgctcagaacacaccgagatcctttagaaataaatgtaatcgagactaatctggaaatcgtccctgcagccaa

SEQ ID NO: 26845 - DNA, 128 bp, Homo sapiens
  chr1:214387629-214387757
  hyper
tctccttcctcaaagcgagctccagagtagaaactgcaattgtgtatttgaaattctccagtcaccaaatccaagaaaggtgaagaggaactgccccagtggcgtctgcgaggcgtttcctctataaa

SEQ ID NO: 26846 - DNA, 126 bp, Homo sapiens
  chr1:214725407-214725533
  hyper
gtggagagagcaaggcgaccgcagccaccccaaccctgggctgctcccgccgttggggagaaagaggcaaggcaaggaagagcccacctagacttccgaggaccgcagagacggggcggcggcagg

SEQ ID NO: 26847 - DNA, 934 bp, Homo sapiens
  chr1:215255060-215255994
  hyper
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtag

SEQ ID NO: 26848 - DNA, 606 bp, Homo sapiens
  chr1:215256219-215256825
  hyper
cgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgc

SEQ ID NO: 26849 - DNA, 100 bp, Homo sapiens
  chr1:216896454-216896554
  hyper
acacaaacaagcagtcgtgcacacaaaatacccagggcattacctgaatcagtgtgtaaagatatagtctgtccgcccccacccccgcacccccacgacg

SEQ ID NO: 26850 - DNA, 87 bp, Homo sapiens; identical to SEQ ID NO: 5901
  chr1:216896887-216896974
  hyper

SEQ ID NO: 26851 - DNA, 145 bp, Homo sapiens
  chr1:217262983-217263128
  hyper
ctttaactgggctcccgcgacctcggcaggcgagggggtgctggccggccctccggtggcaagggcacggccccccgctctgcccccgcgggcgcggggccggcctggcacccggggtccgcgtcccgagcggctgtgcactcac

SEQ ID NO: 26852 - DNA, 1211 bp, Homo sapiens
  chr1:217307486-217308697
  hyper
agggaactggggatgcgagctgggaacagaccgcgctccagcccccatggtttgtgacggggaacttcgggcgcacacaccctggggagtaggtctcctccaaatggcaccgacacagactggcgctggatcttctctccctgctaatctatccgcaaagaccgcctgggcacttttgggggaatgtggccaaaaggggactctaactgcgacatctacagaggaaggagaaactggtggtgcctaagaagttgatctcgatgcgcgcagtgagggcacagggccctgcgcgccagagaagcgaagccagcggtctccacttacttgttcttaattcctccctacccccgctctggcctctcattttcggcctcatggatccaagacccgaggttattttcagtcacaactttctccacaccccgtacccccaaaagtgtacctcagctcaggcgggaaagggcactttgacccgccgtgcgcgagtttccagccagccgctgcgcgcctgagagaaagagcgcctggctgcggctccgagcgcacagctcttccccgcgtgtttggcgcggctacgtttctcttgctccgggctgaggctcgaggaacctcgccagcctgctgtggtcccgtccccttgacgtttgatttctaaaaccgcatagtctgcggctctggcatttagaaaaagaggacaaggtcaaggcctgtggaccgaccgccgcgatccgcttgcacctttgctctcacagcaagcgagtcctggccgcagccgctggaaaaaggtgccgcagcgcccagtttacctggaattcagggacctgaccctgactctatttccggctagtcccagcctctccttcctctcctttccccgctttccgcccagggcggttctgagattttgattaagagagatctgtccccgcaccgcagagggatggtgccaaatggccaggcttcctgggcactgcgtcctcattcccaggtcagagctactgcgaaaggaaaggtctccatctggacgcacctcgtcccctcccccagcgcgcggggcagccctctagggccagctcgggcacgcgcttttccccctcctcaccccctgctccgcccagccccgtacagttttattctttatgaaacacacacgcccaccccgcctcccacgtaaaggccagtcttgactcattttgcgcccagatgcaaac

SEQ ID NO: 26853 - DNA, 358 bp, Homo sapiens
  chr1:217308948-217309306
  hyper
cgaagcggggtcaggcgcggacccacattcaccgactgcagaactgttttctttgccactaccagagggtgtttcggggctccccacggtcttctccctggctgcttgccgcgtgagagcagaaataaaacaaaacaaatcacgggacacgacggagtcgggccgctgggcgcctccgggatcgctctcactttgcactcggaagcgggcgcggggattcgggctgccgcgtgtagcctataaatagcaaactttttgaccgaagcaactaacaaataagaggagcaggcgtgcattttgctcaagatccccccttttctggggacgaccttactcccacccccgccccctttgcagt

SEQ ID NO: 26854 - DNA, 30 bp, Homo sapiens
  chr1:217309653-217309683
  hyper
ttttagatggaagtgcgaaaggtgagtgcg

SEQ ID NO: 26855 - DNA, 39 bp, Homo sapiens
  chr1:217310204-217310243
  hyper
ccagggtcaataggacgatcagcacggatgggtgtgggg

SEQ ID NO: 26856 - DNA, 757 bp, Homo sapiens
  chr1:217310871-217311628
  hyper
gggcctgggaggctgcggtaccgcctgtcggtcccggtcccgagcgcgcttgcttaagagttctcaaagacggggttggaagcagtacagacgtccccggttatcgctgccgggcttgtgcgccccacgccacctacctgtccggccttcccgctccaattgctgacccgtttagggagcccggcctggagcccgccgcctccagaggagcccgccctcgccctcccccgcgcgcctccgctctctgggacgcctggccaaatgcggggcggtctctcgcgggccattggcttgggccaccgttccgagtcagctcctaggatttccccaggctttgcggcccctttgtgggtctaggccagcgcctcaccttgcaccctattccacctccagtccccttaggtgcccccgcatccctcctccagagtccaggctttgaaactgcagcaactccgcaaagaaagcctttgggaaaacctcctagagggccgaatgtggaggtcgggtgggtgggtgggtgggtactcgcggcatttctcaaggttctgggtgttcgtaactaggggaacaggccctatgggggcagaaatgacagacgcacgaacagcgtctctgtggctgtctgcagcgcgaggttcacgtctattgttttatgcctccgggagagctaccccgcgtgatagatcttttcagatccatcactggaagaaaaaccctggtgataacgattatctcccgctcgcgctatctcgccatc

SEQ ID NO: 26857 - DNA, 66 bp, Homo sapiens; identical to SEQ ID NO: 5907
  chr1:217311944-217312010
  hyper

SEQ ID NO: 26858 - DNA, 18 bp, Homo sapiens
  chr1:217313025-217313043
  hyper
cccctctgcaattgccgg

SEQ ID NO: 26859 - DNA, 679 bp, Homo sapiens; identical to SEQ ID NO: 5909
  chr1:217313068-217313747
  hyper

SEQ ID NO: 26860 - DNA, 30 bp, Homo sapiens; identical to SEQ ID NO: 5910
  chr1:218337322-218337352
  hyper

SEQ ID NO: 26861 - DNA, 547 bp, Homo sapiens
  chr1:218337623-218338170
  hyper
cagctgattaagaagcggggggagtgactttctctgggctcttacggatcaatcaccgctaaggggatgcaggttgaggggaaggaagaaagtaaatcgcggggcagtttgactaagtgaaacccaattccttcgccccaaagctgtggtggccagacgtgcgcgaccctctagacccaaaacagttttagtcagcaacgggtcatcagcaggaccgagaagactgggtgggaggtctggccggtccgaaatagggaagaggtgcgggctcatcaccgaggcggtagggctcggcttatggtctagagccttgaggcgctcccgcgtgagccccgctgcttccagtccgccctcgcctggcccggcgcgggtcgctccctcctccccgtcctgttccgcactttacccagcaggggtcccaggtcgagcagggccaaccctgctcgcgcagcgccggacccctccccgctgcccggggtgcggcggcttccctccgcccaaacggggggtgtctcctccatcacccctgccgcggcttcccagtcgg

SEQ ID NO: 26862 - DNA, 278 bp, Homo sapiens
  chr1:218338508-218338786
  hyper
gctagagagggaggccggcgaaacaaaagccgtagaggaaaattaagcgacttccccctcggcggggaacttggaggtgggggagcggggagcggcgcggggcgcaaggagaaggaagtgctgagctgggttgccgacgaaccccgggcagggggaggtggggggctgcggcagaagaaagacaaacatctggggatcggaccatatgccggagctttgtcttgtccttcaaagttcggctgcccttgaagtgatttgtcaggcggcccacgggtgac

SEQ ID NO: 26863 - DNA, 156 bp, Homo sapiens
  chr1:218339178-218339334
  hyper
tctttctcttttgcccgccaaccgctgaactgattagactgtaattaaggccataaagccctcagattatacacctgtttattcactgaagtcggggtctcatcaagcaaattagctgcttgcaggctacacattgggcctcgagcttgcctgatt

SEQ ID NO: 26864 - DNA, 184 bp, Homo sapiens
  chr1:218520108-218520292
  hyper
tacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagc

SEQ ID NO: 26865 - DNA, 173 bp, Homo sapiens
  chr1:218520309-218520482
  hyper
cgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcccgggatcgcccttccctctcg

SEQ ID NO: 26866 - DNA, 45 bp, Homo sapiens
  chr1:219347215-219347260
  hyper
tggcagtggcatcagcgatggcggctgcgtcggggtcggttctgc

SEQ ID NO: 26867 - DNA, 162 bp, Homo sapiens
  chr1:220101049-220101211
  hyper
agaagaaaaagagggcgtggggtgagaagaaagggaccgggtgggaggaggaaggaagggccaagcggtccaaaggatgcaaccgaaaggcacctgctacgtttgcgaacacggtcgcccccttctcccgcttcctttccaccgaggtcccccggagggtta

SEQ ID NO: 26868 - DNA, 243 bp, Homo sapiens
  chr1:220101370-220101613
  hyper
cgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccgg

SEQ ID NO: 26869 - DNA, 30 bp, Homo sapiens
  chr1:220101929-220101959
  hyper
taacgcgaggccgagcgccaccagtccccg

SEQ ID NO: 26870 - DNA, 118 bp, Homo sapiens
  chr1:220700814-220700932
  hyper
gagggtgctgcagggcgcccagagcgagacgtcttccgccggccccattcccgaagaggccgcgccgtcgggggctgagacccacttgtactgagtctccagccgcctccctaggctg

SEQ ID NO: 26871 - DNA, 303 bp, Homo sapiens
  chr1:220702162-220702465
  hyper
aaatgtcggcccggacgccattgccgacggtgaacgagcgggacacggaaaatgtgagtaaccggagcctccctcgggagcagtgggggcgagaccctcctctgatccccacttcacccgcgcttgggccgtcccccgtgcctcggcgcggccacccgcggcagggtctccacctggagcccggcgtgaccctcacccactgctcagccctattcttcattccaaccccatttcgcttgtttcccctcaagggtgagggtagggaaccgtaagtggcgccctctcgctcggaggtggtcctcc

SEQ ID NO: 26872 - DNA, 90 bp, Homo sapiens
  chr1:220864103-220864193
  hyper
cgggggagcgggagccgggtccttaccatcgactcacccagtttctccgggctgcacctgcgacccctccgcccccgctcccattccctc

SEQ ID NO: 26873 - DNA, 436 bp, Homo sapiens
  chr1:220921624-220922060
  hyper
cgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatct

SEQ ID NO: 26874 - DNA, 243 bp, Homo sapiens
  chr1:220960315-220960558
  hyper
gcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcggga

SEQ ID NO: 26875 - DNA, 1203 bp, Homo sapiens
  chr1:221052007-221053210
  hyper
tagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagc

SEQ ID NO: 26876 - DNA, 496 bp, Homo sapiens
  chr1:221053255-221053751
  hyper
cgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgca

SEQ ID NO: 26877 - DNA, 351 bp, Homo sapiens
  chr1:221067466-221067817
  hyper
ccgcaggctgctccccgagtcccaacgctactagggtgctgtaacagtgatgaggcggcgttgcagtctggctaggcgctgcagcgggcaccagctacgttttgctgtcggcggcagttacccggacgcaagttaaggggtaggcgcgcagaggcggttggaggcgggcggccggcccctgacctcggagagctgcgccgagcagggcggaaaatttatggtctgtgtacactttctggctccagagccccgcgcaccagaaggatggggccctgcgagcgcgccccaggccgcgagctggggccgcaggcgccacggccatgtatagtgcccacccgactctgttctgca

SEQ ID NO: 26878 - DNA, 211 bp, Homo sapiens
  chr1:221914261-221914472
  hyper
tgcacatagcaaagacgccaaaccccacgccaagagacgctcacctaaacgaactttaagagctatcaggaaaaatgccatctatcatccgtctacacacgaccgtcaccattctcatccgtctacacacgaccgtcaccattctctgacacagaaccaaagtgtcacaggcggaatccacactcacgcgcgcacacggggcacgcaccca

SEQ ID NO: 26879 - DNA, 141 bp, Homo sapiens
  chr1:223302777-223302918
  hyper
ggaaggccctgctcccgaccgacccggagcgcgctgctgccctctaccggtcatccgtgcggccggacaccgtgtcaggcccgcgaggagggctctgccgcagtcccggggaacagcacccagcagcgccactgggagagg

SEQ ID NO: 26880 - DNA, 280 bp, Homo sapiens
  chr1:223538158-223538438
  hyper
agtctcttaatttcccgcgttaacccctccccgctcccatctccgccgaagctctgcgcgtccccagggagcccgaaggaccatctgaggcggctgagagacactctccccctcccccacacccttggtattttccctctgccagccgcaggtgttgcgagtgaggacccctgtccggtcttggagatgcgcggggccctcggagccttggcctgggaggcgctcccgggggcggggaggcgggggtagcgggtgattggtgacacgcagaaggttgggt

SEQ ID NO: 26881 - DNA, 127 bp, Homo sapiens
  chr1:223936626-223936753
  hyper
gccgctgcgctagtgcgtccggcggtcccgcccggcagtaggacagagggagcgagggagtccgggaggaagggagagcgggtgcggccagtctgacggttgctgtgtttgcagatcaccagcgccg

SEQ ID NO: 26882 - DNA, 215 bp, Homo sapiens
  chr1:223936995-223937210
  hyper
cgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaa

SEQ ID NO: 26883 - DNA, 256 bp, Homo sapiens
  chr1:224528612-224528868
  hyper
ggggctccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctccccgtgccctccccacgaggcctgggagcgggtcctgcccggctgcgcaagggt

SEQ ID NO: 26884 - DNA, 55 bp, Homo sapiens
  chr1:224803348-224803403
  hyper
caacaccaataccaccgagccctcgttgctgcctcttcagcgcagaatagcccac

SEQ ID NO: 26885 - DNA, 486 bp, Homo sapiens
  chr1:224803810-224804296
  hyper
gcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcc

SEQ ID NO: 26886 - DNA, 292 bp, Homo sapiens
  chr1:224804395-224804687
  hyper
cgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgc

SEQ ID NO: 26887 - DNA, 270 bp, Homo sapiens; identical to SEQ ID NO: 121
  chr1:224804846-224805116
  hyper

SEQ ID NO: 26888 - DNA, 555 bp, Homo sapiens; identical to SEQ ID NO: 122
  chr1:224805197-224805752
  hyper

SEQ ID NO: 26889 - DNA, 18 bp, Homo sapiens
  chr1:224805848-224805866
  hyper
cgccggtcctctcaaaga

SEQ ID NO: 26890 - DNA, 395 bp, Homo sapiens
  chr1:225117226-225117621
  hyper
tgtcacatcgggggccgccgcgtacccgcggtggaatctcgcaagagccagggcccctcctcacctgcccggcacccaggatcccttgcgccgcgttcgggaccccacccccattgtggcctcttcgccagggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcgggtaaggtcgtcagcgtcttcctgtcagcggtcggcagagcctcggcgggcgggcggcgcgtggggcagccggtgtcgcactggg

SEQ ID NO: 26891 - DNA, 62 bp, Homo sapiens
  chr1:225632491-225632553
  hyper
caacagataacaaatcgacattgtcgtgcataaatgtagagctgatccgtatttcatgtcaa

SEQ ID NO: 26892 - DNA, 30 bp, Homo sapiens
  chr1:226069474-226069504
  hyper
tcgcctcaccctttccgcccccgcccttcc

SEQ ID NO: 26893 - DNA, 43 bp, Homo sapiens
  chr1:226150283-226150326
  hyper
aatcacggtgctgaccgtgcctctgcagcgctgtcttcaggtg

SEQ ID NO: 26894 - DNA, 207 bp, Homo sapiens
  chr1:226411017-226411224
  hyper
aacggggatttgacccggagaagagagttctgtcgcctgcggcccgcgcacccgggcccctccgggctgcccctcccaggcaaatagtccttcggggatgtggattgcgccgtccgggcgggtgggcggggaagaacacggagggggccgggacccaagttcacgcctccctcctgcatcccgcagccggcggaagcgattattccc

SEQ ID NO: 26895 - DNA, 758 bp, Homo sapiens
  chr1:226411246-226412004
  hyper
cgggctcgcacccggaggagacacgggtctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtgagggcccgctgcgttcgcaagtgcgcgctggagcggaggcgctgcggactctaggtctggactgcgggctcctgaggccacacccgggacgttgcaggcacggtgcttcccctgaggctctgcgtactagactgaaatagggggtgatatcggcacctgctgcatagggtggttgcgaggcctgtgtgaaataatttaggcctgcactgaacgatttctctcatta

SEQ ID NO: 26896 - DNA, 83 bp, Homo sapiens
  chr1:226736126-226736209
  hyper
caggggactcagcctcgaggctttcccgacggtgtcagccaagcacacactcccagttcgcagggcttcgtggtcaaggttcc

SEQ ID NO: 26897 - DNA, 692 bp, Homo sapiens
  chr1:226736861-226737553
  hyper
ggggggagagaagggcgcggccggagacctcctggcggggccgcgcgctccaagtgctgcgaccacgcgccaccgcccgctcctggcgtccccgggcaggtggcagaagcgcgtggagtgtgcaccccagaggggagaggctgcgctggggtctccgacccgcaggcggggccccaaagagccggaaactttgcggccaatgttggagcccgcagcggcggccggaatggctctgccggcttcggagtagggctcccgtcccggcgccccgatttctgctccttctctccgtcgtgtgcatccgtccgcgagcccacttccccgagaggaatggggtcggatcagaatgagctctagggcctcggcggcgaggatcaaactcccgggcgtcgaagtcagctgagccggggaaagaggacgagccgggctagatatacctgcagccccctttggttcgcggagtgcggaccgcgtggggacgagaactctagccagagtctcctccgcctcattcaggggtacctgcacttccgccagcaccccgcagggcgccagggggatgggggatgattttattagtttggatgcatgtggccagagatgaacccatagctccctcggatcccttctgttcctgagaagtagagagtgcgccgatgtaattctgtgcaggactccggcagccggcaggg

SEQ ID NO: 26898 - DNA, 15 bp, Homo sapiens
  chr1:226924815-226924830
  hyper
gccaccacctgctgc

SEQ ID NO: 26899 - DNA, 714 bp, Homo sapiens
  chr1:226924900-226925614
  hyper
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcc

SEQ ID NO: 26900 - DNA, 132 bp, Homo sapiens
  chr1:227505711-227505843
  hyper
aagcggctacttggccgcccgagcccactccatgtcggtggtcgctcgtgggccgagccgcgccgcgccgcgccgggcagagagcccggtctccccgacacccgcaccgggccgccgcgccggaggctcccg

SEQ ID NO: 26901 - DNA, 283 bp, Homo sapiens
  chr1:227729829-227730112
  hyper
cggggccgggccggcgagagaagggtccggggcacccagtgggctcggatctcgagcggtccccgtgacggccccgcgactgcgcgacttcccgctctagagagtttatggaccctgtcccaggagggctccgcagccgccagggaggtaccggagggaccgcggcgctgggagagggtggcgccaggcggccctggagccctgggcgacgcggccgggccggccagagggcggagaagtccaaagcagcagcccggacagccgcttccgcccctgcgccgcc

SEQ ID NO: 26902 - DNA, 273 bp, Homo sapiens
  chr1:227730322-227730595
  hyper
ggtcctggcagaggccgcggcgagggcaggagccggtgcgctggccgctgcacatgcgccgcccggcaccgggaccctgcgggcgcgccccctggtggcagccagcgggaggtggcgtccctgtccccagccaggcggcagcgcgaagctgcctccccgcggggggagcggaagtggcccagctgctcgagtgacttactagttaaaaagctggggttggagctgccacgcggggaagtgtggaggcctgcggggctccgcctagactttctg

SEQ ID NO: 26903 - DNA, 30 bp, Homo sapiens
  chr1:227975163-227975193
  hyper
agaaggtaggggtctcggtgtggccggagc

SEQ ID NO: 26904 - DNA, 89 bp, Homo sapiens
  chr1:228074787-228074876
  hyper
tgagaacattttttccgacgcagcccgcagcgattgtctccctcagaagcagcgctggggacgccctcctgggccgggcagggggcggg

SEQ ID NO: 26905 - DNA, 169 bp, Homo sapiens
  chr1:228134702-228134871
  hyper
tcagcgcgcccaaagcgcagcgagggtccctgtaaaggtcgcaggactgggcatcccagacctcagagagggggagggaagaaggaagggaaagaaaggaagagagagacgcgccgacagcccggcaaagcgctgctgcagagacacgtgagcacgggcaatgacaccg

SEQ ID NO: 26906 - DNA, 3 bp, Homo sapiens
  chr1:228135301-228135304
  hyper
acc

SEQ ID NO: 26907 - DNA, 328 bp, Homo sapiens
  chr1:228135362-228135690
  hyper
cgccaggcaacccggcggccccgccgcgccccggccccagccaccccgggtgcctcggggactccggacgaccccgccccggccccgccgcccccgcccaccagtgcgcgccggccgccgaaggcacctacccgaagtaggcggccgaagggcgcagcgcggcgagcagcagcgtcagcccgaaggccgcggccagccagcgcgccagcggggacccatccagcatcttgccgcgcctcggcggccgaccatcgcgctcccagctccgcgcagggcgcgccgcggccgccgccctcttatagcgcccggagcgcggccagctgggccc

SEQ ID NO: 26908 - DNA, 161 bp, Homo sapiens
  chr1:228194250-228194411
  hyper
ctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggc

SEQ ID NO: 26909 - DNA, 1798 bp, Homo sapiens
  chr1:228194727-228196525
  hyper
agggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatcttt

SEQ ID NO: 26910 - DNA, 109 bp, Homo sapiens
  chr1:228225753-228225862
  hyper
ggtcagcacggcgcccggccgcgcgggccgcccggcggtgtcaggggccgtggccgcggtggggcgcgggccgcattccgctctcaggtggctccggggccttttgtgc

SEQ ID NO: 26911 - DNA, 46 bp, Homo sapiens
  chr1:228248302-228248348
  hyper
ggaactggcctgctgcgccccaggccccgcccgtctctgctctgct

SEQ ID NO: 26912 - DNA, 124 bp, Homo sapiens
  chr1:228248612-228248736
  hyper
agccctgagatgggccggcccccttcctggcccctcatggcgggactggagaaatggtccgctttcctggagccaatggcccggcccctcctgactcatccgcctggcccgggaatgaatgggg

SEQ ID NO: 26913 - DNA, 618 bp, Homo sapiens
  chr1:228463205-228463823
  hyper
agctggaggtgggagcggggcttaaggaagcttcctggtttcctcgcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagagtgagccgcgggcgggaagggcggggcatcgaggaggagtgaggagggaggcggggcattgaggattagtgaggacgtaggcggggtgctgagggg

SEQ ID NO: 26914 - DNA, 45 bp, Homo sapiens
  chr1:228566475-228566520
  hyper
aacctggcccaggtgcgctgagggtcgccccggccacacccttgg

SEQ ID NO: 26915 - DNA, 61 bp, Homo sapiens
  chr1:228566903-228566964
  hyper
agttcttgggcaaagcgtgcaagcgagggcgagaagccgcgggccacgatccgctggagga

SEQ ID NO: 26916 - DNA, 233 bp, Homo sapiens
  chr1:228603691-228603924
  hyper
tgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacc

SEQ ID NO: 26917 - DNA, 486 bp, Homo sapiens
  chr1:228604123-228604609
  hyper
ggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtct

SEQ ID NO: 26918 - DNA, 339 bp, Homo sapiens
  chr1:228633581-228633920
  hyper
tgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatcccc

SEQ ID NO: 26919 - DNA, 29 bp, Homo sapiens
  chr1:228633921-228633950
  hyper
gcttctctgcagctgtacaccctgcactg

SEQ ID NO: 26920 - DNA, 245 bp, Homo sapiens
  chr1:228633983-228634228
  hyper
cgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtc

SEQ ID NO: 26921 - DNA, 276 bp, Homo sapiens
  chr1:228644968-228645244
  hyper
tccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcct

SEQ ID NO: 26922 - DNA, 604 bp, Homo sapiens
  chr1:228645305-228645909
  hyper
cgccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaaggacg

SEQ ID NO: 26923 - DNA, 120 bp, Homo sapiens
  chr1:228646029-228646149
  hyper
tcaatgacatcttcgagcgcatcgccagcgaggcctcccgcctggcacactacaacaagcgctccaccatcacgtcccgcgaagtgcagacggccgttcgcctgctgctgcccggcgagc

SEQ ID NO: 26924 - DNA, 120 bp, Homo sapiens
  chr1:228646209-228646329
  hyper
gaggcgttcctcggcgtcctgaacccaaaggctcttttcagagccacccacacgatcaagaaagggtttcgaacacggtgaagggttatgtaacctaatgtgtctccatgcaccctagcg

SEQ ID NO: 26925 - DNA, 82 bp, Homo sapiens
  chr1:228646859-228646941
  hyper
ccccaaatgtcttttataagcaagtggtgcattcctggatgttgagcgcttgcgcccggttcaggaccgggtccaaatgagg

SEQ ID NO: 26926 - DNA, 100 bp, Homo sapiens
  chr1:228647217-228647317
  hyper
caggatgtttgataccgaatcgaagcacggcgtcaaagcagcgtcctgcgcgggggagccggatgtaataagcgaccccagctgccggtaactttaaccc

SEQ ID NO: 26927 - DNA, 648 bp, Homo sapiens
  chr1:228651254-228651902
  hyper
tttgggggtaaaatacgagaatcccttaattggggaaattttagctgagtgataaggagatctgtgagcctgctgttttgatgtttcaagcaggaaggcgtggcataaagagctgcttaggcgcaacgctgctgaaatggttttggctagaagctcacagtgtctagttgtggctaaggagggaggaaaggggcgggagaagaacggacccaagcgcctccgcccagacggcgcgataaccccctcacctccaaccccggacctcagtgagcacgtcctccagtctcagccgccaggaggcactgggggcggggacgtggcacaagatcttcccggaggtgacccacgctcctcgcgcgcagggcgtaagccacacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaaaagagcctttgggttcggggcgc

SEQ ID NO: 26928 - DNA, 211 bp, Homo sapiens
  chr1:228652242-228652453
  hyper
gccttcttggagccctttttagaagccggagccgcccgcgatggctccggcatggcgaggtgacaagagcgcctagacgaacgcggatgcggggccggcagggctatttgccatctttatattcaaattaaggctccaaatttgtagtgtctgattggacggcctgactccgcggccgccactgggaggaatttctgtaaatagcagagtc

SEQ ID NO: 26929 - DNA, 121 bp, Homo sapiens
  chr1:228652508-228652629
  hyper
cgcgccggagctgaggttgcgcatctttgttcaaagcctttgttttaaacctggagatttttgtgtctgcagcggatctggaggtagctaaagagaaactgaaaaacggttgcaaccccaa

SEQ ID NO: 26930 - DNA, 30 bp, Homo sapiens
  chr1:228871287-228871317
  hyper
ggcgccgccggagcgcggagccacgaccct

SEQ ID NO: 26931 - DNA, 140 bp, Homo sapiens; identical to SEQ ID NO: 131
  chr1:229542813-229542953
  hyper

SEQ ID NO: 26932 - DNA, 312 bp, Homo sapiens
  chr1:229543220-229543532
  hyper
cgagagggagctctggtccccgaggggctgtcccgggagggagcgaggtggggagggggagcaggccctgccccgagcaccccgcggactgagcgtctggcgtgcacggcggaggggttaccgcggggaggtgacaccccagggtggtgagggcacgcagatgaggctggcctgaggggtgcctgctttggggaaagcagtctgtggagggagggaaggagggcgatcgcggccccacgcgggttgtgctgctgaggctccgcgccgcaggaaaggcaccctagccggattcgccctcggacgccccagctg

SEQ ID NO: 26933 - DNA, 257 bp, Homo sapiens
  chr1:229566603-229566860
  hyper
ggggaacaccataggcggagctgagacgccctctgagaaacagctctccagccccagcaccatggtcagcgcccgctgcctgaggggacccagggccaccagcggaggccgccccggcagtgctggcaacactcgggagcgctgcgcagaggaagaaagctgcctcgccacaccccagagggtcaagtcaggccaccactagctgccagtgatctggaatggatctgatccactgcagaaaccggcaggggagcatg

SEQ ID NO: 26934 - DNA, 166 bp, Homo sapiens
  chr1:229567111-229567277
  hyper
cactgtgtcagtttacgatggcagcaacggaagttgttacaaagaaagtgactgcggggtggctggagctcagccgcccccccattgagaagattcgtcgtcctgagaagtcgcgtgctggaggtggagtgtgtctagaagcatttgcggtggacgatggaagggc

SEQ ID NO: 26935 - DNA, 624 bp, Homo sapiens; identical to SEQ ID NO: 134
  chr1:229567369-229567993
  hyper

SEQ ID NO: 26936 - DNA, 193 bp, Homo sapiens; identical to SEQ ID NO: 135
  chr1:229568157-229568350
  hyper

SEQ ID NO: 26937 - DNA, 1128 bp, Homo sapiens
  chr1:229569458-229570586
  hyper
agggaactgccttggcgacaactaaagcaaaaccgtttatctccctaggcacatcctacatgccaggtaaaggagcccaaaggggctagagaaaaatttggagaagtctaatttccagaggctgactgtcttgcctcctttttaaagcgcgtgtggctccggagacgaggcacagcgctcagggcgcaggcctggggctgaccaggtgaaccgactgggttctgccccggagtccttcaggttcccctcggtagtgccctgtccccctgtcccctcccaactcctgccctacctgggcgggtagctacaactgctactctcggctcgggccctggtcgccgcggaggggaagcgaggcttcacttggcgctgtccgctgcggtggccgcttgtccctctgctcaggttttatatagcccgcgggcattccctccgcgccaccccgcaggaatgtcgctgcccttctcgagccatatttgggtgttgggcactagagccccctccctcggccggttcgcggcctgggcccccgcccgggtcccctgcgttgaccaaagaaggagcgggttggcccggtcccaggtaacgcgggccgggccgtatatggagtgtctccctagcgggtttgcccctcctgacccgacccagttgcccgccggaggggatggggtggggcgagggtcaccgcgttcgccggtgggtgcatgtgtgcgcctgcgctccgggaaccgcacctgtcccaaaggcctccccaaccatgtccactctgagcgccctgggcgctcgggaaggtgcctgactgctgacttccaatatttcaactcctcttcgggttctttgctcagatccccaaactcccacttgcgactaccgggaagagggagtcgtgtggagtggtgggcttgggaggattggagaagcagtcactcctgagtctcaggaagggaaggaaggcgaactccctctcctttacgcccctggaactccatttctctcttcccacccccgagctccctgaatccaaaaagctgagccacgtcgaccccttcccccaccgcacagagggccaccggcggccggagggcgcgcagctgtcgcaggatagacaactggcggggggaggcgagg

SEQ ID NO: 26938 - DNA, 30 bp, Homo sapiens
  chr1:230240615-230240645
  hyper
aaatgccacacaggacgcttgcagtccccc

SEQ ID NO: 26939 - DNA, 120 bp, Homo sapiens
  chr1:230561556-230561676
  hyper
tgtccgggccggactcgccgaacacgtcgtccgagatgtgcaggctctcgtagcgcgcgcgggcagcctcgagcagcgccggcgccctcctccgcgcgcccccgccgccctcggccatgg

SEQ ID NO: 26940 - DNA, 37 bp, Homo sapiens
  chr1:231296747-231296784
  hyper
ccccctgcctgaccccgccagcctgcgcctcctcacc

SEQ ID NO: 26941 - DNA, 286 bp, Homo sapiens
  chr1:231296817-231297103
  hyper
cgctacgactccggtctttagtctttgtttggagcacgggagaacctgggacggagggaggcatgacttcaatattcatatcgttgttaaataaacgatttcctaatttgtatctgtttcatgccagcgtgaaacttctgtaggcagagccggctgcgctgccagcactttcttctgctcgtccccacccacctctgcctcccccacccagccttccctcggcagcagcggggaagaacagccgagcagaccaaacagccggggccgcgggtgggaggctgttccc

SEQ ID NO: 26942 - DNA, 205 bp, Homo sapiens
  chr1:231297104-231297309
  hyper
cagctcgtggctggcgttggagaatgtggagattttcccattcataaaaggaacgtctccgcttgccgccttcccgtccgccgcacaccgccacatccgcagcggggtagggctgggtctgggggcgctgggttcccaggggtctacccgggcgcgctctcgcctttctcaggaaaccccattttgtgagcggcaccgcgtgtcc

SEQ ID NO: 26943 - DNA, 30 bp, Homo sapiens
  chr1:231297520-231297550
  hyper
ggctttttaggatcccgttttcacccttct

SEQ ID NO: 26944 - DNA, 852 bp, Homo sapiens
  chr1:231297797-231298649
  hyper
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcct

SEQ ID NO: 26945 - DNA, 155 bp, Homo sapiens
  chr1:231298924-231299079
  hyper
cgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtccc

SEQ ID NO: 26946 - DNA, 25 bp, Homo sapiens
  chr1:231299434-231299459
  hyper
atcccggggacccttcgccaagcat

SEQ ID NO: 26947 - DNA, 163 bp, Homo sapiens
  chr1:231299478-231299641
  hyper
cgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatgga

SEQ ID NO: 26948 - DNA, 38 bp, Homo sapiens
  chr1:232765315-232765353
  hyper
cctcagtgcctgtgtcgccgagacgggaataacctttc

SEQ ID NO: 26949 - DNA, 51 bp, Homo sapiens
  chr1:233750219-233750270
  hyper
ctgggacttcacctccgcgctcttcttcgccagcaccgtgctctccaccac

SEQ ID NO: 26950 - DNA, 234 bp, Homo sapiens
  chr1:234040247-234040481
  hyper
gtactgaactgggagcggcagggtttgagtcaaaagagaagggtggaggagcgcgtccggtgccccaaggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcc

SEQ ID NO: 26951 - DNA, 5 bp, Homo sapiens
  chr1:234040969-234040974
  hyper
aggct

SEQ ID NO: 26952 - DNA, 213 bp, Homo sapiens; identical to SEQ ID NO: 1897
  chr1:234041148-234041361
  hyper

SEQ ID NO: 26953 - DNA, 191 bp, Homo sapiens
  chr1:234041415-234041606
  hyper
cgggccggtggggctcacgtccatcgaggagcggatcctgcgcatcactggctactatggctaccagccctgggcagcgagctgcaaaagtaagaccccctcacgtcatgtttcccgttcactggtccatcttcttaccattgtcacagcagcctcggggagcgcacgcagtgaggcgtccagccaccccc

SEQ ID NO: 26954 - DNA, 182 bp, Homo sapiens
  chr1:234349869-234350051
  hyper
cagggatgagggctgcggggctgggcgtcccggggaggagggcggagcaggtgagctgcggggtgggagcagggagtgcacttgtacgtgacgttggagtttgcagcaacctccaagtaggaggctgtgcgcgcgtgtgtgtggagtggctgcgcggccggggaggatgtgcgctgcagggc

SEQ ID NO: 26955 - DNA, 256 bp, Homo sapiens
  chr1:234350052-234350308
  hyper
gccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgaccctta

SEQ ID NO: 26956 - DNA, 279 bp, Homo sapiens; identical to SEQ ID NO: 5978
  chr1:235812015-235812294
  hyper

SEQ ID NO: 26957 - DNA, 444 bp, Homo sapiens
  chr1:235812717-235813161
  hyper
ggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggccc

SEQ ID NO: 26958 - DNA, 161 bp, Homo sapiens
  chr1:235813636-235813797
  hyper
cggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggac

SEQ ID NO: 26959 - DNA, 139 bp, Homo sapiens
  chr1:235814009-235814148
  hyper
ggttctaggagcgactgctctccaggcctcgtccctgtggcaccgcaggcttttgcgctggagattttaaaacactttagtgattacagccctcttcctttcagggaaaaaacagtttaagcgccgtccattttccgac

SEQ ID NO: 26960 - DNA, 107 bp, Homo sapiens
  chr1:236227637-236227744
  hyper
ctgccaagacacatccggagtccacacacaaatacaggaggctgccggcgaaactctcccgcagccacaagagtcccggggcccgcgcgcagactgcgatccagctc

SEQ ID NO: 26961 - DNA, 152 bp, Homo sapiens
  chr1:236227769-236227921
  hyper
cgcgagaacctggctccacccgggaccggccaggtcctagccccgaagggactggacagccgagggacgcggactgacctccctgcggcgatgcagcccacagccgccggggaggaagctccgcggggtccatgggtgccggggtcacggcc

SEQ ID NO: 26962 - DNA, 187 bp, Homo sapiens; identical to SEQ ID NO: 1902
  chr1:236228021-236228208
  hyper

SEQ ID NO: 26963 - DNA, 61 bp, Homo sapiens
  chr1:236228563-236228624
  hyper
gcagcccaatggccgcgagggggagggcgaggggcgaagccgaacctcccgccttgggcgc

SEQ ID NO: 26964 - DNA, 146 bp, Homo sapiens
  chr1:236228705-236228851
  hyper
cgtggtcctctgattagggttgggtcgtggagagccggcgacgtggaaacgctccggattcaggaacggcgcccaccccattgccgctcggccgcgtccggggtccaattcgcttgaccctggtaggaagacggggtgggagctgg

SEQ ID NO: 26965 - DNA, 31 bp, Homo sapiens; identical to SEQ ID NO: 5986
  chr1:236558486-236558517
  hyper

SEQ ID NO: 26966 - DNA, 660 bp, Homo sapiens
  chr1:236558547-236559207
  hyper
cgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcg

SEQ ID NO: 26967 - DNA, 112 bp, Homo sapiens; identical to SEQ ID NO: 5990
  chr1:236559256-236559368
  hyper

SEQ ID NO: 26968 - DNA, 49 bp, Homo sapiens; identical to SEQ ID NO: 136
  chr1:236849457-236849506
  hyper

SEQ ID NO: 26969 - DNA, 15 bp, Homo sapiens
  chr1:236850197-236850212
  hyper
cgctttgtggaggtg

SEQ ID NO: 26970 - DNA, 165 bp, Homo sapiens
  chr1:237206101-237206266
  hyper
cgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcc

SEQ ID NO: 26971 - DNA, 224 bp, Homo sapiens; identical to SEQ ID NO: 137
  chr1:237206511-237206735
  hyper

SEQ ID NO: 26972 - DNA, 210 bp, Homo sapiens
  chr1:239549605-239549815
  hyper
aatctatctttgaagcgccgcgggaggcacaatttgggaacaggtgaggccatgctgggtgggtgaggcccccctctctcctgcttggtgttccgctttcagccaacccaccccaggagtaccctgggatctcctcgccccctgccaggcggagaacgcggagcccagcgggcacgcgggaatggagctaggcgccggcagggcaactgg

SEQ ID NO: 26973 - DNA, 89 bp, Homo sapiens
  chr1:239550034-239550123
  hyper
gagaaagggaatacacgataaagaaggagacggaaagaagagaaaaagtgaggcgggagacagagggaaaagggcgtgaacagaaaggg

SEQ ID NO: 26974 - DNA, 579 bp, Homo sapiens
  chr1:239550614-239551193
  hyper
ggaggaaaaagttttcggcgcgggtaggagaggtcttgtgtttggagtccaaagaaggggctgggtagggacgagagaggctgttgatttggggaagatgggggcacttgaattccgacagcgcgatctggtgcggagttggagttctgggactgagggtggggaacgcccgctggcactcaagtgccccgaaagggacgggaatcatgcgagcggtggccgggagagagtcggggacgtcccaccccgctctccctcgcttcgattctctcttcgccactgccggatctgaggctccaaagtgcccgagcatgaggagctactgggctccgggtgtgtttgtgagcgcactcgtgtgttgagcgtttgtctcccatctccccatttggtttcctgtcatttctaagaaggctaaagctggcacccgccaacctcgcagtggggccgcaagttcggattgcatttcagggggcgagaaggcaaatttggcacttcgagtaacacttgggcgaaggtacctagcctagtgcgcatctttactgacccggggagagtctgcactcgcgaggcagcggccgc

SEQ ID NO: 26975 - DNA, 134 bp, Homo sapiens
  chr1:240160952-240161086
  hyper
caagacatttaaacccgggcggtgggggggcgggcggtgtcagacgcccaacgaccacctccctcccggcccgcgccgagcccggccacaccctccccgcgacacccgcgatcgccccccaggactggcggccc

SEQ ID NO: 26976 - DNA, 259 bp, Homo sapiens; identical to SEQ ID NO: 5995
  chr1:240161122-240161381
  hyper

SEQ ID NO: 26977 - DNA, 667 bp, Homo sapiens
  chr1:240254819-240255486
  hyper
tatgtggctgtgacccgatggcacctctaaactggaattgggcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgc

SEQ ID NO: 26978 - DNA, 672 bp, Homo sapiens; identical to SEQ ID NO: 139
  chr1:240255487-240256159
  hyper

SEQ ID NO: 26979 - DNA, 156 bp, Homo sapiens
  chr1:240256624-240256780
  hyper
cgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaact

SEQ ID NO: 26980 - DNA, 238 bp, Homo sapiens
  chr1:240775075-240775313
  hyper
ggtcctgaccagccacggaacaaacaacgtcaattcattctaagtgcctggtgaaggtagaaatcagaaaccgtgtctgtgtcacgttagtcgtgacaagctgcgtacctgcaatgacgtgatggaagcctcctcctcgggtcccttctctctctctctctccctctccctctgccttctctgagttctctagtccacagcggggtctaagtttggtctcccgccgccgctttcagtt

SEQ ID NO: 26981 - DNA, 77 bp, Homo sapiens; identical to SEQ ID NO: 6000
  chr1:240775378-240775455
  hyper

SEQ ID NO: 26982 - DNA, 434 bp, Homo sapiens
  chr1:241520099-241520533
  hyper
cggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgg

SEQ ID NO: 26983 - DNA, 145 bp, Homo sapiens
  chr1:241587106-241587251
  hyper
gcaggcagtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggca

SEQ ID NO: 26984 - DNA, 138 bp, Homo sapiens
  chr1:241587471-241587609
  hyper
gggtagcagggcagtcgagcacggagggaggggcgggcctccaggggacttcagcgggagccgggcctggggcggtgccgcacttgcacacggagtgtggggggccaggcctgggaccaggagctggggccgggcttc

SEQ ID NO: 26985 - DNA, 268 bp, Homo sapiens; identical to SEQ ID NO: 1911
  chr1:241587610-241587878
  hyper

SEQ ID NO: 26986 - DNA, 40 bp, Homo sapiens
  chr1:242161790-242161830
  hyper
ccggggcacgctctgcgccacctaccggatgatgctgagg

SEQ ID NO: 26987 - DNA, 1065 bp, Homo sapiens
  chr1:242686734-242687799
  hyper
gaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggccgagagccactcgtgctgccggatctccatcctgacatgaccgggcggccgccggcgagcagcggactcgggacgggcgcgcggggagccgggcgcggagggcgagcgggaggcccagcgggagccggaggtggagctggagactgagctggaggagctggaggagcgagcgggcgcggggagcgcggggtgctgagcgccagctgggagcgcggccgggcgggagggggcgatcgcgggaggcgcggggc

SEQ ID NO: 26988 - DNA, 27 bp, Homo sapiens
  chr1:242688007-242688034
  hyper
ggccggctcccggggcggcggcggcgg

SEQ ID NO: 26989 - DNA, 164 bp, Homo sapiens
  chr1:242688080-242688244
  hyper
cgcgcctgcaggttggtgcagtgaggagccgccgccgcccctcccgccgcgcccaggcccgggcggccgcgctcccgctccgcacccgcctttcccgagcaggctacacctctccctggcgcatctttactggaaagccggcaggcgaggggagaagtgagcgc

SEQ ID NO: 26990 - DNA, 418 bp, Homo sapiens
  chr1:242688277-242688695
  hyper
cgcggggatggctccggagggagacactcaggaaaccacctccgcccttcccccatctctatccagcggcgccccctcaccctgcccccggctcgcttgggctgcgccttcccccattctgaaagttcactaacttcccaccccaagggacttagagcagagggtgcccagcattcccccctgaaaatagccgagagacatgtgttttctggagccgtacacgctactttcatccgatggtgtggcgatgcaaatacgcccgggggcagtagcccctcgggcaggcacgcgggaccggttgctccccagccctcggtgtccacctagaaccgggctccccgggccgcacccattccgatcctgggagggtgatccagggctcctctgcaacgctccgcttgtgcggtgactgttcctt

SEQ ID NO: 26991 - DNA, 92 bp, Homo sapiens
  chr1:243053773-243053865
  hyper
ccggccagcaggcctcgcgctgctctcggtcctgggcgcagggagagccgcggaggcggagagcagggctggcgggccggctcctgggcctc

SEQ ID NO: 26992 - DNA, 167 bp, Homo sapiens
  chr1:243053866-243054033
  hyper
ctgaagagcttcccgcgggccaggctcggccccagcacgacctgaacaacgtctgcttcttgcaagccgccacccggcctatgggcgcgaactccacccgctcgccccctccacgtccccgcctggcctgccgctgatgggggcgggcagggcggaattccagcaac

SEQ ID NO: 26993 - DNA, 263 bp, Homo sapiens
  chr1:243646485-243646748
  hyper
ggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctc

SEQ ID NO: 26994 - DNA, 248 bp, Homo sapiens
  chr1:244014423-244014671
  hyper
ccaccccctgcacctcggggaagagggaacccgggtcagcccgtagcaagaatcattcctgactatcccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacattt

SEQ ID NO: 26995 - DNA, 325 bp, Homo sapiens; identical to SEQ ID NO: 6011
  chr1:244080470-244080795
  hyper

SEQ ID NO: 26996 - DNA, 786 bp, Homo sapiens
  chr1:244893526-244894312
  hyper
ctgctccgaggccctcggaccaaagagaggctgcgaggaggacgcggctcgtttagctcgctgcgaacctcaagataacccttggtttccatgcacatccccccaacattgcatgtgctttcattcctacggtgctggggttactttcatttattgcttttgttgaccaaaaagaaaaaaacaatcctgagcgtgcacagggggcgcaacgggggaccggctcctcgtggctgaccggcggcggggctggcgcgcgggggcggcctgcgcgggccgcccggggacgctgctctggggtccggccgcggcctcgtggccgccctgcgcgcggtccagcaccagcagcgggatctcctccagccggtccggccgctccttgcgccgcaggtagcgccgcctccacgtcgccagcctctgaagcagcctctgcaggctcgaggggccccacaggccgcgctccggggcctccttgcctgcgcgcgcgtgagcttgcctgagcttcttcctgcgcgggccgcggaacagccgccgccagcaccagcacccagagcaggagccgccgtcgccggccaccgcgcgccgcccgaccgcctccggatccccgcgcggaggggggccccgctccaggcgcgccgccttctccagcagctcgtgctgcgcgccgccgcgccgggggccaccaaaccggggggccgccatggcccgcgcaggcctcttctcggagcgcggggcccacatctcgggaaccgtcgggctggacaacaacgctgccgcctccaggactcc

SEQ ID NO: 26997 - DNA, 176 bp, Homo sapiens
  chr1:247171005-247171181
  hyper
cagcggccgggatcccgctgccggcccggcccccacctgcgcgggacgggactgagggccgagctgcgccagcgggactcggccgcacactccggagccgaccgccgggaggcccggggccgccagcgctggttccagccaattccaaccgattccaaccaccccctctcccttct

SEQ ID NO: 26998 - DNA, 166 bp, Homo sapiens
  chr1:247171251-247171417
  hyper
cgcaatacctgcaggccacagggcgatggagcctgcggcagtcacccgggactctccgagaggcagcagacgggaacccagcaccccgccggccgcaaggagacaaaggccccgccagatccccaaggccgccccttcctctctggctgcacgcctgattggacag

SEQ ID NO: 26999 - DNA, 120 bp, Homo sapiens
  chr1:247274343-247274463
  hyper
agagctcggggccgcgagcaagcctccgacgccctggtcccctggacccgccggttaaactgtgattctctttctaaatcctttgtctgcgccggactcggggtacccgccgggtggtgt

SEQ ID NO: 27000 - DNA, 77 bp, Homo sapiens
  chr1:247274523-247274600
  hyper
ctccccagtggttgggattacaggcgtgagcccccgcgcccggccaaagggccccctaggaccggctgtctcccccg

SEQ ID NO: 27001 - DNA, 111 bp, Homo sapiens
  chr1:247274826-247274937
  hyper
gctccggaaagtttgcggcggctgccccgggagggacttcggcggggaggaggcggcggcgccaggtggccgaagtcggaggggtccgtccgctcccgcagcctaggagcg

SEQ ID NO: 27002 - DNA, 29 bp, Homo sapiens
  chr1:248020420-248020449
  hyper
ttgaactgaagccagcggacaccacccgt

SEQ ID NO: 27003 - DNA, 116 bp, Homo sapiens; identical to SEQ ID NO: 140
  chr1:248020515-248020631
  hyper

SEQ ID NO: 27004 - DNA, 384 bp, Homo sapiens
  chr1:248020956-248021340
  hyper
ggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaa

SEQ ID NO: 27005 - DNA, 191 bp, Homo sapiens
  chr2:287500-287691
  hyper
tgtctctttttgaaacgtgtttctcaaagacaattctatttcccagcagccccggccctcgggcgcgctcggccccactcacccactcgctgctccggcgaaggccccagccccgccgcctccgcgcggcccagggcgcagtcccgcccgaggagctgcaggcccttgtgctccgccgagtggtgcttccg

SEQ ID NO: 27006 - DNA, 42 bp, Homo sapiens
  chr2:288009-288051
  hyper
cacctccgcggaccccgaggaacaagccggcaggtgagggag

SEQ ID NO: 27007 - DNA, 573 bp, Homo sapiens
  chr2:288269-288842
  hyper
ggacctcggaggggccgcgctcccgcgcctaccgctctccaagaaggcggcgccgcgcgccgggcccggcggccgcgctcaagtttccagcgtcgcctttgcgcggtggtcgccggcgagcgccgagtccccgaagcccacggaggaggccgggtgcggaccctcgcgctggccccggccgcgccacgtgctggaagcccctccacctcccggccatggcgccctcccgcacctgcccggcgccacccgggagccacctgcgcgtcgtggccgggccggttacctggagccgccggagtcgtcgccgtctgtgcgcacgtctgtccccgcgccccgagctgcgccactactccatgcccggcgggcggagcgcacgggacgcggggactcggccgctccgagcgctggacccacggccgacctggggtgcgccggctccgagtcccgcctcagacctcggggagcttcttatccccgcgcccgccgacgtcaggcgggtccccaagggctccgagcggggctttaattagaagccgctgaagtgttagtacccccatgcggatcttcgtcagt

SEQ ID NO: 27008 - DNA, 123 bp, Homo sapiens
  chr2:289223-289346
  hyper
caattagagtccatccgttttggagggatccgctctccggacctcgaggggtctgccccgcccgagcccagtccccaggttcgggtccccaagccctggtccccgaggcggggcggccaggag

SEQ ID NO: 27009 - DNA, 740 bp, Homo sapiens
  chr2:289672-290412
  hyper
attatcaatcagttgcgcactttcccattcgattggtgctttctgggcaagagctggacgtcttccaagtccgcgatctgtttgggaaaggtgttctgagtgcaatcagagaggcggagtgggcgagaattaaaggcctgcaccatgatcggggcagtcgcaggaccgcggcgggaaggtgctggcccaggcgcacgtgagcgcgggcggtgcgggcggaaggctccgcgccccgatcccccagctcccggagaggccccgtctgcgcccgtccccgcgtcctttctctcttcctgcacggggtctgtctcctcaggaggagaaagtgtccggcagagctgggcggggaggcagcgtggagagagaagatatgaaatgtgccggttccggaccccgccccacacccttgggatctgcgttctctccgctcccttgaaaaacagatggtttgatttcacagcgaggcttttctttttctttttgcaagctacatgactgaaatgtgaacatttctgctaaaatacactcaggaaaaagtaaaattttatgtcaaacagaccttaggcacataaaaggaggcatttttcgtttctctctttccccttcccatgtccaagaagacacttgagttccacgggcaagagcgacgcctggcgatggaaccggccctccccggccctgctcccggtcctgcttgccgggcccacctcgcagctggtggacaccgcagttcccagaaa

SEQ ID NO: 27010 - DNA, 119 bp, Homo sapiens
  chr2:468115-468234
  hyper
cgcgaggggcaggacgaggctgcatgggccagcgagggggtcgacaccgagccagagtgagcgcggggcctggggcgcagagcccgcccagggagccgggagacgccgcgcaagctccc

SEQ ID NO: 27011 - DNA, 280 bp, Homo sapiens
  chr2:468423-468703
  hyper
ggggctcctgcgcgccccttgaaccccgcctcccgcatcctcctgcaacagcctggagctccctgtgcaggacgcagcggggggcggggggcggtcttaggaggctgcggggcgcactcccacctcctgcctccccgagacccccagcgccttctccagggtttagagcggaggtgaaggggcctcgtcctgcaccgccactgggcgcctgggctgttcatcatcggttaccgccgattcataggaactcctcaacacattggctcggaaatgtacagtc

SEQ ID NO: 27012 - DNA, 198 bp, Homo sapiens
  chr2:945812-946010
  hyper
ggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggcc

SEQ ID NO: 27013 - DNA, 207 bp, Homo sapiens; identical to SEQ ID NO: 1921
  chr2:946011-946218
  hyper

SEQ ID NO: 27014 - DNA, 115 bp, Homo sapiens; identical to SEQ ID NO: 1922
  chr2:946289-946404
  hyper

SEQ ID NO: 27015 - DNA, 135 bp, Homo sapiens
  chr2:946432-946567
  hyper
cgctcgccgccctccccgcgggtgcgcgcccggcccctccctcgcccggggcgggtctgcgtgggcggtgctccgggtcggcgggcggagctccggttccccagccctgcgccccggtggagcccgagccggagc

SEQ ID NO: 27016 - DNA, 128 bp, Homo sapiens
  chr2:946916-947044
  hyper
cgcagtgggcacccgccccctggccgctctgctccctccagcccagtgtcttactggaaacttgcaggctttgctcctccagcgtcttctaaggtttggttttgaggcgcccgggcttccctttactg

SEQ ID NO: 27017 - DNA, 55 bp, Homo sapiens
  chr2:947126-947181
  hyper
cggtggctcggaccggagcgtcccccctgcagccttcgggcgcccaggccaggtc

SEQ ID NO: 27018 - DNA, 516 bp, Homo sapiens
  chr2:1746517-1747033
  hyper
tgggctgaccattcacgggctctggaaagaaagccttggtctctctgcggaggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatc

SEQ ID NO: 27019 - DNA, 358 bp, Homo sapiens
  chr2:1747650-1748008
  hyper
ggggaagcgggaggccggcggagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccgg

SEQ ID NO: 27020 - DNA, 339 bp, Homo sapiens
  chr2:1748396-1748735
  hyper
ggggcgagaacccggggccccagcgtccggcctgagcgccctcatcccggtggggcggcccgcatggccaaggcgagcgctcgggggcgcggaggagagcattggcacccctgattctgcgctcgagactcggggctcgggaccctggggcctacgcgaagcttctccacttctcttacccgtggtttctgcctgcgctcactacgggttttttagttggcgccttaatgtttgtaacacttttagagcgcttgctctgatccgggcacgattccaggcgcgcaggcgcgctcctctctttctccttctccctacccgcaaccacgtaggaaattattt

SEQ ID NO: 27021 - DNA, 42 bp, Homo sapiens
  chr2:5813681-5813723
  hyper
acacctgcccctccacggccgcgcgggcggaggatggcactg

SEQ ID NO: 27022 - DNA, 226 bp, Homo sapiens
  chr2:5830979-5831205
  hyper
tttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaacacaaaggagacgaacacggcacgatcgc

SEQ ID NO: 27023 - DNA, 164 bp, Homo sapiens
  chr2:5831237-5831401
  hyper
cgccccaggtcgcggctccccggccgccagcgcacctttccatctccagggaaaatatttagacgggaaactcgagtgcaccttattttctctttggtttatgagtgacccagaaggcttctagctcacaatcgcacgatttcaggacgaggctgccggagaag

SEQ ID NO: 27024 - DNA, 86 bp, Homo sapiens
  chr2:5831467-5831553
  hyper
cggaggggcggggagaggacggggcggggagaggaggggcggggagcagagggagaagggaaggagggcgccgggcccctcgcagg

SEQ ID NO: 27025 - DNA, 259 bp, Homo sapiens; identical to SEQ ID NO: 1924
  chr2:5831789-5832048
  hyper

SEQ ID NO: 27026 - DNA, 5 bp, Homo sapiens
  chr2:5832283-5832288
  hyper
cgcat

SEQ ID NO: 27027 - DNA, 116 bp, Homo sapiens; identical to SEQ ID NO: 1925
  chr2:5832731-5832847
  hyper

SEQ ID NO: 27028 - DNA, 151 bp, Homo sapiens; identical to SEQ ID NO: 1926
  chr2:5833282-5833433
  hyper

SEQ ID NO: 27029 - DNA, 141 bp, Homo sapiens; identical to SEQ ID NO: 1927
  chr2:5833499-5833640
  hyper

SEQ ID NO: 27030 - DNA, 366 bp, Homo sapiens
  chr2:5833734-5834100
  hyper
cgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgacta

SEQ ID NO: 27031 - DNA, 490 bp, Homo sapiens
  chr2:5836085-5836575
  hyper
ggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggc

SEQ ID NO: 27032 - DNA, 124 bp, Homo sapiens
  chr2:5836621-5836745
  hyper
cgcggtctccggggtgcctgggagggccgaaccactggtgagggcgtggggagcagggggtggcagagggcacccgggcggtagtccgggacgcgcaaggcagagccctgacgctccgggtccc

SEQ ID NO: 27033 - DNA, 165 bp, Homo sapiens
  chr2:5836827-5836992
  hyper
cgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccc

SEQ ID NO: 27034 - DNA, 116 bp, Homo sapiens; identical to SEQ ID NO: 6040
  chr2:5837352-5837468
  hyper

SEQ ID NO: 27035 - DNA, 137 bp, Homo sapiens
  chr2:5866074-5866211
  hyper
ctgggggcagcagagcgacgtgccagcgtccgtgttgggcgggtgtcggggggacccggacaccccgccctccttcctgcagagctctgcgggccctgtggcatccatggagaccctggctccggtttcacaggaag

SEQ ID NO: 27036 - DNA, 228 bp, Homo sapiens
  chr2:6121893-6122121
  hyper
ttccctgcaataccccgggaccgtcggtaaagcaggctttgtcatcgtctgcgttttcgccgcggcgctgtcctgtctcagctcctcctgactcagctgaagggggctggtgaataatgcatcacctagggagaggcgctggggctgcggggcacagctgagcgtgtgcagagggagcccctcaggctttctctctgtctgcctccatcttaccgtatccagagacca

SEQ ID NO: 27037 - DNA, 30 bp, Homo sapiens
  chr2:7057304-7057334
  hyper
tgctgtgtgttccctcggtgtaggaatcag

SEQ ID NO: 27038 - DNA, 235 bp, Homo sapiens
  chr2:7058143-7058378
  hyper
cgggcgagctggcggcgggggctttcaaggttcgcggccccgcccgcagaccctggggctggagcctcggccccaagaggaggtctgggaaaggacgacgcgtccggggcatcgccaccggcggggaaggtcggaactggccaagaggatgccccgcacatcccctgcgcgcggggtccgcggctgctactgcccctggtccccaccgcgagccctttcccggggaatgagccgc

SEQ ID NO: 27039 - DNA, 33 bp, Homo sapiens
  chr2:7571090-7571123
  hyper
tgggctgcaggcctgcgagtggcaggcgcagcc

SEQ ID NO: 27040 - DNA, 320 bp, Homo sapiens
  chr2:7571157-7571477
  hyper
cgctgccctctctccggaactgtttttttctgtcctggtctctgaaagccttattgattgctcaaagtgaacttctcagcccacggtttcctcacccccggggcagcttgcatttcctctgccgcggcctctgtcgcctcccctcccgcgcgcctcggccttttacatttcaaatgctcgacagctgggccaacttctgcttccgcccaaagaagggctctttgccgctcacaatggccggccagtggcgcgggggctcttttctctccagctgtgagagaggctttttcaaaggccggggggaagctgccgtccagctg

SEQ ID NO: 27041 - DNA, 150 bp, Homo sapiens
  chr2:7571576-7571726
  hyper
gggcaggtgaggccaggccggccgggcgtcaccgcaggtgtgcactccgcgcgcgcactcagctcgctttggtgtttctccaggccctcagggcccaccactcctagtcccagcccacaggtctgcccgagtctccgcccaggaatgtgg

SEQ ID NO: 27042 - DNA, 80 bp, Homo sapiens
  chr2:9143213-9143293
  hyper
ggggtcgctcagaggcgcgcgcggggcaggcagcaccacgccaggctccccaaagcgcagccttccgcaccctttccaca

SEQ ID NO: 27043 - DNA, 340 bp, Homo sapiens
  chr2:10182780-10183120
  hyper
aaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtca

SEQ ID NO: 27044 - DNA, 155 bp, Homo sapiens
  chr2:10220786-10220941
  hyper
gttcatttatggaaacgctccccagacgacgctcgccgggcccgtgggaggccgcgggagcttggggggacttcccaaagcctgagccccctagcgatgcgcggggtgggcgggggaaagaccctgagggctgcgcgcgctgcgttcgcgaggtc

SEQ ID NO: 27045 - DNA, 49 bp, Homo sapiens
  chr2:10220958-10221007
  hyper
cgacctttcagtgtccgccaggcctgagacgccccgggagggaaggggc

SEQ ID NO: 27046 - DNA, 143 bp, Homo sapiens
  chr2:10444448-10444591
  hyper
acggcgtaaaattggcgcttcccgcacatgcagatctcgggctcccggggtgtcccggccgccaaaggccacccctttcctcctggctgaccccaattccaccagaggaggatgtttgccagggacgccgagtccagctgctg

SEQ ID NO: 27047 - DNA, 30 bp, Homo sapiens
  chr2:10589172-10589202
  hyper
atgggtcctggcctgcggaggtagtttccc

SEQ ID NO: 27048 - DNA, 71 bp, Homo sapiens
  chr2:10688822-10688893
  hyper
tgcttgcagcctggccgcgtgtgcgcctctgctgggatgacccggtcctgttgccccggggccccatcgga

SEQ ID NO: 27049 - DNA, 44 bp, Homo sapiens
  chr2:10861191-10861235
  hyper
agtttcctgggcaaccgggcgcacacccgcgcccacacggacag

SEQ ID NO: 27050 - DNA, 30 bp, Homo sapiens
  chr2:11052102-11052132
  hyper
gctctctgcacacctcgagcacctcgcgga

SEQ ID NO: 27051 - DNA, 332 bp, Homo sapiens
  chr2:11052361-11052693
  hyper
ggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacc

SEQ ID NO: 27052 - DNA, 556 bp, Homo sapiens
  chr2:11622808-11623364
  hyper
gccaagcccaccgcccggccctcctccgcggccgtcccgaagacccggagaagtggaccacagggggcggccagtgtcaggggtcgagtcctccgcgctggccgcggttccggagatccgggctttgccgagcgccccgcgccgtggccggggccggggccaggtccgggtgcggggcctggcgctgcggccgcgagctcagcctgtaggctgggctagcctccgtcggcggcgggcgctcaggagcggggccgcggcggccggaggacaaagggcccgaggtaggagcggtccctccgggcggcagcgggcggagcgggggcgcggggctgtgcggggctgctcggggcgggcactcggcgcccggcggggaaggtgcgccccgccggacgcgggcacttcctggccctggtcccgggaaggaggtggaaggtgtccgggatcggccctggcagcgtgtagggacctgggtgctgccgctgccgtgcgcttgtgcgtgcgtgtgcgcgcgggtataggtgtgggcgcgcgtgtgtgtggggtgtgcgtgcgtgtg

SEQ ID NO: 27053 - DNA, 135 bp, Homo sapiens
  chr2:11623424-11623559
  hyper
catgtgtacgcgtgtatcggtgtgcgcgcgcgtgtgtgtgtgtgagagagagagagcacccgaggctcctggcgcttggcacatggtgagccctcggtaggtgggagccgtgaacagtgacggtgataatcgtat

SEQ ID NO: 27054 - DNA, 289 bp, Homo sapiens
  chr2:12858341-12858630
  hyper
tcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttatt

SEQ ID NO: 27055 - DNA, 30 bp, Homo sapiens
  chr2:14773043-14773073
  hyper
ggagcagggaaatcacgggtagggagaagc

SEQ ID NO: 27056 - DNA, 71 bp, Homo sapiens
  chr2:14773957-14774028
  hyper
ggcacgtaagctagccggcaggtcccaggggcactgcacgtcttggggagggacaccgaaaggggcagccc

SEQ ID NO: 27057 - DNA, 50 bp, Homo sapiens
  chr2:14774593-14774643
  hyper
acagcctgtatgaggcgggcgcggccaacgtgggccgggtggtgaatagc

SEQ ID NO: 27058 - DNA, 319 bp, Homo sapiens
  chr2:14774939-14775258
  hyper
agtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccc

SEQ ID NO: 27059 - DNA, 83 bp, Homo sapiens
  chr2:14775608-14775691
  hyper
ttgtgttccaggctgcgggctaagccagacagtgtttgcctccggttctttccaccgtgggaagcgaacgccacccccacccg

SEQ ID NO: 27060 - DNA, 46 bp, Homo sapiens
  chr2:16080930-16080976
  hyper
ccctggacgggattgcgacgtgcgcaccgggcgccctaatatgccc

SEQ ID NO: 27061 - DNA, 989 bp, Homo sapiens
  chr2:16082016-16083005
  hyper
cccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcct

SEQ ID NO: 27062 - DNA, 43 bp, Homo sapiens
  chr2:17699420-17699463
  hyper
agtctgtggagttatcgaaaatagcattcgttgaaacaaggag

SEQ ID NO: 27063 - DNA, 135 bp, Homo sapiens
  chr2:17719677-17719812
  hyper
taaacattacaatatcgcatttaggacgcaaacagcgctgcagtgcaaatggaactttaaaaaatctgcccgcccacgtagacaaagctactttacaaaagcgcacgcgtcgatatcaatcgtaccctacaacag

SEQ ID NO: 27064 - DNA, 290 bp, Homo sapiens
  chr2:17720027-17720317
  hyper
tgtagtaggggaaatcgaccaaagacgagattttgaaagccttttgaaagtcgtttttctagctaaaaagaaaaagtgacttattcaggactgactccccctgccagtcccaggaaacaggagcagcccggcgcgcccgggagccccgcagcgcagtgcgcactgcggctccagagcgaagggctggcgcccgccagattctaaacgtgctcggctgccgcagcccgccggggccgcgcgccgtggtccgcgcgactccgcgctccgggtttccgcggtcaccagcactg

SEQ ID NO: 27065 - DNA, 157 bp, Homo sapiens
  chr2:17721522-17721679
  hyper
taacaaagggtgggccgggggtcggctaggacagaaagcagcgggaaaagcggctccacgtgttccatctctggcctcggccttcagcccccaggttcggtaaccactgggcgtggcgagtccgggtaacccgcagtccctcgcgcccgtccaggtg

SEQ ID NO: 27066 - DNA, 117 bp, Homo sapiens
  chr2:17721750-17721867
  hyper
cgtggaatccacccgcggaaactccgagcccctccgactgagcatgcgccatcgccaggcggcttttggtcacaggctcccgagttctcctagctggggctgcggagctggggggag

SEQ ID NO: 27067 - DNA, 151 bp, Homo sapiens
  chr2:18011883-18012034
  hyper
actggctgcagatcccgcaaccctcgggtgttcaagtgcgcggggtggtgcgggcgctcccgcagtccgcgcttggctcgtgggaggcctcgggcgccccctccaggattccgtgctaactgcaaacgatcgcgctcgcagggaggccccc

SEQ ID NO: 27068 - DNA, 1192 bp, Homo sapiens
  chr2:18058949-18060141
  hyper
ccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcccggggcgcccggctgcgggcccgaagcgaggggctggcggagctgcgaccaatggggcggcggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttac

SEQ ID NO: 27069 - DNA, 30 bp, Homo sapiens
  chr2:18060643-18060673
  hyper
agttgcagggaagagcgaacccagggccct

SEQ ID NO: 27070 - DNA, 67 bp, Homo sapiens
  chr2:19551382-19551449
  hyper
cgcggcagcggaggccgggccccctgcagaccccaggcccgaggtccccgtcccgctctcctagtcc

SEQ ID NO: 27071 - DNA, 157 bp, Homo sapiens
  chr2:19551499-19551656
  hyper
cgcggtccctagggcaggaggctgaagcagatacagggattacacttttgcaggctccgggggtgggggcaggggcgggaggaggaggtgggagctgccagtgctaaggacttcgttgcctctcctctctccactcactctccgcagtcagagttac

SEQ ID NO: 27072 - DNA, 282 bp, Homo sapiens
  chr2:19556318-19556600
  hyper
ggatgagtgagcccccggctcctccggctccggtttcccagaccgcggaaccccagggcgaatactttcgatctttaaacacaggatggaaaacccttccccaggctaggcacccattcctcaaacagcttgggcctcaggacctgcgggaaagaataaggggacccgaccacgcacagcagacgcaattcgcgctcgggatcccgagtccctgcgcagtgcgggcactcgcgtccctcgcgcggtggagcgccaatcccaggtctgcggccagtcctatgc

SEQ ID NO: 27073 - DNA, 105 bp, Homo sapiens
  chr2:19556980-19557085
  hyper
cgccgccggtcgctgctagtcccctccagcgcttctcttccctagggggttgtgaacctgggacacctagccttgcacgtggttttgttccgcagagccaatgcg

SEQ ID NO: 27074 - DNA, 33 bp, Homo sapiens
  chr2:19558008-19558041
  hyper
gagagaggaggcacccgccgagcagtgacaagg

SEQ ID NO: 27075 - DNA, 30 bp, Homo sapiens
  chr2:19558491-19558521
  hyper
cccaaccctgccctgcgcctgcgcaatgaa

SEQ ID NO: 27076 - DNA, 251 bp, Homo sapiens
  chr2:19558733-19558984
  hyper
tcctaggacacagcccgtgctctttgggaggagggagggaggggcagtagctctgtgcaccgggatccccacaccgcggcttgggtttcaacgcactttggcgcctgacagagtcgcatctcctcccagaatctctttccagaggcggcagaccccgagtgtggagcagctcctggctatccaagcgtgctcggggccagggtgttaacccaggcagcgctggttaattcctggtgcgggagggccagggt

SEQ ID NO: 27077 - DNA, 342 bp, Homo sapiens
  chr2:19561131-19561473
  hyper
catgtgtttaggactcgcgaggacgtcacgtttcgaatttggtaaaagtcctcggtagctaggacccaacagttctgccctcctggaaacccaatgaaggtgacaaaactcccatctcattactgggagtccagcgcactccgccaccgcggctgcagcttctgctagctcggagcctgcggactccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtc

SEQ ID NO: 27078 - DNA, 184 bp, Homo sapiens
  chr2:19561523-19561707
  hyper
cgatccctccgtctgcccgggcttccgggctgtggaccgcactgaacccagtcccgcagcaagccctgctgccgccttttcctgggcacgcctgcggtggtgacggcccgctgctcatgtctccacgccaaaccccagcccctctcccgattcctgctccttggtaaagcgccccagcctgtct

SEQ ID NO: 27079 - DNA, 30 bp, Homo sapiens
  chr2:19563338-19563368
  hyper
ccctcccggcacacccggaggtgagaagtg

SEQ ID NO: 27080 - DNA, 195 bp, Homo sapiens
  chr2:20068725-20068920
  hyper
tgggatgcaagtgcccgccaagccccccgtttcccacgtggagttcccacagggcagcagggaggggccgcgccttctctaactgacccgaaccgacccgggcttcacaggcttcgtggagagcagctgccccgccggcatcttccggatgaggctctctagacaacaaagccttctacgcggaagttactggtg

SEQ ID NO: 27081 - DNA, 67 bp, Homo sapiens
  chr2:20212718-20212785
  hyper
cggctgcagcctgcccggccctccactctccctcccaccccagcggggcctgcgccccaggtacggg

SEQ ID NO: 27082 - DNA, 133 bp, Homo sapiens; identical to SEQ ID NO: 1931
  chr2:20865714-20865847
  hyper

SEQ ID NO: 27083 - DNA, 408 bp, Homo sapiens
  chr2:20865848-20866256
  hyper
ttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgct

SEQ ID NO: 27084 - DNA, 65 bp, Homo sapiens
  chr2:20867171-20867236
  hyper
gcgccgcggctgtcccggccgccgcggttccccgggcccgcgccgcgcgccgcgccgcgggctcc

SEQ ID NO: 27085 - DNA, 349 bp, Homo sapiens
  chr2:21022707-21023056
  hyper
atagagaagaaggggcgccagatcccgcgtgcctgcccacccgtccttcctttgggcagtcaccctgagctcggcaagctgtacctcacctgtccacctggaaggctgcccgctctccctgagggtcctgggaaggcggcacgagaccggaagtgcccccctcaggtgacgtcacagtaccgcgccggagctgatccgggaagccgatgtcagcctggcgcgcggcgcacagctggctgggagatttcttactggcttggagccggtggtccagatcagagagacctcttggagggtgtcggggttttcctttctttttcatttgaattttatccgccttttattttct

SEQ ID NO: 27086 - DNA, 131 bp, Homo sapiens
  chr2:23608959-23609090
  hyper
tgtgtgacccctggccggagcagcccccctgctgggcccggcggcgcgcgcccctctccaggccacgttcccctgagcggcccagggccccggccgggcaggagacctggaggcgacggagggctggcccc

SEQ ID NO: 27087 - DNA, 120 bp, Homo sapiens
  chr2:23609527-23609647
  hyper
ctccgtggcctggagcgggctgagagcgctagggttatctgcggtcgccgcgcgggtgcccgcgctgggcagcgtcggccccgggccccaagggagggacgtgctcgcctggggccggag

SEQ ID NO: 27088 - DNA, 174 bp, Homo sapiens
  chr2:23609896-23610070
  hyper
tgggtaaggagctgccgccgccgccgctgccatccccgccgctctgcaaacgttctcctccctccctcccgtgcttgcgccgcggcgcgccccgggcgaatcgtggacgcaggtatttatgtagcattaggcgagacctcggcgctggagggaccagaccgtggaggacgccga

SEQ ID NO: 27089 - DNA, 16 bp, Homo sapiens
  chr2:24232773-24232789
  hyper
gtcctgagggcctgcc

SEQ ID NO: 27090 - DNA, 114 bp, Homo sapiens
  chr2:24233349-24233463
  hyper
gcaggtcctcccggggtccccgagctctgggcaggcagggctttctgaagcgcctggggaggctgcgtccttcccgacctcaggcagctgctgtggcctcggcctccctcccag

SEQ ID NO: 27091 - DNA, 199 bp, Homo sapiens
  chr2:24273048-24273247
  hyper
agtcgttcggttatccgctgctgctgataccccagcctgggtttcggcttcgctttccctgccctactcggcgagctctggaaagcaggacctgctctcggatacccgctgctcggggacctcctcctagcgcgtcccccgccgggcctcccctcggtcgcttccctgcgggccgggctgtgagcggctgtggggacag

SEQ ID NO: 27092 - DNA, 209 bp, Homo sapiens
  chr2:25354748-25354957
  hyper
catgttccaggaggccgtcatcaagaccgtgggtgcggcgcggggccgggccggggcggggcggggccgaggcgcggagtggggaggggaggggagggacgggacggggcccaggggctcaagactgaggcgcagggcggggtggggccaaggggaggaaagagggaccctggaaaggggcggggcaccgggggcggcccggggatggg

SEQ ID NO: 27093 - DNA, 699 bp, Homo sapiens
  chr2:25391035-25391734
  hyper
aaagaccgggttgtcccaagacctcctagcaagctctcggagcctccggaccgccgcgagcccctgggggagaggaggccgccggctccctggagacagcgcctgcagcttcgcggccgtccgcccaggggccggacgtgggccctccagctcagctactggcggcttctcatgccgcagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaacttaattatggatggcgttgggtctccgcttagaacgggcgggaggctta

SEQ ID NO: 27094 - DNA, 51 bp, Homo sapiens
  chr2:25438821-25438872
  hyper
atttatcctaaaaaacgacaaggtccgggcgcccagcagaacggcccggct

SEQ ID NO: 27095 - DNA, 245 bp, Homo sapiens
  chr2:25439138-25439383
  hyper
ggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcatcggtgataattgcgccggcgggcgcgg

SEQ ID NO: 27096 - DNA, 57 bp, Homo sapiens
  chr2:26395401-26395458
  hyper
gcagaattcagaacccgagctttgggcggcggagcaggacagggcgcgggtgggcgc

SEQ ID NO: 27097 - DNA, 53 bp, Homo sapiens
  chr2:26395459-26395512
  hyper
gcctccgggaggccagcacgagggggagcggcggggcccggacacacccagcc

SEQ ID NO: 27098 - DNA, 282 bp, Homo sapiens
  chr2:26396681-26396963
  hyper
ccctaggagcagcctcggtcctggggcgggcaggccaccttcgggagaggccggcgggagccgggtctgctgcccggcgtgacccccaaactcccggccctcccccgaatcttgtcccacttcttaataggacctggggcccccagccgctcggctgatggaaccacgcatgggggcccgagagggtacgcccggaggctgcatggagcgaggggaccgtttggggggaggggggtgctgcttggttgggggatgggcggtagccggggctggcagccaggc

SEQ ID NO: 27099 - DNA, 46 bp, Homo sapiens
  chr2:26397014-26397060
  hyper
cgcttccatgaatgctaatggggcccgcggccgcaggctcctcgtc

SEQ ID NO: 27100 - DNA, 524 bp, Homo sapiens
  chr2:26401702-26402226
  hyper
ccagccccatcttttcgcggggctgcttctgtccgcccgcacgggggaggggaggaggaggcggaggcggaggcagaggcccctaggagggcgaaggccggcgggttaacgaggaggcgctgagtgcacggctgggctccacgctgatttctcctaatgaattaataatggcgctcgggcgggcgggggtggccggctgcggaccgcggagagagccgaggggaaggccgtggagggaggaggacggcgactcgcgccgggtggggctgaaggcactgcggggtgactcggtctccaggctgcggcgctctgctccgggagtcagggagacctggcctggccccgtactgtcccccgtcccagcccccgcccctggccctgcgggaggggccaggcgtcttccctgagcatggtgccacttccccagtgttggccttgtttcctgctcagcatttggcagatgcgcctctggcccaactaggatgtttccattttacagacgggaaatccgaagcccagagaga

SEQ ID NO: 27101 - DNA, 179 bp, Homo sapiens; identical to SEQ ID NO: 145
  chr2:26407743-26407922
  hyper

SEQ ID NO: 27102 - DNA, 149 bp, Homo sapiens
  chr2:26521984-26522133
  hyper
gtgcgggttgtgttccgaggccagtgtgggggaaaccagacctagaacgttgtatacggctgataggaccaggtccaccgctgcagcaggctgtgagaggggaaggcacgttcctggctaagcagcgtccaaaactcccgtaataggac

SEQ ID NO: 27103 - DNA, 390 bp, Homo sapiens
  chr2:26915677-26916067
  hyper
agcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctggg

SEQ ID NO: 27104 - DNA, 301 bp, Homo sapiens
  chr2:26916088-26916389
  hyper
cggggccggctggggctgggggcgggggctcccccgagaggggctgggcgccgaaccctgcgctcgcagaaacccgagttcagcctggcgtgtgtgctccgcggggacggaactcggggaggcgtcgattcctggctccggacctgactctccggccgggccagccctaacttggccctgccatgttgcataggcccccagggactccgaagtgtgtgagaggggcagggacgaccggcggaggctcgggcaggaggggtgtggccgggccaggccctgaacagggcgctgagagtgagcg

SEQ ID NO: 27105 - DNA, 30 bp, Homo sapiens
  chr2:27069901-27069931
  hyper
gatcgccggggagcccggggagggagggat

SEQ ID NO: 27106 - DNA, 950 bp, Homo sapiens
  chr2:27070324-27071274
  hyper
tctcagtggagagaacgcactccgggttcgagacctccccgggtgcagatgcgaactgcggtggccccaagtggccgtccactttgttcatgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtgatggcaggggggtcggtgggcttacccctcccgggctaggacatcctcctctcccccttctgtttctgcgtgaggcgcacaaaagggcggggagccgggtgagcctggggcccggccgcaggggacgcggcgggaggtgtggttt

SEQ ID NO: 27107 - DNA, 161 bp, Homo sapiens
  chr2:27071758-27071919
  hyper
ccgagccgggtccctcggctggagcccagcgcgggagcccgccttgcagcatcgatctcagcgggcaccgacgtcgacgccccgggcctggggacggggctgtagtctgagctggagagaagccgggagagggcgaggggaggcctcggttgagaaaagat

SEQ ID NO: 27108 - DNA, 30 bp, Homo sapiens
  chr2:27072330-27072360
  hyper
ccaggatggcagatccgggaccgggctggg

SEQ ID NO: 27109 - DNA, 359 bp, Homo sapiens
  chr2:27072672-27073031
  hyper
ccacgccgggaatcccgtgtgggaggcgctcccccggcctgggggcctgcagacagccacccccccactccggctcgggtgccttctggtgcagcgccgccgcccgccccgcgctgtccacccgctgccgagacgcggcgtggttagcggcgcggagctgccgggcggcgacgcaggtgccaaagactggaggtcgcctcggtgcagcgcgggttcccccgagcagcggctttgtctgccgaggcggccgtagtctaggggctgcagctgtgctttctcagggggagccgtaagggctggtgcggattgtggtcaaattgcggagaagcgggtggaaatgatcccgcaagggtgaggct

SEQ ID NO: 27110 - DNA, 302 bp, Homo sapiens
  chr2:27341792-27342094
  hyper
gccgccagcctcccccgggccgctccacgtggccgctccacgtcgccctcccggctggagccgccgccctggccgggcagagtccggagccagtgccagccgccgccccgcccgccggacctggcccttcgcagctccaccagcgcccccgctgcgcccgcggccggaggggctgcgcgcgcccgtgtgagtgtgcgcgtgtgtgcgtgcgtgagtgcgcatgtgcgcgtgtgcgagtccgcgtgtgctcgtgagtgcgctcgtgtgcttgtgcgggtgtgcacatgcgtgtgacattgtga

SEQ ID NO: 27111 - DNA, 168 bp, Homo sapiens
  chr2:27473190-27473358
  hyper
tgccccagttgggggcgctgctccccagccagccgggctctaggaagcgggagggccaaatgcctcctttaagccggctgcaccggggccctgaccgggcgggagggctgctggagggtggtgcttatcacccgggcttcctcttgaccctgccggctgggccctggg

SEQ ID NO: 27112 - DNA, 482 bp, Homo sapiens
  chr2:27484899-27485381
  hyper
agacaagatggcccacgggggtgggcagggaggtcggacggccgctcagaggggcaggtggacggtggcggcaggcgcgggggccggcggggcgcgttggcggttctcctgccacccccggcccgctgtcccggccgctccgcgcgcctcatttcacacctcgccgcccccggccccgtctgtgcggagccgggaatacccccgctgcccagaccgcacctgctccttcctcgccgccccctcgcttcccggcggccgcccgccccccaggggcccgcaagacccgcgcggagcccggcccatcctcgggccccggcgcccacagctggccgcggctggagggggcgcgcggaggggagcccccggggcctacagagggagctctgaagcctgggcagcgaggcgctcccgccctgggcccggggcaatgcggaccttggcgcaccgggcgagggctccggcccgaccgagcggcagctgct

SEQ ID NO: 27113 - DNA, 30 bp, Homo sapiens
  chr2:27485609-27485639
  hyper
agacaacgaaatggacggagggtagtaggg

SEQ ID NO: 27114 - DNA, 32 bp, Homo sapiens
  chr2:27486442-27486474
  hyper
tgccaatcactgtaccgcgaatgatcatttat

SEQ ID NO: 27115 - DNA, 181 bp, Homo sapiens
  chr2:27486854-27487035
  hyper
acccaggggagggagcgacttacagcaaagtcggtggccgagcctcaagtcgaagcttcaaatgctcaatgttctctcccctcgcacctgccgccactgtagaatgggagggggtgggaagaggattgtgcactcgaagctgtgacagtctgtgaagaggagggtccgtaggaggagggga

SEQ ID NO: 27116 - DNA, 200 bp, Homo sapiens
  chr2:27717830-27718030
  hyper
cctaccccatcccggcgcgggcccggcgacgcgggcagcgcggggccgagctgcgggcggagcgggcgcgggtctgcggagcccccagggctcgagcgggccacggagtctgtccgggagcagggggcgttgcccggacgctggcctgggtccccggtgcgggaggcagtgcggcggcctccgcccgcccctgcagcggg

SEQ ID NO: 27117 - DNA, 296 bp, Homo sapiens
  chr2:27938325-27938621
  hyper
gggggcaggcctggccgagtggctccgtgaagacgcaggcgcggccggagggcgcggggctcgggcaggatcgcgccgccgggccgggagggggctgcgggcgcgcggcggatgtcacggcttacctcagagcccaaattagaaggctgaaaaaatcacagcaggaaataatgtgctgcctaaaatagaagcatcaactgggagagaggccggggagtaggtggcatctgaggctcccgccgcgtcctccccagcggctgcctgacgctgcatcggaggcgcgtgggtggcgcccg

SEQ ID NO: 27118 - DNA, 326 bp, Homo sapiens
  chr2:29033372-29033698
  hyper
gcggggaggggaggccgcagccccagccccgggggcctggttgtctaatcgaagggaagtaaacggccccaacgcaagcctgactgcgagacgtgcccaagggaggtaggtcgaatgaagagggttgtgtgagttttgcgcgggcaggcgggataacggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagag

SEQ ID NO: 27119 - DNA, 590 bp, Homo sapiens; identical to SEQ ID NO: 1940
  chr2:29338158-29338748
  hyper

SEQ ID NO: 27120 - DNA, 296 bp, Homo sapiens
  chr2:29338809-29339105
  hyper
cggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcccgcatccttaaggat

SEQ ID NO: 27121 - DNA, 32 bp, Homo sapiens
  chr2:30142892-30142924
  hyper
ggaggcgcgaattgccgcggacagccttccct

SEQ ID NO: 27122 - DNA, 47 bp, Homo sapiens; identical to SEQ ID NO: 6091
  chr2:30143276-30143323
  hyper

SEQ ID NO: 27123 - DNA, 330 bp, Homo sapiens
  chr2:30143382-30143712
  hyper
cgcgagtagctgagtggctcccggggctgcagcggcggccccgcagctggggagcccgcgcgctggccggtccccatcccggagcccacagctgccgtggaaagcagcagcggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaa

SEQ ID NO: 27124 - DNA, 193 bp, Homo sapiens
  chr2:30143958-30144151
  hyper
ttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctggg

SEQ ID NO: 27125 - DNA, 405 bp, Homo sapiens
  chr2:30144174-30144579
  hyper
cgcaagtttgcagcgtccttgctctcaccggcgcctcggctcctcagagttcgcaggcactggagcggccccggcggcagcagctgagggcgttcagggcaggggcgcccgaaatcttgccgccccctcctcacccatcatcagcgcccgcggctttgggtggccgaccagagggcggccggaaagcacctcggtgccccgcgaccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctc

SEQ ID NO: 27126 - DNA, 113 bp, Homo sapiens
  chr2:30144580-30144693
  hyper
ccccgccccacccgcaccctccaaccaatggcgtggctcgatcggctcctatgcaaatctgcagaggcctcggcattcattgagaaaaggagtgagcccgccccaccctccct

SEQ ID NO: 27127 - DNA, 29 bp, Homo sapiens
  chr2:30453625-30453654
  hyper
cacaccttctgcccccgctgcagaccggg

SEQ ID NO: 27128 - DNA, 445 bp, Homo sapiens
  chr2:30453784-30454229
  hyper
cggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccg

SEQ ID NO: 27129 - DNA, 133 bp, Homo sapiens
  chr2:30454460-30454593
  hyper
gctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgc

SEQ ID NO: 27130 - DNA, 247 bp, Homo sapiens
  chr2:30455560-30455807
  hyper
aaagttcatgcttctcgcttcaacttttcgggccggcgccacagccccgagcgaggaagagccgcccctacgtcagactcttcaccctgcgtgcgctcttctggctcctttctttggaggtcgccagcagcctttccaagacccgggaggaaactgcctttgcagggcccagctcccgaacctaaacttgccgcaaagccccgcatcttctgttagtctccctgcccccatccgtcccagcctggca

SEQ ID NO: 27131 - DNA, 395 bp, Homo sapiens
  chr2:31360195-31360590
  hyper
atttcctcaactccccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgag

SEQ ID NO: 27132 - DNA, 63 bp, Homo sapiens; identical to SEQ ID NO: 6096
  chr2:31360630-31360693
  hyper

SEQ ID NO: 27133 - DNA, 62 bp, Homo sapiens; identical to SEQ ID NO: 6097
  chr2:31360694-31360756
  hyper

SEQ ID NO: 27134 - DNA, 176 bp, Homo sapiens; identical to SEQ ID NO: 6098
  chr2:31360803-31360979
  hyper

SEQ ID NO: 27135 - DNA, 394 bp, Homo sapiens
  chr2:31361296-31361690
  hyper
atagggaaactgactcgagcagcgagagggaggaatccgaggctgtgccaagcaccccgggaggagcacgagggcggagggagtgagcggggagggcgggcccgacagacaggccgactcggagcgagcccaggtgggagtgagcggggctctgagagggggcgctaccgccgcccgccgaccgaaacgctcggtgctgttgcggggccgccagcgccaagccctgggcgcagctcccagaccatcgtgggttggggcaaggcggggcggggcgggagcggtgcactcgggatgcccgccacccccagctgccagctgggacccaagggccggccctcgccaggcggcgctgtgcctgggaggactttcccgctcatcgcgggggctgcacgtg

SEQ ID NO: 27136 - DNA, 464 bp, Homo sapiens
  chr2:31456725-31457189
  hyper
ggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtt

SEQ ID NO: 27137 - DNA, 128 bp, Homo sapiens
  chr2:32852511-32852639
  hyper
caaataaggtaccagcggaggctggtttgtctccttgcaatttctttgtgatcacccctgggatcactcttctacagcgttccgacagtgttccaaaaacttccctgcaccagcggcaggggcagatt

SEQ ID NO: 27138 - DNA, 110 bp, Homo sapiens
  chr2:37571787-37571897
  hyper
ggagaagagggaaggcgaaggacgcgcgttcccgggctcgtgaccgccagcggcccggggaacccgctcccagacagactcggagagatggcaggcggaagacaccggcg

SEQ ID NO: 27139 - DNA, 24 bp, Homo sapiens
  chr2:38301261-38301285
  hyper
gacaagataggagaccggaggggt

SEQ ID NO: 27140 - DNA, 99 bp, Homo sapiens; identical to SEQ ID NO: 6102
  chr2:38301762-38301861
  hyper

SEQ ID NO: 27141 - DNA, 532 bp, Homo sapiens
  chr2:38302369-38302901
  hyper
cgggcccgggggcgcggaccggagctgccgcctccgttgcctcagcagccgctggcccacatgcacagtggccagcaccgacaggagtagcaggagcgtggtctgctggatggacagcgggtttagcggccaagggtcgttcgggctgaggctggtgcccatgctggggacagagaggagaaggcgtgacactcaggggtgcagagacaggagcgggcgccccacgcccctaccccagcctctggggactgagtgccgttgggtggagaggtcggagctgactctctggagaaatggccgaagacgccccttcccatccccaacccactctcccttggagaagagaaggggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataatccatctgaagaggtcgccgggcag

SEQ ID NO: 27142 - DNA, 746 bp, Homo sapiens
  chr2:38302948-38303694
  hyper
cgcgggacagccggctccgagaaggaactgggacctttgcctagggcaagacgtcaacaggaacccgcagcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcgaggccgcacggtgtccccagaaccacgctcggtacaacctgccccggccgctgcgctcgacttgggagcgcgccccgccccgagcgcacgacctcccttccctctccgcgacttgagcttgcttcccggaaagccagtgtagtggcagcggtttgcctcacag

SEQ ID NO: 27143 - DNA, 79 bp, Homo sapiens
  chr2:38755384-38755463
  hyper
gccgctgtgattgggcgaaagatggcgctgggcggatggaaatcctaatgacagtctccaaattcgcctccatctgtac

SEQ ID NO: 27144 - DNA, 57 bp, Homo sapiens
  chr2:39187181-39187238
  hyper
acttcgagtcctctccggcggagccgctgggcaacgtggagcgctccctgcgcgccc

SEQ ID NO: 27145 - DNA, 123 bp, Homo sapiens
  chr2:39187544-39187667
  hyper
gcaaggccaagccgctgagccgctctctcaaagagttcccgcgtgcgccgccagccgacggcgtggccccacgcctctacagcacgcgcagcagcagcggcggccgcgcgcccatcaaggccg

SEQ ID NO: 27146 - DNA, 963 bp, Homo sapiens
  chr2:39893018-39893981
  hyper
ggaagagggagggagcgggcggagagctggggccaagtgcattgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcctttgtacacctgcctgacatgtgtgtcttttcttgacgctgctccccgtgagggggactaaccgtcaaagactcgacttttctcacccgggctccttccttcaagttgtgctccttttggaaataccgtttggaagaaaag

SEQ ID NO: 27147 - DNA, 379 bp, Homo sapiens
  chr2:40678462-40678841
  hyper
cctacatttcttcctcgtctgtctctgccccgccacacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcgga

SEQ ID NO: 27148 - DNA, 185 bp, Homo sapiens
  chr2:40678901-40679086
  hyper
cacacacacacacacacacacacaaatttagaagccgctcgtttgccaaagcagagggaagtgtagccttatgagcagcaaatggaaaatagttcttggtctctgactaaatgccttctgcctgtccatcataagatcctacctggtttggggagtgtgaatggattcttcctccgttcctccac

SEQ ID NO: 27149 - DNA, 432 bp, Homo sapiens; identical to SEQ ID NO: 152
  chr2:40679087-40679519
  hyper

SEQ ID NO: 27150 - DNA, 85 bp, Homo sapiens; identical to SEQ ID NO: 153
  chr2:40679520-40679605
  hyper

SEQ ID NO: 27151 - DNA, 30 bp, Homo sapiens
  chr2:42274603-42274633
  hyper
tccctgcgcccaaaccgccccgaggccccc

SEQ ID NO: 27152 - DNA, 130 bp, Homo sapiens
  chr2:42275776-42275906
  hyper
aggctacaccaaggccgtgtaccgggtccgcctgcccggcggtgccgcggtggcgctcaaggcggtggactttagcggccacgatctgggcagctgcgtgcgcgagttcggggtacggaggggctgctat

SEQ ID NO: 27153 - DNA, 109 bp, Homo sapiens
  chr2:42329336-42329445
  hyper
aagtgcagatgggttcgcaaacgtggactctctagttttgggtctgcagatggggccggccaccacgtgctctctgagttctctttccaagtacagatccctccggaga

SEQ ID NO: 27154 - DNA, 43 bp, Homo sapiens
  chr2:42329493-42329536
  hyper
cgtgagaaccggagcccggggtgacttgcgggggaggggatcg

SEQ ID NO: 27155 - DNA, 86 bp, Homo sapiens; identical to SEQ ID NO: 6114
  chr2:42329751-42329837
  hyper

SEQ ID NO: 27156 - DNA, 2 bp, Homo sapiens
  chr2:42719904-42719906
  hyper
ga

SEQ ID NO: 27157 - DNA, 185 bp, Homo sapiens
  chr2:42720262-42720447
  hyper
agaaggtgtaggtgtcggacatgcggtcgtcgaggcggcgctggcagcagtactcgaggtgcgcgccctccaggccccagtagatcatctcgttgtagaaggagagctcgcacatccgcggcgcgaagcgcagcttgccgtggccgcgcacgtagagcaggatgaagccgaaggcctccgagtgc

SEQ ID NO: 27158 - DNA, 440 bp, Homo sapiens
  chr2:42720772-42721212
  hyper
cgctcctgccctccgctggcccgggggtccctgggctcgagtatctccggcgctgctagtagcgcgccctccgcccggcggtacctgcgggtggccggggagtcctcgccggcgccagcgctgagccccaccggctgggaacgcggctgtgtccgcgccgccgaccctcgcgcccgagggctgcgcacaccgaggccgcggtgccctctcccaagccgcggggccgaccccctgagggctgcgggcgccgaatggagccgccggggcggaatagctccccgtctccggcgctccctgcggccgcgaatccggcggccgccccgccgccgtccagaggcgagaggcaaagtgagcgggttcggaggcggcgaagagccggctcgcggcggcgggggcggggcctctgtgcagtcctcctcctcgcccgccggctccgcgcg

SEQ ID NO: 27159 - DNA, 727 bp, Homo sapiens
  chr2:43019598-43020325
  hyper
gagcttgttgcagaccgggggctggaaggagccccggttctccttcacccaggccctcactcccaggcggcgctccatgactgtcccgggcgcctcctcgcagcgctgtcctcccgccgtcggaggcccgcagctccgcccagccgcctttttaaccagaatcccaagctcacgaggcggagcaaacccccgcgaccccgtggtgggggcttggggcccgcggactttgccccctggtggactttggtctgagcccgccgccctccgcgccactccaggccctggcgagcgcggcggcggcagcgctggggaacggcgtcccgcgccctctgcttctccgcggggcaggggctcggtccccgccaccgtctccggggcgccccacacactggcgcctgcggtggggcctgctcccggcggaggacaaagaatccagacccttcctggacgcttgtccccagacgttccttccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactc

SEQ ID NO: 27160 - DNA, 203 bp, Homo sapiens
  chr2:43037974-43038177
  hyper
gacatccacccactgcgtccttctagtgctcttcttaggcgggtcctgtaactgcacctagtcccggaccacaggagggcggatggaggtggcgaggcgctccactgtggcggggtccctagctggccgtggggatcgaatattctacagggcacttcattctacagtgtgagcccgagctcccggtgcggagatgaggcctg

SEQ ID NO: 27161 - DNA, 51 bp, Homo sapiens
  chr2:43448422-43448473
  hyper
caccagtgcaatcatcgttaacgtgaaacagctgcccgaggcctggcgtat

SEQ ID NO: 27162 - DNA, 318 bp, Homo sapiens
  chr2:43451091-43451409
  hyper
aagtcccaaactcatcggagtcctaacaaagtttaagtgttttttttttttttttgttctattcgtatcacaactgccctgttgtgaatattttgttcaacagaaaaagttcgacttttttgctcaaaaagaatgaaacttcgtaataaaaataaaaaaaaaaagacaagaggaaaccgaaaaaggaggggtgggggcccctcccggcacagagttcgagtccaagtgctcggtcgggcttgcagtctgcctagggcccatgtcaccccccccactcccgtgcccccagcaagggcgagatggcgaggggtgtcctcc

SEQ ID NO: 27163 - DNA, 152 bp, Homo sapiens
  chr2:43451694-43451846
  hyper
ggtcgcgctgggcggcgccggcggctgcgcggggggcgccaggccctgctgctgctgctgctgctgactgcggtagtaggcggcggcggccacggcggcaaagttgtgggtctggatggcgagcggcgtgatgaggctgctgagctccggac

SEQ ID NO: 27164 - DNA, 552 bp, Homo sapiens
  chr2:43451891-43452443
  hyper
cgcacggggcccccggcgccagcaggtcctcggcgcccccggtgccgtacagcagagcggccgcagccgcggccgccgcggaggcgcagcatgtcggggcgcccgagggcgtggaggccgcggaggccgaggaacaggaggaggcggaggaggagcaggacgaggccgaagagcaggagggcggcggcggcgtgcgcgacgtggggctgtcgagcagcagcggcgactcgaggccgcccgggggctgatggtggcccgacgggaagcccgagaagctgaggctgtggtgcaacttgggccgcggctcccgcgggaagcccaggtgcaacgcatcgcgcgtgccaaaggcacgcaggtccccggaggcgccccccgacggcgcgggccgccgctcgtccgcgttgtggatgaagtggcagcgcggcccataggggcagaagccgatggtatgaaaggtgcggcacagctcggtcttgtacttcggatggcgagtcaggctgcgcagctcgtggaagccatgcgcgaactggcacttttcgccgtacttgcacg

SEQ ID NO: 27165 - DNA, 61 bp, Homo sapiens
  chr2:43864669-43864730
  hyper
ggctgactcgggatccgccgctgcacctcccgccacagcccagagtcggcccccaagtctg

SEQ ID NO: 27166 - DNA, 119 bp, Homo sapiens; identical to SEQ ID NO: 154
  chr2:45028940-45029059
  hyper

SEQ ID NO: 27167 - DNA, 188 bp, Homo sapiens
  chr2:45029183-45029371
  hyper
cgacccggcgccgactctcctcctcttctccctgcgagggcccgcgccgcccgggcccagtcctgggggatagatccctcggggcccaacggctgggccaccgccggtctccggccactgctgcgaggacaggcgctgcctaactaatttctcctctaagggggctgtgcgtgcgtctccttcccaac

SEQ ID NO: 27168 - DNA, 118 bp, Homo sapiens
  chr2:45029987-45030105
  hyper
cggctgccccgtccgggacccgctaattacagggattcggtttccccgctctgaaggaatgcattacctgcagcaaaggaggcgcggcctctcaggaaggccccgagaggaagctgaa

SEQ ID NO: 27169 - DNA, 37 bp, Homo sapiens
  chr2:45154244-45154281
  hyper
gctgcagagtcccagcgccgaacggttctagcttccg

SEQ ID NO: 27170 - DNA, 86 bp, Homo sapiens; identical to SEQ ID NO: 156
  chr2:45155125-45155211
  hyper

SEQ ID NO: 27171 - DNA, 636 bp, Homo sapiens; identical to SEQ ID NO: 157
  chr2:45155355-45155991
  hyper

SEQ ID NO: 27172 - DNA, 820 bp, Homo sapiens; identical to SEQ ID NO: 158
  chr2:45155992-45156812
  hyper

SEQ ID NO: 27173 - DNA, 205 bp, Homo sapiens
  chr2:45156832-45157037
  hyper
cgcggccggccccgaaggcgcgagggacagcgcggccggcggtggagcctcactcaggcacggagcccacagagcgaggctgaggaggactccatgctgttgtccgtcgggaaaccggactactctggggcgcgctggagccaccattctgccagcagccggggaggggccgcgagggctcccaagtggacggaagtaggcgacc

SEQ ID NO: 27174 - DNA, 426 bp, Homo sapiens
  chr2:45157254-45157680
  hyper
gtatgggatttttgccgtcggagcacctcgtatccggcgcgcgggcccagtgtgggactgcggctgggagcccgggccctccgggagtgaagatacctttggaggtgagacggcctctctagcgcgttgacactgttgatggaagggattaaaggggtatcaggttattttaatttattgttgaagatgatgactgccccctccccgatccgcataccgtcctcactttcccaccccaaccctagacccgacaacaccgttcagccctttgccccgggcagcggaaatggttagcttcctctaggagtttctgctgaggaaggcgcaggcaaccctagtcggcttagagagagacaaccgcacgcgatcaccgagcacgatttctcccaacaaaaaaactaacaataatagcgatccacacactca

SEQ ID NO: 27175 - DNA, 779 bp, Homo sapiens
  chr2:45159488-45160267
  hyper
gttggggtcactcctcgcaggcactgtggcttttgtctgcatctggacaacagggtgtgcacccgtgtattcaaataattatgcctgtgggcacttctttattcctcaaattcctgttagtgttcctttaattctcccgtagtgttcctttaattctcccatgtgtattcggtacgattgcctgtacgttccaggcatagtcaggtgactcagcttgagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctttgggaaggataggaccatcatctagggcgtctctcggtggactgtggctgggccgggctgaatgggcgggcggaggtctcgaggtcgtctcctggctctcgattgctcccatcacccaagccacctcgaggtcgagtgcgccctggggctatgtctggggaggtcatggcgtctcggggcgaatgatatgcacgttttggggcaaaactctcctaggcctcgcaggagcagctgtatttgtaacttggaattggcctgggcccgcctcccttggcccctcctccagctcctacctcaacacgcagcgctcagcgggctgccagagtgagcttcccggaccacccccaag

SEQ ID NO: 27176 - DNA, 476 bp, Homo sapiens
  chr2:45160538-45161014
  hyper
gtagatgtgttttctcgtgagaatgatgcagacttactgctgacttaaggtcagtttgtttgaaaagggagaacgtcagtccgatggtcggtggttgtgtctctcctgagcattcgtacaaagtgaagccacctcccctccgccatgcagtctcccagaccgggtcaaaggacccaggctccaggtcgctgaggcctggagggctgaggcccttgctgtgcgccctggtgctctgatcccaaggcccaagctgccccggtacccacttagggtcagggtggaaagcctacgtgggaaagggggacctggaggactacccccacgcccatggcagggtggagtcccgaccttggcatattggacctactcacttggcatctccctgccccgaccccgtctgggatccgtattggcagcgacgaggaagggaggaatggtaagggagttgggtcggtacaggacggaagtgaagatgg

SEQ ID NO: 27177 - DNA, 112 bp, Homo sapiens
  chr2:45161221-45161333
  hyper
gagaggatggggaaacgcgcgccccaagagcaaaagcaaacagctgtggaggcgctgcccgcggctcaggcttcccaacaggttagctatactgggatccacccggcatttc

SEQ ID NO: 27178 - DNA, 207 bp, Homo sapiens
  chr2:45161334-45161541
  hyper
caggaaggggtggggggaagacagagcgagagggggagagaggctcacaagaggacagagggagggagggaaagagagataggagccagagagcgcaccgcgcggcttaaaaggagagacttactaatgaatatttatccgccgctgctccgtgctcccggcttcccttacctttcggcaggtaagatcctccctgtgccccagccc

SEQ ID NO: 27179 - DNA, 439 bp, Homo sapiens
  chr2:45161597-45162036
  hyper
cgttggtgggggtgggagggcggctctactctgcgttcactttgggtgcccaggcatgcgaccctgcacgactaggaaccgcgtgcgtgggctccatgtgtggaatgagtgtgagcatgtaagagtgtgtttgtgtgtgtgcgagagagagacagagagactatgcgcccgcaagcgcgcgcgcgcgcctgtttgtggcgcgctctggaaacattttccgacttttcactcggacgccctggatttctcgcctttgcctttctctgcttcccctccctcttctctcgccctcccctcccccacccaggtctaccccaccctaccccactcctaccccggctgctgaggcgctcttctgccggctattgtacggctggcgcgggctccccctggccacatcccgggcctctcacacaagaagaatagttctgtttccgcc

SEQ ID NO: 27180 - DNA, 198 bp, Homo sapiens
  chr2:45162037-45162235
  hyper
taaacccccacacaaaggctgcccggccaccgggtcccctgtcccccttcccggggacttcggcttttgaggtgctgctgcgcgttctttctccctccccctctcagggcgccagggcccagaccaaggagctaagagtgatcgggacttgggggtaccgggtggaactccttgggggccgcccgccaggcttcctgg

SEQ ID NO: 27181 - DNA, 628 bp, Homo sapiens
  chr2:45162443-45163071
  hyper
ggggtcggctggctccggagttgcgcaaggtggacacacaaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagcagtgctgcctctcctcgccgcctttcatgccgcggccgctccttattcttgtgtctcggcctctcccggccccctcggacaaaacccccagagcccggccactctcttcccgctaaatccccttcggggtcagtgctctaccagcaccgggccgcgcgcctctcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagcccc

SEQ ID NO: 27182 - DNA, 322 bp, Homo sapiens
  chr2:45164822-45165144
  hyper
gtttactgtccggggcgacaattgcttggagcgccagtccccggaggctaaggcggggggcgggggtgcggggagggagcagttgttgttgttgtttttcaaaggaaagtaatcggggtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcgg

SEQ ID NO: 27183 - DNA, 286 bp, Homo sapiens
  chr2:45165500-45165786
  hyper
ccaagtcccagatcccgcaatcagagcggccagagagcagagaagagacctagaggatctgcaagctgacctatccacccgagactctccgctctgagcgaccccagggtgcaggcgccctccacgcgccacctcctctagcggtcccccagggtcccttcccagtcctcgcactgccctagggcttgcttggttcccagaccagcgtggaaggccgctgggccccggaacccaaggtccctctgcttctgctccactccccagtgcccagcgcctgggaatttgg

SEQ ID NO: 27184 - DNA, 73 bp, Homo sapiens
  chr2:45166113-45166186
  hyper
gcgcacaaagctacacgcctctctgcagccctctgccctgcttcgcgttccggaaccgcggtcgccacccaag

SEQ ID NO: 27185 - DNA, 30 bp, Homo sapiens
  chr2:45166483-45166513
  hyper
gcagtttcggggtcacgagctgctttcaaa

SEQ ID NO: 27186 - DNA, 93 bp, Homo sapiens
  chr2:45168959-45169052
  hyper
tctccctctctgtctcgggttctctctctgcgcgcgcgcaccgggccgctctcctacctccctctctatgtggctgcgcgggtgtgtgtgtgt

SEQ ID NO: 27187 - DNA, 232 bp, Homo sapiens
  chr2:45169316-45169548
  hyper
gctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagac

SEQ ID NO: 27188 - DNA, 574 bp, Homo sapiens
  chr2:45169549-45170123
  hyper
ggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctag

SEQ ID NO: 27189 - DNA, 45 bp, Homo sapiens
  chr2:45170168-45170213
  hyper
cggagaaagtttccgcttgtccgggacgcgcggaagagggggccg

SEQ ID NO: 27190 - DNA, 318 bp, Homo sapiens
  chr2:45171246-45171564
  hyper
tccccacttttccaccgccagctttcctattttctctaccctcggtcctgcgctctgcgctggcatccagagagcaaagtatgcagttctacccggagactggccgggcggtggggaacccgcagctcccggtgtgtgtttgagggagcagggacggggttactaggggaactcgaccggtcgcggggcagccggctcagtttgaagagccccagggactgcggagggaagaagcgcccggctcctctccgacttctgcttctccagggcttggcgtactttgtcgcttgcacccaggcctccccaagcggccgggct

SEQ ID NO: 27191 - DNA, 88 bp, Homo sapiens
  chr2:45171836-45171924
  hyper
cgcgcagacaccggcacctccatcctctcggtaacctccagcgactcggaatgtgatgtatgatagccaaggccgccctcctccctct

SEQ ID NO: 27192 - DNA, 264 bp, Homo sapiens
  chr2:45172185-45172449
  hyper
caaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgtt

SEQ ID NO: 27193 - DNA, 536 bp, Homo sapiens
  chr2:45176593-45177129
  hyper
gcctgagactttgggcggggagacggttcagtgaggcagcgggaaggcccttgcctgggcttgccgagggggctgtgatggtggagtggcccccaggttcttctgcaaggagaataggacagcctggtacattctcgacccagcgcatcacccgggaccccggagctcgaagtccattcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacgcgcgctgaggcccccacggcttcccaccgctccggccctttccggccccagctgagctgaagctccctggccccagtgtgcgggccccggtggccgtctggcccgagggagggcgggggcaggcgaga

SEQ ID NO: 27194 - DNA, 700 bp, Homo sapiens
  chr2:45179296-45179996
  hyper
aaggcagggtccagacgtgagggggagcgcggcggggcgtgggggacgcggcccccggggcaggggtccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccggcctgtggctgggcccgcactgcctttggtttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgtgtgtctgagctgaagcggctacgcttataccgggaggtgaaacggaagctcagagag

SEQ ID NO: 27195 - DNA, 713 bp, Homo sapiens
  chr2:45181520-45182233
  hyper
aggactgagctaagacgccagaatgggttaaaggcatttccaaggaggaatggtgaggacttgatgaccagctgcagaccttataggctgccctccgaccttcagcttcctgtgcgctcacaattcacgtgctcacacgtgctccttagaggggtctgtcggtggacgccgcgaaccaatcaaacccttgcactttgttccaaaacccattccctaccagaatgggagtcctgtagggccaggtctcctcccatacccacccatttcggcctttgttctactgcacaataacagctggcactggggtgcgggaggacggtgaaagctcgagtcccaggctccaaatcctccaggagtaactggggtgacccgaggagagcagcgcactgggtgagtggaagcgtggcccgtgagaagggtaccgagggtcagaagtgtcgcaagggacccaggacgcgcgcgcctccgaacccctgagtcttcgcaggctctgcgaaacttcagtgcgcgcagcctcctgcacaccgttttcgcgcgacctccttgcctcggtctccaggggtcaagccaacccagcgcgggaatgttccatttgcccttttgggacattcagagaggcttttccgggctgccgcggcgcttccacgcagaggaggcgtcggcttccaggcagcttggcgatcttgttattggacacgcgagagtttagagac

SEQ ID NO: 27196 - DNA, 15 bp, Homo sapiens
  chr2:45231136-45231151
  hyper
attctgattttatcc

SEQ ID NO: 27197 - DNA, 123 bp, Homo sapiens
  chr2:45231244-45231367
  hyper
cgcccggccgcggtgccctggtcgctgagggacgcggtcagtacctaccgccactgcgacccgagaagggaaagcctcaacttcttcctctcggagtcctgcccactacggatctgcctggac

SEQ ID NO: 27198 - DNA, 341 bp, Homo sapiens
  chr2:45231852-45232193
  hyper
gtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtacccgccctcggcacaagctctctcgtcttccacttcgacctcgaggtggagaaagaggctggcaagggctgtgcgcgtcgctggtgtggggagggcagcaggctgcccctccccgcttctgcagcgagttttcccagccaggaaaagggagggagctgtttcaggaatttcagtgccttcacctagcgactgacacaagtc

SEQ ID NO: 27199 - DNA, 30 bp, Homo sapiens
  chr2:45232401-45232431
  hyper
cacatgagggcattacggggagacggcaag

SEQ ID NO: 27200 - DNA, 323 bp, Homo sapiens
  chr2:45233446-45233769
  hyper
caggctgtgcagggacggcagcccagggggcggcgggctgaggagcagtgcggggctggatgatgagtggtctggcgtccccgatggagtcttctcatcctccgagctgcctaacaccgacttgccgctgccattcagcgggttgtggctgttagaattggagttctcgttgttctccctgcaagtgcgggagcaaagcagcggggtcagcagggacatcgagaccacccagcgccatctcagtcacagtcagagccagccaccagcctcgggagacagatcccgggcttgtggcctgcgggtgttttcggtttctaccattt

SEQ ID NO: 27201 - DNA, 1411 bp, Homo sapiens
  chr2:45235475-45236886
  hyper
ctgaattgctctgcccgctttagacaaatccctgctcgccgggtctccggcatagaaaggcctaagcatcgtccaagtcaggccgggctgccgctgggctgtggccgggcctgggggcccagtttaggcctctccgggggaccggcagaagccctgcgaacccctcccttgggccccggggagctggcgccgaagaaggtctacttactcgtacctttccttggcctcggccgcccggtcgcgctgccgccggttcttgaaccagttgctgacctgtgtggtggtgaggcccgtggcctccgccagctcacgcttctcgcggggtgaagggtaggggttgtgcgcgtaccactcgcgcagcacgctgcgactcttttccttgaagcagtagctggtctcctcgccgtcccagatggagcgcggcagcgggaatttgcggcgcacgcggtatttgcccacggcgcccaggggtcggccgcgcagcttctccgcctcgatgtagtgtgccttgagccacagctgctgcagcttggcgtggttgtgcggcgagaactggtggctctccaggatcttgtagagctcgcggaagttgccgcggtggaaggccaccacggccttggccttgagcacgctttcattcttgtgaaggtgctcgcaggcgggcagcgaccacaggaagcggcccagccgctcgatgttgccgccctgctgcagcacctcgcacacgcacgccacttgctcctgcgtgaagccgaaggtgggcagcatggacatggtgccggctgcgtccccgcccgcccgcgcgcgccctcaccgggccgcgcggtcccgcatgggagcttcctcgccgggccgtccgggccgagacgcgggcggggctggccccctggcccggcactggcccccggtgagccccgagtcactgccgtacgtccccgcgccggccgcgggtcccacgaagctccgaaccccaacggcccgcgcgcctggcccaagccctcgcccaagcccgggggccgcccggggcgccgctccgcatgctccgcgcccgcccgccgttccctcgctcgcttctcactcgttctccctcccgtctagctggctctcagctttcttaataatattattctaagcgggcatgaggcgcggcggcccgcgccctgattggtccggttatctgacccggggcctgccagcgccagacaatagtcggagtcaaattattcgccatggagacgctgtcagtcactggtaacccgagcctcggcgggccgggcggctccccccggccggctccgctgacagatcgccccgctccgcgcagaactgagggcggctctactggagcctggggcgctctgagagcctgggaggcggagaggggccgggttggggccggcggcggcggaga

SEQ ID NO: 27202 - DNA, 147 bp, Homo sapiens
  chr2:45237178-45237325
  hyper
gggcacattctaccccggcgcaggccagtgggatgggagagtttggacgtgctcgggtgccgcccaaagacttggctttttctgctgacagcgccccacccccatcctagaaactctggactcagcggtcctcgagggaaaagggga

SEQ ID NO: 27203 - DNA, 44 bp, Homo sapiens
  chr2:45237645-45237689
  hyper
gcagggactctaggacggtggtggggcttccccggtgggtggtc

SEQ ID NO: 27204 - DNA, 253 bp, Homo sapiens
  chr2:45237690-45237943
  hyper
gggaggagaacggaggcaagattcccagtcctcccgcttcgccgctggggatcggctcggctcctggccactccagcctgggaaccggctcgctgagctccgggatgaggtgctttaaaagggggtcctgttttttgcttctttgtcagggtgccaatggaaacatgtggtgctggtcctgtgggagaagggctcgcacaaaggtgggagaactgaggatgggtgtgttcttgctctacgttttgaaaagccc

SEQ ID NO: 27205 - DNA, 30 bp, Homo sapiens
  chr2:45240323-45240353
  hyper
tccagcctataaaggcggcagaaatcccct

SEQ ID NO: 27206 - DNA, 39 bp, Homo sapiens
  chr2:45240592-45240631
  hyper
tccccacctgcccctcgtacctgccggtctgtcgggtcc

SEQ ID NO: 27207 - DNA, 406 bp, Homo sapiens; identical to SEQ ID NO: 1963
  chr2:45240763-45241169
  hyper

SEQ ID NO: 27208 - DNA, 551 bp, Homo sapiens
  chr2:45241232-45241783
  hyper
cgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcccaggagggagaggagggagaggacgcggagagggcccgctggttcttccctcctcaccccagcactgacccgcctgtgcgctggcacggagggctcgaaaatcggggcgcgtccgcgaagagcgagacctcggagacagacacacaacccagaggtgcactaggttgccagacggtctgatcacaggattcttggggggatagacgctggcttttctccatcacacgtttcccctgcaacgtctgggtgcccaggaaatgtttgaatggatgcctgaatgaccaatcgggtttgactgacagcaacagctgggaagtgacccggccaataggagaa

SEQ ID NO: 27209 - DNA, 66 bp, Homo sapiens; identical to SEQ ID NO: 6161
  chr2:45395854-45395920
  hyper

SEQ ID NO: 27210 - DNA, 291 bp, Homo sapiens
  chr2:45396160-45396451
  hyper
gctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaaaccatggcagcattgcggctccggcgggcgggctctgcgcggggccccaccgagctttccgggagcctctcccgcagccgatgggcatctaggggcgcagaacgaagagtgggcgccgaaacgggtgtaggcgctg

SEQ ID NO: 27211 - DNA, 310 bp, Homo sapiens
  chr2:45396672-45396982
  hyper
ccgccaccctctgggcgaacggaatggcacccgcggagacgggcggggacgggcgaaagcgggtttgctccgacccgaagctgagcccgggttggagggcgagaccgtaggcgagaatggccgcgcgggctgggagacccgggccggtatggagtgagtggagccgcccgaggtagggtagttggggatggtagttgtgaagacagtcggagtctagctccgggcagacgaaacaccggggcgcgccagggtccgtttcctccttctctctgctttcccaccagccctgtagatacggagccagcagtcg

SEQ ID NO: 27212 - DNA, 33 bp, Homo sapiens; identical to SEQ ID NO: 6164
  chr2:45397223-45397256
  hyper

SEQ ID NO: 27213 - DNA, 37 bp, Homo sapiens
  chr2:47596757-47596794
  hyper
tgggctggggggcagcggcccccggccctcggccccc

SEQ ID NO: 27214 - DNA, 299 bp, Homo sapiens
  chr2:47748224-47748523
  hyper
gcatggagatgagctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaagaggaagttgcccaggcggtagagcccctgg

SEQ ID NO: 27215 - DNA, 40 bp, Homo sapiens
  chr2:47748726-47748766
  hyper
gtcggcctccgagagcgcggagccgcggcggaaggtggcg

SEQ ID NO: 27216 - DNA, 738 bp, Homo sapiens
  chr2:47796750-47797488
  hyper
aaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagcccc

SEQ ID NO: 27217 - DNA, 474 bp, Homo sapiens; identical to SEQ ID NO: 1966
  chr2:47797489-47797963
  hyper

SEQ ID NO: 27218 - DNA, 1069 bp, Homo sapiens; identical to SEQ ID NO: 1967
  chr2:47797964-47799033
  hyper

SEQ ID NO: 27219 - DNA, 98 bp, Homo sapiens
  chr2:47799123-47799221
  hyper
cggctgcgggtgctcctctgctggacacaagccggctttgccggggccacaaaagttctggcgtggaacaccctcagtacaggcggaaaatcatcctc

SEQ ID NO: 27220 - DNA, 119 bp, Homo sapiens; identical to SEQ ID NO: 6170
  chr2:48982582-48982701
  hyper

SEQ ID NO: 27221 - DNA, 145 bp, Homo sapiens
  chr2:48982753-48982898
  hyper
cggctgcagcagcagcagcagcttcagcagctgcagcgccgagaaccgctgcttcatggccggcgaactgggcttctgcggcttgccagtgtcttggacggcctctgagtgcggcccgcacccctctccccgccccttggctgcc

SEQ ID NO: 27222 - DNA, 155 bp, Homo sapiens
  chr2:50573484-50573639
  hyper
cgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacc

SEQ ID NO: 27223 - DNA, 141 bp, Homo sapiens
  chr2:50573691-50573832
  hyper
cgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtg

SEQ ID NO: 27224 - DNA, 247 bp, Homo sapiens
  chr2:50574097-50574344
  hyper
ccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagcccc

SEQ ID NO: 27225 - DNA, 54 bp, Homo sapiens; identical to SEQ ID NO: 163
  chr2:50574631-50574685
  hyper

SEQ ID NO: 27226 - DNA, 121 bp, Homo sapiens; identical to SEQ ID NO: 164
  chr2:50574738-50574859
  hyper

SEQ ID NO: 27227 - DNA, 57 bp, Homo sapiens
  chr2:51259509-51259566
  hyper
caggtctggatgctgcggagcgaggtgcttttacctttgcatcgtccccttgcaggg

SEQ ID NO: 27228 - DNA, 71 bp, Homo sapiens; identical to SEQ ID NO: 6177
  chr2:56149951-56150022
  hyper

SEQ ID NO: 27229 - DNA, 206 bp, Homo sapiens
  chr2:56150227-56150433
  hyper
aaagtggcatttccacgcctttctctgcgcacagctttgtttaaaagtcccaggttgtgtggaggggcagcccaaagcgactgattctcttttgtcttatcagtctgggtccccgacacgctaccttcggtttcaggctgcctaggaccggaaccagggatcgcaccgcagcccaaggtaccagtttcgggcgggcggcctggccc

SEQ ID NO: 27230 - DNA, 383 bp, Homo sapiens
  chr2:56150770-56151153
  hyper
cccacctcactctcccgcgcgcggcccagtgagtactgggctcgctcggggcgaccccccgttgggggctcctacctgtgcggccgcgctgcgctccgggcccgggcagcgaggggagtgcgcaggggagggcagccccgtgggtctgatctggcgaagtccggcagcggccgcggcggcaggaggaggaggagaaagggagggaaagggggagggcgaaggggggcggaggagagagctgagggaggcgcgagcgctgagcccagcgttgcgagcccggcggtagagcgcgcagcgcagcgaggtccgcgccccctgctccaggggccctctttgccgcccccgcttgccctcccttgccagctcctcgtttcccagactcg

SEQ ID NO: 27231 - DNA, 113 bp, Homo sapiens
  chr2:56411049-56411162
  hyper
atgcgggagctgctgcgggttacgggtggccccagctccaggctcctcctccagccggtcccccaccctccaccccttctcgactccgctctgcaaatcgaaggctttccgga

SEQ ID NO: 27232 - DNA, 63 bp, Homo sapiens; identical to SEQ ID NO: 6180
  chr2:56411703-56411766
  hyper

SEQ ID NO: 27233 - DNA, 98 bp, Homo sapiens
  chr2:58655439-58655537
  hyper
ggagcgcctgggactcgagacggcggcaggttcaattagctaaacaaagaaatcatggcggattgtttacatttggcagcgcccgggctgcgccgacc

SEQ ID NO: 27234 - DNA, 199 bp, Homo sapiens; identical to SEQ ID NO: 6182
  chr2:58655998-58656197
  hyper

SEQ ID NO: 27235 - DNA, 39 bp, Homo sapiens
  chr2:60784424-60784463
  hyper
tttttatcttgcccgcggaggagacgccccaggacttcc

SEQ ID NO: 27236 - DNA, 80 bp, Homo sapiens
  chr2:60796529-60796609
  hyper
tgcattttgccttgccgcgtctcttcccacttccaacctacaccctctccaaatcttgccccatcctctccatcgctccc

SEQ ID NO: 27237 - DNA, 20 bp, Homo sapiens
  chr2:60796669-60796689
  hyper
acgcacgcacacacacactt

SEQ ID NO: 27238 - DNA, 304 bp, Homo sapiens
  chr2:60797038-60797342
  hyper
tgtagtggaaatctacgtgggtttgcaggttcctgcttttcttgtgtagagcctccggtgccctccacctaaccctgccccaatgcctcgggtcttttttgaactaatgctgtgcgtctccgcaatctgcaattactttggatatttctcaggagctaaacgcagcctgaatttcgtggcgcgtgcaaaaaaaaaaaaaaaggcgaaattaacaaaaccccaccaccgcgctgttgtttttttctggagtttttttttttttttttttttagttcggttcagaagcaaacgctacctagtttct

SEQ ID NO: 27239 - DNA, 294 bp, Homo sapiens
  chr2:60962755-60963049
  hyper
cagctcttggcggtgcgccacaggaactctccggtggtcgggttgtagatgaagagcttccactcggcgaggctctggttgagggactccttcttcatcgtgtgcgcgcggacgacgaggggagcggcggccgcggggacggaggcggcgagggcagcggggacgggggcggcgagggcagcggggacggaggaggcgagggcagcggaggcgcgtcccggctccggcggcgcagcccggcgacggcaggggagggtgggacgaccgagaacacctcctcgttactgggagtac

SEQ ID NO: 27240 - DNA, 91 bp, Homo sapiens
  chr2:62798343-62798434
  hyper
gtgtcaggttgtccccgagtgcgcttgccgtgagtttctgccgcgtgactcacccgtgtccctcgctctcagccatcggaacagcagaagc

SEQ ID NO: 27241 - DNA, 615 bp, Homo sapiens
  chr2:63275877-63276492
  hyper
ggcgcctttcctcggaacctaaggaaggggtatatttcgttgctttctttaaacctcagcacgatcacagtggctccgagccgcgggcggctgaccgcgggcctcgcgggctactcctggtaggggcctgcgcgagcctaaggtgtgtccccgcctgggttagcgctgcgctctgcactgtttcttttcctcttaaagcttctttctcactcactctctccctccttctctctctcattttttccccatttctctcgttcttttattcagctttctctctttctctcccttttgtgaatgggccgcggtgtctttgttctgtagagaagcgcccgtgtcgctgacttttgtgaaccagagaaggatcttgtaaaacctccttttctccttcgtacgcccccactcccacccctcctcccctgcctctttgattagatgttccctcatcgtcaaaaaaaaaatgtaatttcgttggtctggcggccactttctttgaacattagctcgctttcagctccaacttcaattagaaggagttgattttgagagatcaacaaaagaaccgaccaaagccttattaaaggtcctaagaagatctcccgggtcctttgagaa

SEQ ID NO: 27242 - DNA, 319 bp, Homo sapiens
  chr2:63278703-63279022
  hyper
gcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcag

SEQ ID NO: 27243 - DNA, 699 bp, Homo sapiens; identical to SEQ ID NO: 166
  chr2:63280952-63281651
  hyper

SEQ ID NO: 27244 - DNA, 66 bp, Homo sapiens
  chr2:63282650-63282716
  hyper
cgccgcgccaaatgccgccagcagcagcagagcgggagcggaaccaagagccgcccagccaagaag

SEQ ID NO: 27245 - DNA, 224 bp, Homo sapiens
  chr2:63283882-63284106
  hyper
gcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgc

SEQ ID NO: 27246 - DNA, 1052 bp, Homo sapiens
  chr2:63284558-63285610
  hyper
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctggaggccaaaggatgaggcgggaggacttggcaagagaagtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttc

SEQ ID NO: 27247 - DNA, 227 bp, Homo sapiens; identical to SEQ ID NO: 168
  chr2:63286358-63286585
  hyper

SEQ ID NO: 27248 - DNA, 55 bp, Homo sapiens; identical to SEQ ID NO: 169
  chr2:63286693-63286748
  hyper

SEQ ID NO: 27249 - DNA, 244 bp, Homo sapiens
  chr2:63287082-63287326
  hyper
ggcggcgggaacgcggaaggttccctccacccccaccccaacccccacccccacccccgggccggccacctgttgacaggcaggttctctgagaaccgacttcagctcgcccttctgtccaggaagtttgttcggtttgggtttgggtgttcgtgacacaatcggagcaattagaattgaagcaacttcaggagatttagcaacccgcgaaaatttagcaacgttcagacgtcaacagttttct

SEQ ID NO: 27250 - DNA, 143 bp, Homo sapiens
  chr2:64455493-64455636
  hyper
ggcatgaatattcatcgggggcgtggccccgccagcgcgcagggctccaagcagctgcgactagcggaaagcgcgcgccagctgcacgcagggaaacagttctcattttgtgtgctcggctgactgcacgtccagcctcgggc

SEQ ID NO: 27251 - DNA, 110 bp, Homo sapiens
  chr2:64836323-64836433
  hyper
tctggccgccgggcccgggatgccaggatgcggggggccggggctgccggtgctcttgggggcagggggaagctccgctccctctacagaggacaaccgccccgccgccc

SEQ ID NO: 27252 - DNA, 163 bp, Homo sapiens; identical to SEQ ID NO: 6195
  chr2:64836470-64836633
  hyper

SEQ ID NO: 27253 - DNA, 7 bp, Homo sapiens
  chr2:64836746-64836753
  hyper
cgcggcg

SEQ ID NO: 27254 - DNA, 148 bp, Homo sapiens
  chr2:66653040-66653188
  hyper
ctgtctcctttcctccgtctcccggtcctctcccagcgtcacccctcactacctatacccccgcgccctacccccacctggggcgctgggttccacgcctcctcaagaggtgtgagcgcccgcgctgggcgcccgtagcgcggccctc

SEQ ID NO: 27255 - DNA, 535 bp, Homo sapiens
  chr2:66653399-66653934
  hyper
agtcctaaaaggaatcgtagagcaattgatctcggaggagatgagcgcaccccggggctcattgctgcccctgaggaagagccgtccaggaacggaggcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggatcgcagtcaaaactggcggggatggggcacactggtgggagaggggaccttttcaccttttgctcttcccaggggacacagtcccccaaacctacgtccctgcgccaaaccaggtgcgagcaaactccgcggaccccgcagctggaagtgcatcctgccgggacccccacc

SEQ ID NO: 27256 - DNA, 226 bp, Homo sapiens
  chr2:66659963-66660189
  hyper
tctttcaaggcaaagcgcttctgaaggttttgggagaacgtgtgtcagcccttcaggcacacagggtgccagtacggagttgggggcggggaagggtgcagtgcaggcggctgggaaggctcatctgctcggctttatggaaacgctccactgttgggggcaaccaaccccgcgttgactcctgcgaagtgctaaaggaagcgatagatgtcgcctaaggagacta

SEQ ID NO: 27257 - DNA, 101 bp, Homo sapiens
  chr2:66660603-66660704
  hyper
ataattgattttccccgcagccaatgcgcggcggcctgggcgggggcgcctcctgattggccgagcactcctccacggctgcctaccgagatttgggtgag

SEQ ID NO: 27258 - DNA, 318 bp, Homo sapiens
  chr2:66802623-66802941
  hyper
atcttttggggatttcgaaaaacgactcggtaggaaacggagggaggcggaggcgcgggagtgggggaaacccccttattatccagtgtcggaactggctcccttaatctgatgcttaaatatttgatgtggaaaaattacccataaaattagttactaacaatttcaaattgaaatcacttatcgaattataaacgcattaaagctgtatggatggtattaggagttcctcgggaggcagcgggtgtctccttgaagtgagccaggcgggcgagtttcgccccggggaaaagagcccccagccgagcccgggggcaa

SEQ ID NO: 27259 - DNA, 157 bp, Homo sapiens
  chr2:66803441-66803598
  hyper
gaccacagctctggtcgcggggggtggcgggggtgggggggctgcacgggcgcctgccttaccctcctgccctcacccccatctgagtctagtctaagggactgttgactttgtctctggagatggggcgaccaggggtctgcgaaggaggttgtgg

SEQ ID NO: 27260 - DNA, 78 bp, Homo sapiens
  chr2:66808556-66808634
  hyper
gttttctttccccgccgccccactgtcccttttctcgtctccccgcgcacctccccagacgccctgccggggtggctc

SEQ ID NO: 27261 - DNA, 837 bp, Homo sapiens
  chr2:66808726-66809563
  hyper
cgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtac

SEQ ID NO: 27262 - DNA, 268 bp, Homo sapiens; identical to SEQ ID NO: 173
  chr2:68546249-68546517
  hyper

SEQ ID NO: 27263 - DNA, 561 bp, Homo sapiens
  chr2:68546552-68547113
  hyper
cggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcggg

SEQ ID NO: 27264 - DNA, 123 bp, Homo sapiens
  chr2:68870366-68870489
  hyper
ggtcctttgcaagctcgcggctgagcggggccgtgtccgtccactccgacggcgctgggctgccaaggtgagccgccgaggagccccgtgccccgaggcgggcacagccgccctgcatgggtg

SEQ ID NO: 27265 - DNA, 292 bp, Homo sapiens
  chr2:68870746-68871038
  hyper
gcgcctcacggccaccggaggcggggacagggagtccggcgcgggccgggtcgggggatctgcagcggcggcgcgaaggtaactcccccgccagagccgggaaagagccccgagcagaggaggaagggagcggggacctgcccttcgcctgccggcttctggaagaagcgtctcctgatccggccccggaataagaaacccggaccttgcctgccgggctccgcgatgccgcaggtacagagcgcgccctcccggggaggatgctccagggaccccgcgctgcactggctgc

SEQ ID NO: 27266 - DNA, 631 bp, Homo sapiens
  chr2:69240089-69240720
  hyper
gcctggaagcgcccccgcccccgacgcactcccgcgggtcccacgcgtgctttcgccgcctttgtccacaaggtggcagcctttgaactttcttccccgtaagaacgcgaaaggggggcagagaggaaggagagaaggcaaagcactgcccccaccaagaacaatttgaaacccccccccccccccatcatatttaaaatctgggacaaagaaccgtcgggacggaactccttccattgcaaaagctcggcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaaggggg

SEQ ID NO: 27267 - DNA, 40 bp, Homo sapiens
  chr2:69241225-69241265
  hyper
tgttttgttttgaaacgctgtcccacggaaggcattatct

SEQ ID NO: 27268 - DNA, 175 bp, Homo sapiens
  chr2:69533635-69533810
  hyper
agggctctctgtgtgcgaatccaggccctgagttcgcacgcccacctggggcggtggtccagccgccaggaacccgcttcccagccgctccccctcacgcaggaagccgggactctgggcgcagctctcccggaccacggccacgtcctggctccagctacggaggcagaaagaa

SEQ ID NO: 27269 - DNA, 57 bp, Homo sapiens
  chr2:70313348-70313405
  hyper
ccgaccccaatttctcgttggcgacgaatgctaaccacgtgtcgccattttgtgttc

SEQ ID NO: 27270 - DNA, 909 bp, Homo sapiens
  chr2:71503413-71504322
  hyper
tctgtaaacagcaggcgaagaaattattagtcttaaaaaggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagcggcagaacgcctggccgggccggcgttttccgggacactcgtttcggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtcggtgaaatcgcttg

SEQ ID NO: 27271 - DNA, 558 bp, Homo sapiens
  chr2:71680684-71681242
  hyper
tctcctgtccaagagcgagatctgggctacgccgggcgcccggagccctagtccagcccccggccatcgcggccgccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggtaggaggggccgaccaccctcgccc

SEQ ID NO: 27272 - DNA, 75 bp, Homo sapiens
  chr2:71693520-71693595
  hyper
ggtgcgcaccgggcccgggatccctggctggtgtggagccttggtcaccggaggcccccgcggagcaggccccac

SEQ ID NO: 27273 - DNA, 43 bp, Homo sapiens
  chr2:71693820-71693863
  hyper
cattggtcacttctccgcggaggagcagcgaaggcgacagctc

SEQ ID NO: 27274 - DNA, 171 bp, Homo sapiens
  chr2:71694277-71694448
  hyper
gaaaagcgaaagtgccgtaggtcagcggttatcacttttctaagactgacacccagaggaaataaagtccgagcttttactgggtagtggggataagggtaagttggaagatgggtgcagaaggtagagaggaatcagggcctctgaaaaacggggcgtgtagatgatgtg

SEQ ID NO: 27275 - DNA, 30 bp, Homo sapiens
  chr2:72372207-72372237
  hyper
taacccttctcctgccggggcagcacccgg

SEQ ID NO: 27276 - DNA, 167 bp, Homo sapiens
  chr2:72372591-72372758
  hyper
gataattccccctgccgtgcagcccttctagacggcgtctacccctttaagaaaaatctaggcggaggtggggtgcgacagaaggggtggtgaggcgagggtttccctccctccgtctgctatacccgtctccctcgctccgtctcactctccgtctttcctctcct

SEQ ID NO: 27277 - DNA, 127 bp, Homo sapiens; identical to SEQ ID NO: 6212
  chr2:72374563-72374690
  hyper

SEQ ID NO: 27278 - DNA, 52 bp, Homo sapiens; identical to SEQ ID NO: 6213
  chr2:72374713-72374765
  hyper

SEQ ID NO: 27279 - DNA, 30 bp, Homo sapiens
  chr2:72375350-72375380
  hyper
agggagcctctctctcgtaagccccttccc

SEQ ID NO: 27280 - DNA, 30 bp, Homo sapiens
  chr2:72377270-72377300
  hyper
gttaacatggagctgcgtacagcaaccccg

SEQ ID NO: 27281 - DNA, 58 bp, Homo sapiens; identical to SEQ ID NO: 6214
  chr2:73142033-73142091
  hyper

SEQ ID NO: 27282 - DNA, 30 bp, Homo sapiens
  chr2:73142786-73142816
  hyper
tccttccatatggaacgaaaatctccttct

SEQ ID NO: 27283 - DNA, 30 bp, Homo sapiens
  chr2:73143592-73143622
  hyper
agcggcgcctttctgcggcctcgaaggtgg

SEQ ID NO: 27284 - DNA, 30 bp, Homo sapiens; identical to SEQ ID NO: 6215
  chr2:73143902-73143932
  hyper

SEQ ID NO: 27285 - DNA, 744 bp, Homo sapiens
  chr2:73145232-73145976
  hyper
ctaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattcccaggcagggaagagctgtgcggcatccacccgcgccttcgccgcgtaggtctccctcccaggaaagcaggtggagacctccaggcttttctagaaaatataccagttcggacgcaagcccaggcgcgtcctcggagcctgtgctggccctcgccacagcctgcccaattctctctcccagctgagccagtctcagaccagagtacaactcctcccgctctccctccgcccggcttaacctcgcaccacgcttctctcgcaagtccaccaccacctccgagacctcagccttcgctggcgcgtccgggcgggggaaagtccattcgcgtgccccagctctg

SEQ ID NO: 27286 - DNA, 48 bp, Homo sapiens
  chr2:73146224-73146272
  hyper
gagggcttttaaggtcgtagccagtccgaaccccggagtttgcatcca

SEQ ID NO: 27287 - DNA, 361 bp, Homo sapiens
  chr2:73147167-73147528
  hyper
aggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctggagagaaatccagctccggctctgagcgtctccagtcaggcgaggcggataaatccttcgcaaaaccctcttggaaattgccgccgcttcctgagccatcagtcccagcgggtacgttatcgagtagcacaaacagttggatttttccctcaagaaccgagtctggacgcggagatggagccaagtgtggctgcattttcggacc

SEQ ID NO: 27288 - DNA, 101 bp, Homo sapiens; identical to SEQ ID NO: 176
  chr2:73147966-73148067
  hyper

SEQ ID NO: 27289 - DNA, 43 bp, Homo sapiens
  chr2:73148174-73148217
  hyper
cgtccggccctgagcccctggccggcggcggcctctccagcga

SEQ ID NO: 27290 - DNA, 47 bp, Homo sapiens
  chr2:73150907-73150954
  hyper
gtgtgcctagcaccccgctgctccccttatcacgttcctgaccccca

SEQ ID NO: 27291 - DNA, 662 bp, Homo sapiens
  chr2:73151187-73151849
  hyper
agctgttattccccgcgttcccccgcggagtggctctcgagtgcggggaggtgttgcggaggggagtggacttagggaaggggcggcaaaagggcaaagggagaaatggcgtgtgtgtgcgtgtcaaggaatggagagggcagggcgcttgggagcagggcgcgaggccaggctctgttgggccccggctcacggcgccccttctctctgtctgtacctgcgtgtgttgccgtcggcggcggggccgcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtaatcacccccggtcgcggcctgccctgcgcccggagcccgggtggaggtgagggtgcgcgggtgcaggagaggccctgagcccgccccagcccagccctgctgggttccaaaaggcccccattccccgcggcgctgcggtcaagcccgtctttagagcctcttcctcgagactgcgtgcagcctgctgagcccgcaggacttttgtcaagcgctaaagacctagc

SEQ ID NO: 27292 - DNA, 53 bp, Homo sapiens; identical to SEQ ID NO: 6222
  chr2:73152398-73152451
  hyper

SEQ ID NO: 27293 - DNA, 256 bp, Homo sapiens
  chr2:73152739-73152995
  hyper
cgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcagg

SEQ ID NO: 27294 - DNA, 568 bp, Homo sapiens
  chr2:73429355-73429923
  hyper
caggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccgga

SEQ ID NO: 27295 - DNA, 93 bp, Homo sapiens
  chr2:73429976-73430069
  hyper
cgcgccggcggcctcccagccgtcgggctccgcctgcgtccacccggccttctggaccgctgcttccctgtgcgccaccgggggtctgccctg

SEQ ID NO: 27296 - DNA, 51 bp, Homo sapiens
  chr2:73430322-73430373
  hyper
ccttgcagttgaagccgaggaccgcgacagtcttgctgaaaaagaccccgg

SEQ ID NO: 27297 - DNA, 314 bp, Homo sapiens
  chr2:73430442-73430756
  hyper
cggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgct

SEQ ID NO: 27298 - DNA, 32 bp, Homo sapiens; identical to SEQ ID NO: 6228
  chr2:73512107-73512139
  hyper

SEQ ID NO: 27299 - DNA, 1606 bp, Homo sapiens
  chr2:73518261-73519867
  hyper
ggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccggaactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgtgtggatgcgcaggtggcgattgagctcgtcggagcgcgcaaagctccgcacacaactctccaccgggcaagcgaaggccttggcgtgcggccgcgggcagaagcagcgcgtgctgcatttgccgccgcggcgccccttgcgtcgcgccttggcctgggggaaaggggtgggcggcggcggcggcacgggtggtgcagccacgccactgcttccagggatgtccgccaccagaggtttagggaagtccgccgcggcggcgctgcgaaggcccagcggggaaagctgaggctgcgtactggccagaaactctccgccgtcgccgctactccctccctccccactaggaggggtcaggagcccagggaggccctcagccccctcccctaagtcacccggggccagcgggaaagcgtcataggccccgctgggatagagtctgttggctgggacggccggcagttccgcagggcagctgatggacagcaagtcctcaatcttggtccctattacgggaaaacgagcctccggggcggcctggtagtctccctgtgacccacagttccctggggcccccacagaaagcagctcccagggcgcgtagggacccttgaaggcagagacagcgtccagcgctggcgaggcgggaggcgcccggaggccgggcttgacgtcgggcggggagagctgaggctcatacaggcactgcgagggggcacccgcgcaaggcgaggcctcccagaacgcctctgggaaaggggcagcgcccagatccggggagtaaaggtccggcggacccggcagcaaggcatcggaccccgcaggaaaaggggcatccagcggggatctggacgctgctgcctctggaccggggaagggtgccaggcctaagatgcccgacatgaggttgaagagtgcctccgggtcgtgcgggtgttcgggcactgcctgaatgaagaagctaccgctgtagctgaggccgggagggggtgtgggcgcaggcccctccaggaagcaggagtcggctaagtccccac

SEQ ID NO: 27300 - DNA, 802 bp, Homo sapiens
  chr2:73520242-73521044
  hyper
ttctcaggtatggtgcgcccccgcgctgcgccgtcgtcgtctgagcacccctgctcgccctccttacctccagggtagccggtggccgcgggagcgtccctggcaggcagccggggcaattcagcgctgggttcggcgcaacagccttcagtggacttgacgaggagcgcgtcgggttcggaaaactcgctaaggtggagcatggcgcggcgccggctgtggggcgcccggggcctcgcccgctgggcttgggggcgcgcgggtggcggggaggctggcggtaggggttccccgcagcgcacagacctaggcgcccgggctcctggcttcgggcactcacctctgggaaaggagtcggggagccgcggcgccctcgctcgcccgcaccggcctcgggcggcggctcctcgcctctccaaagcgctgccgggctcccccagcccacagcccccccacttatatagctgcggcggcgctggctccgggcttccgactccccgggccactgccattttgggaggccccggccctgccgccgtgacgtaaatgcccaaacatggacacaggatgtgtgccggggactcccgaaaaggaaagctcgagctgtgacgttgttgttgtcgccgccgccgccaggctcgcgccgctgcgtgcgcgcgcgctccccaggcgtggagcgctggggccgcggatgcgccagtctggggcgctgcgcctcaccgggccgaccgtccggtagatgcgcttcccacctggaggcagaggccgaggggcagcaggggaggaccgtgttgggtttgaa

SEQ ID NO: 27301 - DNA, 35 bp, Homo sapiens
  chr2:74229462-74229497
  hyper
ggggttagagagtggcgaagcgggaatcccccccc

SEQ ID NO: 27302 - DNA, 126 bp, Homo sapiens
  chr2:74230043-74230169
  hyper
ggggagcctgtctgccgtgatccaggcggcagctggaggcaggaagatggtcccagatagcctttctttcccaggctgtatcccctcccgttcgccttcttcccctccggccgggctgggggctgt

SEQ ID NO: 27303 - DNA, 44 bp, Homo sapiens; identical to SEQ ID NO: 6233
  chr2:74726199-74726243
  hyper

SEQ ID NO: 27304 - DNA, 30 bp, Homo sapiens
  chr2:74726744-74726774
  hyper
ccgggcccccagcctcggacccgcccccgg

SEQ ID NO: 27305 - DNA, 52 bp, Homo sapiens
  chr2:74730183-74730235
  hyper
gtccgggggtgcagacggcgccctggggtggtcctgccgccacctctccttt

SEQ ID NO: 27306 - DNA, 30 bp, Homo sapiens
  chr2:74730614-74730644
  hyper
tcgacgccgagctgccgcccagccccaatg

SEQ ID NO: 27307 - DNA, 531 bp, Homo sapiens
  chr2:74740605-74741136
  hyper
cacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactccctgcacttggggtccgggggtaagtgccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgcc

SEQ ID NO: 27308 - DNA, 708 bp, Homo sapiens
  chr2:74741137-74741845
  hyper
ttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcggtgagcatctccgctgactcagcggcccatgctcgggcccctcccgcgctgagcctggctcctaacaccctggccccctgtccccctccccgcacatctccgccagccagccttccccctgcgcttggcgcaaacaggcgtcccttcccctttaactgctgggccccgcccctgccctacccccagcccccactacccacccgggccgatccgtcagtcactgccccagccggagctggccaaccctctccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctc

SEQ ID NO: 27309 - DNA, 279 bp, Homo sapiens
  chr2:74741872-74742151
  hyper
cgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctc

SEQ ID NO: 27310 - DNA, 324 bp, Homo sapiens; identical to SEQ ID NO: 180
  chr2:74742324-74742648
  hyper

SEQ ID NO: 27311 - DNA, 452 bp, Homo sapiens; identical to SEQ ID NO: 181
  chr2:74742693-74743145
  hyper

SEQ ID NO: 27312 - DNA, 15 bp, Homo sapiens
  chr2:74743766-74743781
  hyper
cgaagcaatagaggg

SEQ ID NO: 27313 - DNA, 142 bp, Homo sapiens
  chr2:74781946-74782088
  hyper
ctggcgcatggatgccgaaccttatccgggctagtagtgggtgagagagcccagaaacagggagaggtgggcagcgggctggagagcggcgccgggagttggagagcctgtgactttcccgtgaagttgctttgcacactcc

SEQ ID NO: 27314 - DNA, 97 bp, Homo sapiens
  chr2:74782218-74782315
  hyper
cgtcgggacccgggccgcctgcgcacgccactccctctcgagcactctctctctctccctagaggtggaggaagacctgggccgtgctctacccggc

SEQ ID NO: 27315 - DNA, 80 bp, Homo sapiens
  chr2:75146976-75147056
  hyper
aggcctcgataaatgtttaatgaataaaacgatgaaaggacccgtcgcctcctaaatgcagatctcgagggagcctccag

SEQ ID NO: 27316 - DNA, 67 bp, Homo sapiens; identical to SEQ ID NO: 6243
  chr2:75426808-75426875
  hyper

SEQ ID NO: 27317 - DNA, 518 bp, Homo sapiens
  chr2:75427525-75428043
  hyper
cctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaa

SEQ ID NO: 27318 - DNA, 30 bp, Homo sapiens
  chr2:75428245-75428275
  hyper
tccctttatttagagcggctgcacaagagg

SEQ ID NO: 27319 - DNA, 157 bp, Homo sapiens
  chr2:75787200-75787357
  hyper
tcccagatagagcagcgtggactgtctgcgcgcccctctccaaaagcaaagcgtcccactgggactttagggggcgccaacagcctttcactccctgatgcactcggctttcggggtcctgggggtcgccaaatgcgcgcggcgagttggctgcctc

SEQ ID NO: 27320 - DNA, 482 bp, Homo sapiens
  chr2:75787804-75788286
  hyper
cctttgctggggccccggcgcgcacttccggggactgcgcttggggcgcgcggggccgagcagggggacccggagctgatcactgaggggcggacacgacaaagcgctgcccgggtcttgggccggcaccagtacctcggaaaggaatcccggcggaggggccgccggggtcagggctggcctggggatgtggggtcccggcctgggtgctcacggacggcggcgccaagccccgcagaagctgcaggagcccgagtcagtgggaggaaaaggttgtctcatttccttcgatctcccccctcctccacccgcttggctccggacctgccctccctctcccccgcccccttctgcaagccagcggcccatgtgggcgcccgcaagacgcgaaacctgaacggctgcggcgtgcggcacctccctccgcgccaagttagttcacgctcccaactcctgcctgcctccccgcgctgccgactgtc

SEQ ID NO: 27321 - DNA, 15 bp, Homo sapiens
  chr2:75788330-75788345
  hyper
cggtcctccaggctt

SEQ ID NO: 27322 - DNA, 166 bp, Homo sapiens
  chr2:79739850-79740016
  hyper
ccccacctgcggcgccgagcctgccgcgcctccagagctccgccctaccccgccccgccctttcgggcgctccccaggccgcgcgcgcccgcggccccccacccagccacccctcgatgcccggtgcctttccaggcgccgcggagccacggggaccgcgggggcg

SEQ ID NO: 27323 - DNA, 242 bp, Homo sapiens
  chr2:79740063-79740305
  hyper
cggcgatccgggccgctgccgctcgcgcttgggcaggacgcggggcgggcggggggaggggggagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggagga

SEQ ID NO: 27324 - DNA, 144 bp, Homo sapiens
  chr2:80529299-80529443
  hyper
cagcctggtgcccgccggcccgtcccggctgcccaggcgtatttggtagcgcatgggttgagagccactgggacaatcacacctcgcattccctcgcgggctgctggtggcaggtacacgagccatactcgttgatgatcacca

SEQ ID NO: 27325 - DNA, 211 bp, Homo sapiens
  chr2:80529698-80529909
  hyper
cgcctggaagagccacggtggcaggctcgaatgtgccgtcgtgctgcccctccccgccgtccgcgagcgtggtggccgagctggcagggggccccagatcactgcggttggtgacggccgagagcaggtggccgctggtgggctcggccccatcctcgcacaggtggaaggcgtacacggcgtccaggacgtcctcgccctgtgcgtactc

SEQ ID NO: 27326 - DNA, 270 bp, Homo sapiens; identical to SEQ ID NO: 1999
  chr2:80529985-80530255
  hyper

SEQ ID NO: 27327 - DNA, 72 bp, Homo sapiens
  chr2:80530256-80530328
  hyper
ggaagtgggcgaagttcaccttgaccaagtcgttgtgctcgaggtgcagctcggtgagcttaaacaagccgg

SEQ ID NO: 27328 - DNA, 179 bp, Homo sapiens
  chr2:80530408-80530587
  hyper
cgcacgggcacaaactggatggcgttggcccgcatatgcagcgtggtgagcttccgcagcccgtggaagaggtcgggcgcgagcgcctgcagcttgttgtacgagaggtccacgctgcgcaggttgggcatgggccggaaggtggtgttgggcagttgggtgatctggttggaactcag

SEQ ID NO: 27329 - DNA, 685 bp, Homo sapiens
  chr2:80531328-80532013
  hyper
taattatatgcagggcgagagaagacccctctgtgtttccgaggcagccccggtccgcggccggcggatctggcaggcgcacaatgtctcactttgctgctcggctcggggctgcaagggcggccggcaaggcggggaggcgacttctaggacccgcaagtttcccaactacgtgccggagcccgagcttcgccttcctgccgccttcctttccctctgcagttcggactgtgacgttgtggggggaaaaaactccaaactcggggctcgcgactccccaggatctgacagtctggttaatgtccgtcattggaaacgaccactgaccggcgccaccttttactccgcggaaacagcctgccattcgcgccccgggcagctgcagagagcgggctcactcatgctttgcgggcggcgggcggcgggcggcgggcggtggggaggtgcggacggcggcgcggggagcggcgagcggcgcccgggctccttccctccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttca

SEQ ID NO: 27330 - DNA, 160 bp, Homo sapiens
  chr2:80549571-80549731
  hyper
cacaattcgggcccacgtagacttaatcccgagaggcaattgttcccttgcttgggcggctacgctccccgcggggctgcctgcagcccccgggcccttgcagctccgggacggcgcgcggcggcggaggccgcggggccccaagcgccagcctggcccc

SEQ ID NO: 27331 - DNA, 217 bp, Homo sapiens
  chr2:85107435-85107652
  hyper
aacatctaaagcgcccggctggacacgcaaggctcggacagtggtcactccgcgaacgcactctgtgacctggagcacacaggtcccccgctgagtgtcagtttcccagatcggtaaaaacaagggaaatggcttcaactccctaaagtcccttctaactcaggcactgaacatatgaaggttaagccaagcagcttcagggcgctgttaatatttt

SEQ ID NO: 27332 - DNA, 401 bp, Homo sapiens
  chr2:85360051-85360452
  hyper
atcagctcgcgcactcggagggactctaggcagggggagggccccgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgc

SEQ ID NO: 27333 - DNA, 90 bp, Homo sapiens
  chr2:85360920-85361010
  hyper
gatccccttccaggacgaggggggcgaggagcaggagccgagcagcgatagcgcctcggcgcagcgggacctagacgaggtcaagtcgtc

SEQ ID NO: 27334 - DNA, 15 bp, Homo sapiens
  chr2:85361295-85361310
  hyper
cgcacccttgccctc

SEQ ID NO: 27335 - DNA, 63 bp, Homo sapiens; identical to SEQ ID NO: 6255
  chr2:85361466-85361529
  hyper

SEQ ID NO: 27336 - DNA, 299 bp, Homo sapiens
  chr2:87016575-87016874
  hyper
cgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgc

SEQ ID NO: 27337 - DNA, 507 bp, Homo sapiens
  chr2:87017729-87018236
  hyper
tcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatga

SEQ ID NO: 27338 - DNA, 367 bp, Homo sapiens
  chr2:87088683-87089050
  hyper
cctccccttctcctgcgtccaggcttttgaggggaggtggcctcagtccaggggctctccggtcccccggggtaatgcgatatgggggtattttatttccacccttagggaccgtgcctgccaagctgcctcccgggcgccccgccaccgcgggctcgacgctgcaccctgccaggaccagggccaggacagccacttatcacctccccgctcaggccccgggagcgcagacccttgggtagcccgcgcgccgccgccttacctgtcagctgcgcggccaagaggagccacagccgcggccgcatcgtggcgcgcccgggacacctggccccgggggctcggcggagacagtcgcggctggggtggg

SEQ ID NO: 27339 - DNA, 30 bp, Homo sapiens
  chr2:88469803-88469833
  hyper
aggtccttcccactgcgaagctgagaaccc

SEQ ID NO: 27340 - DNA, 139 bp, Homo sapiens; identical to SEQ ID NO: 2004
  chr2:88751281-88751420
  hyper

SEQ ID NO: 27341 - DNA, 356 bp, Homo sapiens; identical to SEQ ID NO: 2005
  chr2:88751460-88751816
  hyper

SEQ ID NO: 27342 - DNA, 893 bp, Homo sapiens
  chr2:88751942-88752835
  hyper
gtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttatt

SEQ ID NO: 27343 - DNA, 38 bp, Homo sapiens
  chr2:88753098-88753136
  hyper
tgtaaaatactgtggcgacctcacgttccacgtaatca

SEQ ID NO: 27344 - DNA, 171 bp, Homo sapiens; identical to SEQ ID NO: 184
  chr2:89064805-89064976
  hyper

SEQ ID NO: 27345 - DNA, 371 bp, Homo sapiens
  chr2:89065128-89065499
  hyper
cgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctaca

SEQ ID NO: 27346 - DNA, 192 bp, Homo sapiens
  chr2:91635152-91635344
  hyper
cgtatgcggcttccggcccccgccgccacggctttttatcacccccgccgctttttgcccccgccgccgcgggtttttgcccccgcccccgttgctttttacccccgccgccgcggctttctgcccctgccgacgagggtttttgcggctttatatccccgctgtcatggctttttgcggccgtggcttttt

SEQ ID NO: 27347 - DNA, 163 bp, Homo sapiens
  chr2:95663969-95664132
  hyper
cgccccactgggtggcgcgtgggctccgcgcgcaggcagggagggcggccctcggtggggtcgactgggcggagccgccgcctcctatcttcccttgaaggcacctgcgcagggggacccgcggtgcctgggaggggagggggactttcgcatgaagcccctc

SEQ ID NO: 27348 - DNA, 753 bp, Homo sapiens
  chr2:95690747-95691500
  hyper
aacgtcccttcctgtcgcatggattcaaggccgacctgccccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggc

SEQ ID NO: 27349 - DNA, 979 bp, Homo sapiens
  chr2:95691501-95692480
  hyper
ctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacct

SEQ ID NO: 27350 - DNA, 98 bp, Homo sapiens
  chr2:95873425-95873523
  hyper
tggcgggaggacccccgggtgggggcgccaggctgcccacgcgtgcgttcccggcctcttgggggacccgagcggcggacctccggctccttcccctg

SEQ ID NO: 27351 - DNA, 204 bp, Homo sapiens
  chr2:96012452-96012656
  hyper
tggccgtccgcgctgcgtttcgcgccgccgccgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagc

SEQ ID NO: 27352 - DNA, 41 bp, Homo sapiens
  chr2:96192504-96192545
  hyper
cggcgcaggaaattccggcggcgcggcgaggggtgggggga

SEQ ID NO: 27353 - DNA, 77 bp, Homo sapiens
  chr2:96781907-96781984
  hyper
agagggagcgctgcccgcccagtgcgcaccgtggacgacagcgctgcccggctcggctagacaagagcgtcgcccct

SEQ ID NO: 27354 - DNA, 196 bp, Homo sapiens
  chr2:96782022-96782218
  hyper
cgagcggggcctaggaggtcgggaacacccaggaccagcagccgccctcctacatcctcctccaccggtgcccggggtccctgccgtccgccccagagaagtttcccaagttgtcccgccgccgtccccgtcccgcccgggaccggagaaagtcgcgccctcccgccacgcggatgccgtacgctctgggggcgcg

SEQ ID NO: 27355 - DNA, 69 bp, Homo sapiens
  chr2:96987148-96987217
  hyper
acgctccccgtcccccgcctcgtctttcttcggctcggcccgtggggcttccgccgccctgggcttgca

SEQ ID NO: 27356 - DNA, 435 bp, Homo sapiens
  chr2:96990881-96991316
  hyper
agggaggccgagcagcggagagtgtgtggccacggcccctccactctcccagcaaacccacgggggcctcggtgcggacagagacccggtgtggggaggccgctgcccctgcacgctgggccacgggggtttgggcggggaggagcttgtactgggtgggcggggaggagcccggacggcgggagcggctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacggtgagtaacctgg

SEQ ID NO: 27357 - DNA, 49 bp, Homo sapiens
  chr2:97193015-97193064
  hyper
ggcaggggaaggcctcgggagggacacgacggtccggcagcagagcctg

SEQ ID NO: 27358 - DNA, 401 bp, Homo sapiens
  chr2:97193251-97193652
  hyper
cggtttgagccagctcccctttttgagtcagatccggcggcagggccagaaaagcgctttctgaaaccccagcgcggtcctcggtgggggtggaatggggtggggtggggggcgcggccgcgccgctgggcgccctccccgccctcccccctccccacccccagtcctccctccgctgcccgccccccaagcccggtgtcgccccctccgccccctgccgcatccccggagccagtgcccacaggggccaggcagcccgcaggggtcgctcacggctggtgtaggggcttggtccaccacgctagtacttcgggcaccaaaatagaaaaagaataacgcttggaaagaatctgatgtttccgaaggagcatcgaaaatcgccgttacgggaaaagtaaaac

SEQ ID NO: 27359 - DNA, 104 bp, Homo sapiens
  chr2:97203428-97203532
  hyper
gctcggcgggagctgcgggccaacccgggcccgcgctccgtccctccgcggtgtctaggggtcgcccgggctggggtcgcgtcaccctccgcccagcgccggcg

SEQ ID NO: 27360 - DNA, 208 bp, Homo sapiens
  chr2:98962692-98962900
  hyper
ggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagc

SEQ ID NO: 27361 - DNA, 79 bp, Homo sapiens
  chr2:98963329-98963408
  hyper
ccgagcccgctgagccgtcggggcgggaggcagaaggagcagggctggctcccgctggggacgggtagggcttgcagcc

SEQ ID NO: 27362 - DNA, 417 bp, Homo sapiens; identical to SEQ ID NO: 189
  chr2:98963409-98963826
  hyper

SEQ ID NO: 27363 - DNA, 332 bp, Homo sapiens
  chr2:98963868-98964200
  hyper
cgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctccccatcacat

SEQ ID NO: 27364 - DNA, 245 bp, Homo sapiens
  chr2:98964473-98964718
  hyper
caactgggtcttctacgccagagtcccagttgtagaaaagtcggccaggtcagaggacccagatgggatttcactaagctggtgggagcttctttgcgttctttggggtagggggaaggacaggaactccccctgcttcgcaccaatgcccaaacaccgcacttcctcttcagcctcggttcagccacagagaggggcctcctcctgtgtagatgcccggaggggaggagcggtggttcttgggg

SEQ ID NO: 27365 - DNA, 139 bp, Homo sapiens; identical to SEQ ID NO: 191
  chr2:99439368-99439507
  hyper

SEQ ID NO: 27366 - DNA, 477 bp, Homo sapiens
  chr2:99552170-99552647
  hyper
ctttgggcacttgcacgagcgcgtccggctccccctcggccgcaggagctgcccagggcttcggcggcgggggtggcgcctctccgggtccgaggggcccctggcttcacggcctctgccctcgaccccctagccccggcccgccccacctccgcccggtgcccccgcgcccaccccgccttcgacccacgcctgccttgggacacgcgatttcaaacccctcgaggtacctgggacaggagcgtggcccgggctcggcgagacgcgcagagaagggcaccttccgcggggtgcggcgagccggggctgctcccgccgcggtgcgcgtctagccccagcccaaagccggggcgacgcagcaggtggccgcgcggcctccagacagcccgggtctgcggccgaagagctggacgcgggcgctgacactaccctcccgcggccggcccggccctgcgcccggcgcgctcccagctccca

SEQ ID NO: 27367 - DNA, 74 bp, Homo sapiens
  chr2:99553081-99553155
  hyper
actccaggtgacctccggatccgccctctaagtcagtggcctgcggcgggcgtgggcgccgagggaaggaagtg

SEQ ID NO: 27368 - DNA, 115 bp, Homo sapiens
  chr2:99553419-99553534
  hyper
gctgccttgggtggtcgcccagcgaatctcctccggagcccgagccgcggctttggtctgcggatggcacagcccggcgaccccgtcccggcctcttccccggcggtgcacgccc

SEQ ID NO: 27369 - DNA, 186 bp, Homo sapiens
  chr2:100720888-100721074
  hyper
ggagcagggctaagtcgaagctgtccatggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacccccaggtcggggctcccgacgc

SEQ ID NO: 27370 - DNA, 30 bp, Homo sapiens
  chr2:100721292-100721322
  hyper
ctgcgcccgcccgcccgcctctttctcctc

SEQ ID NO: 27371 - DNA, 374 bp, Homo sapiens; identical to SEQ ID NO: 6284
  chr2:100937836-100938210
  hyper

SEQ ID NO: 27372 - DNA, 216 bp, Homo sapiens; identical to SEQ ID NO: 6285
  chr2:100938329-100938545
  hyper

SEQ ID NO: 27373 - DNA, 225 bp, Homo sapiens; identical to SEQ ID NO: 6286
  chr2:100938574-100938799
  hyper

SEQ ID NO: 27374 - DNA, 10 bp, Homo sapiens
  chr2:100938800-100938810
  hyper
ggacaggcac

SEQ ID NO: 27375 - DNA, 192 bp, Homo sapiens
  chr2:100938984-100939176
  hyper
cgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttcgacttaggaaattg

SEQ ID NO: 27376 - DNA, 61 bp, Homo sapiens
  chr2:101033731-101033792
  hyper
cgccaggacaaaacccgcgggttccccggtttttccgtgcgccccgcggcggggagagggg

SEQ ID NO: 27377 - DNA, 273 bp, Homo sapiens
  chr2:101033998-101034271
  hyper
ggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttctgccgctgcaaaagcgttctttctgaccg

SEQ ID NO: 27378 - DNA, 41 bp, Homo sapiens
  chr2:101436001-101436042
  hyper
ctttgtgccctgggtcgagacctgcgcgcaaccctgcccct

SEQ ID NO: 27379 - DNA, 159 bp, Homo sapiens
  chr2:102003995-102004154
  hyper
cggaagcaaggagcccgagcccccttcccgcccctgcaggatccccgggcgcggtcccccgcgcgagtcccggcgaatccctgcagccgcgcgcgaagctcagaagtccaggctcgcagaagaccaggttccacgcacacgccgcgcatcctgcggagt

SEQ ID NO: 27380 - DNA, 861 bp, Homo sapiens
  chr2:102090355-102091216
  hyper
gcagggtccaaccaacgggtccccgcggggcagaccggatggctttccgcgggaagggtgacaacggggaagtcacagatgggaagcccggccccatcgccgattcgggcccggggcttttacgcgtgtgcgtgcatggcaggtccctccgcgctgcggcgggcgagcatcagaaagcgctgggcctggggccgctcctcacacccggctttgacccggcgtcccgagggcagccgtagcgggaaccacgcttcccctccccggccccacctcctccatcccagcgtcccaggcgcctggcggctcaccactggatgacgccgctgtgcgggccccggctaccctcgccgctcgacggcgaggccggcaccccctcggccatggctcggccccgggcctgcagcaccgaggcaggcagcgagcggcggccgtgggcggcgctgggttgcaccggtcctgctaccgccgctcctcggtgtttactttagaaaggagcgcgcggggggcgcgcggggcgcggggcgggagcccagtcctccaggcccgagcccgggggcgcggaaggcgcgcggcgagtacgggaggccacagctccccaacccccgcgccccgccgaggatgcgcggaccccgccctgcatcctgcggtgtgggctggagctgcctcccgctctcacccagcgcccttcccaccggcgtagcaaccagtcaaacagggacgcgaacaacaagcaccaacttacaccttttccaatctggtcgcggtgttgagtccgtgggtgtccttgacttgcttgagcgttggagttattcaggcagttttcaaaaatattgataccccggctgccgctccccatcccag

SEQ ID NO: 27381 - DNA, 37 bp, Homo sapiens
  chr2:103236062-103236099
  hyper
gggctgctgagggtacgcgcagcggcctctcgtcgcc

SEQ ID NO: 27382 - DNA, 195 bp, Homo sapiens
  chr2:105458957-105459152
  hyper
ttgggaagactcaggcgaaagagggagatgcccgtgtagagaaccgaggaggggggctggggtagaataatcagctctaaggttgcagatttagatctcaaggctgaaaaggataagcttccaccagagcatcctgtagcgcctcctgtcctgccctgccctgccctgcgcgcgcaccgcactcacacgtacacc

SEQ ID NO: 27383 - DNA, 361 bp, Homo sapiens; identical to SEQ ID NO: 193
  chr2:105459902-105460263
  hyper

SEQ ID NO: 27384 - DNA, 247 bp, Homo sapiens; identical to SEQ ID NO: 194
  chr2:105460264-105460511
  hyper

SEQ ID NO: 27385 - DNA, 144 bp, Homo sapiens
  chr2:105460921-105461065
  hyper
ggagagggtgatacacgttcacacaccgcttgctaaatgcagtggcgagaggagggagcagcgtctacatgaagcgaacttttcaagcgcagagccctgactcccaggcgcgggggctcaccgggaggggcccgggcgagagag

SEQ ID NO: 27386 - DNA, 251 bp, Homo sapiens
  chr2:105461163-105461414
  hyper
cggccggtgggcagccctcgacccggggcgcgtccacagcgcccacccgcggcccccaaacacctcgagagcagatcttaggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctg

SEQ ID NO: 27387 - DNA, 113 bp, Homo sapiens; identical to SEQ ID NO: 2022
  chr2:105461555-105461668
  hyper

SEQ ID NO: 27388 - DNA, 122 bp, Homo sapiens
  chr2:105461699-105461821
  hyper
cgcgcaccgaatcagtgacaaaggcaagcgggcggcgccgagctccaagccggcgctcctacggcttggcgggaaggaggcccagaagatggggtgcgatttgcacccggattttcctgggc

SEQ ID NO: 27389 - DNA, 57 bp, Homo sapiens
  chr2:105462165-105462222
  hyper
ctaaataaaataaaacgccgttagaatgcgatctaaggaagccgagcttagccctgg

SEQ ID NO: 27390 - DNA, 1294 bp, Homo sapiens
  chr2:105468563-105469857
  hyper
ttatatatacatatacgcatacgtaaatataaaaagcaacctttgggggccgcagaggaaaaaaatccgttctgtttggggtttggttaccaccgcctttggtatctataccttggcaataatggctttgctaaaacctacctacgatggtatctcacccggcaagcaggagctggacaagagcctacataaattctacgcgtctagtgttaatcttgagatcacgcgggggctgcctggctgcggctgggcaggagaactcctgctttcactgagttcacttaactgcgctcggcagaggcacgatacagcgggagagaagggcaggcccgttcacattttaatcggagcgcaccggcggccgctcctcggctgcgtcctgggctgccgctcgggctcgggactgccagatgcaggctctggctgggggcggcgggcgcaagcgggcgcacccgcagctaggggtgcggggtgcacgcacacgcacgctcattaagagccatgtatttattgaatgtccgagttgggttagttcattggaaatccccgaggagggctcaatttgcccttgttttcgttgccactttctcttttttcttggttcgctgaggttcctctgtgcagcgtttccgcttggccgcgtccccccaccccaccccaccccacccccgcttctctcgcctaccgggtgcactccccctcccatcccccttaactctttcagctgggttagagctgagaaagcatttgtcgccgccagccccatccaccacgcaaatccatctgagacagaaaggaaagaaaaaaaagcaccaccatgcctaagaatagagagcgagcaaacccccccaccgctaatcacacacacacacacacacacacacacacacacacacgaggaagcggtggagcagagaagggcgcggctagccgatcccggttctttcgcccggctcctgctgccacagggaattcctaaagccattggggtcgaatacacttacgatgaatctatgggggaaggtcggactgattgcttttcaaatacatcgcacggctccgctgaccggcaccctccaaactcacaagggcacgcacgctacttgcacgaatcccagaggagggaggagggaggaagggagggagagcgaaggagggagagagggggtggaggagccagggagcggcggcagcgagcggtccgtctcgcacgcgcgggcaccgcgctggtcctgggctgcaggtttcccagatgatggcatccgagaacttaaacaaagggggctgccgccgg

SEQ ID NO: 27391 - DNA, 681 bp, Homo sapiens; identical to SEQ ID NO: 2025
  chr2:105469880-105470561
  hyper

SEQ ID NO: 27392 - DNA, 405 bp, Homo sapiens
  chr2:105470562-105470967
  hyper
gagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcatt

SEQ ID NO: 27393 - DNA, 853 bp, Homo sapiens
  chr2:105471573-105472426
  hyper
gccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgcagccgggggccgcggcggcggcggcggcggcgggggcggaggcggcggcggaggaggaggcggcgaaggcggcggggccggcgggggcccggggcgggggcggggaaggagggggggaggaggcgggaggcggggggcgcggcggcggcggcggcggcggcggccgcggctgctgctgcggcggcggcggcggtggtggcggcggtggggtggcgggagcggagcggcatggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgc

SEQ ID NO: 27394 - DNA, 756 bp, Homo sapiens; identical to SEQ ID NO: 6306
  chr2:105472783-105473539
  hyper

SEQ ID NO: 27395 - DNA, 215 bp, Homo sapiens; identical to SEQ ID NO: 6307
  chr2:105473599-105473814
  hyper

SEQ ID NO: 27396 - DNA, 370 bp, Homo sapiens
  chr2:105478684-105479054
  hyper
cgttcttgatgagtccggtcttcctcaaggaagagttggctctggaagtgacctcagaggggtctgggaagagggcaacagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggc

SEQ ID NO: 27397 - DNA, 47 bp, Homo sapiens; identical to SEQ ID NO: 2028
  chr2:105479055-105479102
  hyper

SEQ ID NO: 27398 - DNA, 210 bp, Homo sapiens
  chr2:105479657-105479867
  hyper
ttattattctggaaacgctcaggcctgtggagccctagagactaaagggcagtcagcagagtaatgagcaaacctgggggctggagaaagtccaaggaattgaggagcgaaggaaagggaaacttctgaaagtttccctggaaggttgagggagttgctggaggctggagtcggctcaggttccagaggttctggcgataactttctgca

SEQ ID NO: 27399 - DNA, 64 bp, Homo sapiens
  chr2:105483752-105483816
  hyper
gcgccgggccctctccgctgggggcgagcccggagggaaccgaggggcccgggagggggagctg

SEQ ID NO: 27400 - DNA, 236 bp, Homo sapiens
  chr2:105484041-105484277
  hyper
gtaggggtaggtgcccgcgcctgggcccgcggggctttggtcatggctgttccccgggaggctcagttaggcagcagccttgctgggcaacaggccccgcccttggttaatccgggaaggtcgcgggctgcaatctggcctgacgaggcaggccctgaagtctccccgctgggcgatcagaagagcgttcgagaagccgggagctggtggggttggcagggcgtctgagtcacccg

SEQ ID NO: 27401 - DNA, 207 bp, Homo sapiens
  chr2:105488281-105488488
  hyper
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacctgccagaccttcccacgcgcgggccgcctgggttctggggctttcgtgacg

SEQ ID NO: 27402 - DNA, 686 bp, Homo sapiens
  chr2:105488548-105489234
  hyper
ctcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaagg

SEQ ID NO: 27403 - DNA, 45 bp, Homo sapiens
  chr2:105489909-105489954
  hyper
cggcccgacccgacccgcgacggggccacgcgtagtgccaggcaa

SEQ ID NO: 27404 - DNA, 81 bp, Homo sapiens
  chr2:105760590-105760671
  hyper
gcctttgtctcgggccgccgggcgcgcggggcccagcgcaggcgtaagtgaccggtggccgggccgcggggggtcggcggg

SEQ ID NO: 27405 - DNA, 147 bp, Homo sapiens
  chr2:105760937-105761084
  hyper
tctgggcagaggccacgcggggacggaggaggcagagaggacgggctgtgatggagaaacgggagaggagccggccaggcgccaccgtcaccaccatcaccaaccaccaccaccatcaccatcactgactgtcgcccatcccagctc

SEQ ID NO: 27406 - DNA, 171 bp, Homo sapiens
  chr2:106014945-106015116
  hyper
acagcgtcacctccccgcagccgccggctgggacccgcggccagcctttacccaggctcgcccggtccctgcccgcatggcggtgccccacctggtgaggacgcgggctgcagtcctccctctggggatgagtcggtgggctcctctgagctccagcgcccccagggtcta

SEQ ID NO: 27407 - DNA, 30 bp, Homo sapiens
  chr2:106681724-106681754
  hyper
aggggaacagtggcgcggctggggcgggcg

SEQ ID NO: 27408 - DNA, 34 bp, Homo sapiens
  chr2:106682012-106682046
  hyper
gacctcggtggtactcgcccgtgcgctgggcgca

SEQ ID NO: 27409 - DNA, 30 bp, Homo sapiens
  chr2:106682246-106682276
  hyper
tgtcctggccctgaccgggctggcgctgct

SEQ ID NO: 27410 - DNA, 322 bp, Homo sapiens
  chr2:107103818-107104140
  hyper
cacccaccccagccgcgactgtctccgccgagcccccggggccaggtgtcccgggcgcgccccgatgcggccgcggctgtggctcctcctggccgcgcagctgacaggtaaggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttggcaggcagggtccctaagggtggaaataaaatacccccatatcgcattaccccgggggaccggagagcccctgac

SEQ ID NO: 27411 - DNA, 149 bp, Homo sapiens
  chr2:107502581-107502730
  hyper
cgacaccgtggtgctcggtgctccccctggcagcgcggcactggagtccaaggcgtgcgtgtcacattttattccccggcagccgctcgggtgcgcgcgctacgcgctcccacactcacgctggcgcccgctagagctgggaccctggc

SEQ ID NO: 27412 - DNA, 43 bp, Homo sapiens; identical to SEQ ID NO: 2030
  chr2:107502865-107502908
  hyper

SEQ ID NO: 27413 - DNA, 241 bp, Homo sapiens
  chr2:107503421-107503662
  hyper
cgaaggttacctgcacagtacccgcctggcaccgcgcctggacacctccggggcactcgggtcccgggcggcggcaggaatgcaggaatgcgcacaggctgtgggcggccaggagggagtcccggcgcctgccccggcggaagtgagtctttgtgtaccctgtccaacacctccccccgccagcgcggaaggccgggctacctgcgcgcctggcagcgcctggcagccggctgggtggggc

SEQ ID NO: 27414 - DNA, 274 bp, Homo sapiens
  chr2:107503663-107503937
  hyper
caggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaaccccaagagggacggaaagttcttggggtagaagccggcgggacaagtgg

SEQ ID NO: 27415 - DNA, 30 bp, Homo sapiens
  chr2:108602866-108602896
  hyper
agcgtccctagcacacgccctagcaccact

SEQ ID NO: 27416 - DNA, 114 bp, Homo sapiens
  chr2:108603211-108603325
  hyper
cactccaggtaggagcggagcgggcattcctgcgcctacgggcccgcaccctcggaaacgccttgggcaccgagcccgggcggttttagaggggagggacgcggcgtttttccc

SEQ ID NO: 27417 - DNA, 234 bp, Homo sapiens
  chr2:109648039-109648273
  hyper
gtgcggcgaggagggcgcagtgaagttctgctgtgtgcaccccctgcagctcggccgggaagcgcccgctggaggaacggagagcgccgcttcagcgtcggccacgtgggccgggctctgccggtggcaacctggacgcgctgcgggcgccggcgagacctgcgccaacgcctacctccgggccacaggcgggataaagctgccccactttgcccccagcgaagagaaccctcc

SEQ ID NO: 27418 - DNA, 30 bp, Homo sapiens; identical to SEQ ID NO: 6319
  chr2:109744973-109745003
  hyper

SEQ ID NO: 27419 - DNA, 1154 bp, Homo sapiens
  chr2:109745234-109746388
  hyper
aggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccc

SEQ ID NO: 27420 - DNA, 39 bp, Homo sapiens
  chr2:109746462-109746501
  hyper
cggcaggcagcaccccgggttccccggttttcctctccg

SEQ ID NO: 27421 - DNA, 69 bp, Homo sapiens
  chr2:110371731-110371800
  hyper
tgcaggcgggaactgcggagcagtgattgcggccctcgcgaggccggaagtgggcgggccttgaggcga

SEQ ID NO: 27422 - DNA, 119 bp, Homo sapiens
  chr2:111490570-111490689
  hyper
ggtgccctctcctcccgagctccctcccccacgaagagtcgggtgcagggctgggccccgcggtgacaggcgcggtgtctacgaagaccgtgtggctggaagatcggccttgctggttt

SEQ ID NO: 27423 - DNA, 30 bp, Homo sapiens; identical to SEQ ID NO: 6325
  chr2:111875387-111875417
  hyper

SEQ ID NO: 27424 - DNA, 493 bp, Homo sapiens
  chr2:112656599-112657092
  hyper
gcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaacagaacttacagtgctcggcagcgtttacgtttatctggattcagcgaagtgttgttaca

SEQ ID NO: 27425 - DNA, 53 bp, Homo sapiens
  chr2:113190973-113191026
  hyper
ggtgagacccagcaccgaggcgacgtaccgctccacatcggccttgctgcgcc

SEQ ID NO: 27426 - DNA, 248 bp, Homo sapiens
  chr2:114256940-114257188
  hyper
agacgaggtggaagacgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatgg

SEQ ID NO: 27427 - DNA, 478 bp, Homo sapiens
  chr2:114260999-114261477
  hyper
tcctcccggcctctgcgccaccgcccccggtgcaggacgcgctttgctctcgccgagacccagacgcgctgaaagcctcgcgcgggcagttccccgccccacgccccgggctgcgcgttctcccgcaaagcctctgccgagtgcgcgcaacggcgccgccggactccccgggaccgcgctcccgcgcacgcctgaccggagcaccccgcttcacgggggcgttctgcgcgtccttcctccccggtgcgatttccattctttttcctctcgcggtccccaggagcccaggcacccctcgactccccgggactccctgcgggcccgaagccgccttcccgaggcggcggagttgggcagctccgggccccgcgccgccccgcagagccggagtttctctccggagtctggatacagctctccgcttcgtcgccgcgcactggaccccggtagcgtggagcctgcccgggaagctgggctg

SEQ ID NO: 27428 - DNA, 171 bp, Homo sapiens
  chr2:115918722-115918893
  hyper
aatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctgggg

SEQ ID NO: 27429 - DNA, 88 bp, Homo sapiens; identical to SEQ ID NO: 6332
  chr2:115919337-115919425
  hyper

SEQ ID NO: 27430 - DNA, 30 bp, Homo sapiens
  chr2:115919853-115919883
  hyper
aggctgaaggtgccccggggaaccccggcg

SEQ ID NO: 27431 - DNA, 468 bp, Homo sapiens
  chr2:115920144-115920612
  hyper
agtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggaccc

SEQ ID NO: 27432 - DNA, 57 bp, Homo sapiens
  chr2:115920613-115920670
  hyper
cgggacccaagcgctggggtaggaggactggggatctttgttcggagtgcgctgcga

SEQ ID NO: 27433 - DNA, 706 bp, Homo sapiens
  chr2:118981151-118981857
  hyper
ttgcttaaaatcttccgggcttattgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccgggg

SEQ ID NO: 27434 - DNA, 203 bp, Homo sapiens; identical to SEQ ID NO: 196
  chr2:118981945-118982148
  hyper

SEQ ID NO: 27435 - DNA, 269 bp, Homo sapiens
  chr2:118982253-118982522
  hyper
cggaggagccgggcgagaaagcccgaaaagggaggcggttatttacgaccggcgggttggagtctggcaccagatggtgggggtctgtcaggcccggccgccccgcccagcgccccgcaaacagcgcccggttggcagcgtcgcctgagcagcccccatcttcgcttccagcccctcccgtatattttctcccgtccaagtcgatcaaagacggactttaaaaattactcgcaattagacccaaaaaagtcattcgtgatctttgggta

SEQ ID NO: 27436 - DNA, 478 bp, Homo sapiens
  chr2:119067648-119068126
  hyper
ccacttgtggcactccgaaggcagcggagaagtctataaactacttccattaaaatgcaaatcgggcccgctgagaaaacaagtgacacaaaaagtgggcgccgcgcggccgccgcccgcgatggcgccgatggctgatgccgcgattacgccggcgggggcggcccgcgcgccacgaacgtgcccgacaagccgcgccgcttaatttctgaagagatttatattttttttgttgtcaggaaatgaacaaatacttatcaatgtaaaaactgctatctccgatctccccgccgggtttttcatactgatattctttgcaccccgtaacacaggaaatgaaaatcttctccgcctctcacgtcgccgctgcgccttcaaatcctctgcgagcagactggcctccccccaccggccccctcccgggctcccctccccggtaaacagaaaagaaaacttctgtgggcgaaggagggagaaa

SEQ ID NO: 27437 - DNA, 245 bp, Homo sapiens
  chr2:119532083-119532328
  hyper
tgaaagcctcagtagcggacccggccgggaaaggcggagccgacagctgtcgcggggcggggcttccagggccgggaggtggaaggcggagagcggcgagggctccggctccggacccagccgagcgcgcagcgtgaagcggagaacgccgggttagcgccaggctgaatcctcgctctgactcctattgcggtgggatgtggtctctgagtctccgtttaccgattttacggaatggaacttat

SEQ ID NO: 27438 - DNA, 101 bp, Homo sapiens
  chr2:119566171-119566272
  hyper
tcgcagcaaagggcccgggctgggtgttgccgagcggtcctcggctccccggtggaccatgcccctccagaggtctggcccagcgtcgctctgctctgcaa

SEQ ID NO: 27439 - DNA, 608 bp, Homo sapiens
  chr2:119590773-119591381
  hyper
gatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaagggggtccctaccccacccggggtagcgggagg

SEQ ID NO: 27440 - DNA, 15 bp, Homo sapiens
  chr2:119591658-119591673
  hyper
cgccgcccgggaccc

SEQ ID NO: 27441 - DNA, 300 bp, Homo sapiens
  chr2:119592997-119593297
  hyper
gtgactggagagcagcgggggacagcgtggcctcacccaaggtcagcgctggtccccacgtgtcggccgggggaggggaggggagcggacagtcggagcgttcggatgtccagttgagccgcggcgcggggcagccgggggcgcaaagttggaggcagggctgggcgacgaggagagagggagggccgggagccgaagggacgcccgggtgcaccccgctgcagaggccgagtccgagcggccggagaaggctggtcgcagaagggcggcctccggtgcaaaaaacggaaaccttggagc

SEQ ID NO: 27442 - DNA, 428 bp, Homo sapiens
  chr2:119593535-119593963
  hyper
gcaggacctgcgccccgcggtgggcaagaagatttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 27443 - DNA, 30 bp, Homo sapiens
  chr2:119594194-119594224
  hyper
cagtatagacttcaacgtgatttggtgaga

SEQ ID NO: 27444 - DNA, 30 bp, Homo sapiens
  chr2:119594750-119594780
  hyper
ctcacaggaggctcccgcccctctgcgctg

SEQ ID NO: 27445 - DNA, 969 bp, Homo sapiens
  chr2:119599895-119600864
  hyper
ccgacagaagggacccgggaggtgggggagaagaggtgggcagacacgaaaggaaacacactctcgcacacaaagaaaagtcccagagaaaccagggccggcgatgcgggtcgggaggcaccggagaagcaatgacattcaaatgaaaaaggcaacgaaaacgaaactgggcgggggcagcgaggcggtgggggaggggataaaataattataataattataataattataacaataataataaaggagattaataaaaatgtccagcaaatagagatcgctacacgtatgtgttttccttacctgaaattaaatatatacaaggtcgtaagcggtttggctagatagagctttaaggagttcgcagtttcgtcccttatactgggaatagagaatggatcttatttttcgatagcacctgtccgagtctttctcccttttcaaaaatgctgcgtttcaacgtcattgtccattctgaggctctctttctgtctctctcgctcttttccctgcgctccctccctccttggagcagatgctttctcccccagcgaggggccgggagacgacggcggcggtgccgggagggggcgcgggcgcggccccggcctgtggcggctactcgctctcgtctttgtcctggaccgtggtggtggagtggttgtacagtccctgggccatgaggtgcagcgccaggccgttcttgatgcctgtggctttcttgatcttggcgcgcttgttctggaaccagatcttgatctgggactcgttgaggctgagttcctgggccagggtctgccgccgctgctccgtgatgtagcggtttgcctggaactccgccttgagtctctgcagctgctcggccgtgaacgcggtccgcggccgcttgtcctccttctcgttcttcttcttcttcagcttcctggtgcgcggacctgcagcggcggagagggccggggtggggtgggg

SEQ ID NO: 27446 - DNA, 29 bp, Homo sapiens
  chr2:119602601-119602630
  hyper
ctcttgtaataaaatcgttcctagtctcc

SEQ ID NO: 27447 - DNA, 283 bp, Homo sapiens
  chr2:119602828-119603111
  hyper
cgtggctacgttgttcccggccccctgccggaccgggtgtctggagtgctgatcttgggccaaagcttctgccgctctcccagacactgcgggccggggcgtcaggcaggccttggccttctctcccggagcccagctcaggtctcctcctcgggttcgccaagcgcgaggggcacacggaaaagtggtggaaggaaagccgagaaaaacaggcctacggatgccagaagtctgctggatgtgcgggtgaaaaaaggaaagcgccgcgcggggaggatgcggg

SEQ ID NO: 27448 - DNA, 30 bp, Homo sapiens
  chr2:119603388-119603418
  hyper
ctccgcagaaaatatcgagatggtgtttgt

SEQ ID NO: 27449 - DNA, 277 bp, Homo sapiens
  chr2:119603817-119604094
  hyper
cttggcgttctggggcggtccgcggggccagaaggcatggcgcagcccggagttgggtactcaccggaggatggacgatccgaataacgtgtgcagtacacccaggcgggccatacgagaggctgctgcgagtcagttttgaccacgggcccgccgttggctgagcccataagtaggatagccgggttgccgtgctccgggtatttggtgccctgcgctccggggctccccgcgccgcctccactgccgccgccaccggtgtccgagggcttggctg

SEQ ID NO: 27450 - DNA, 526 bp, Homo sapiens
  chr2:119604154-119604680
  hyper
tcccagctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 27451 - DNA, 162 bp, Homo sapiens; identical to SEQ ID NO: 6349
  chr2:119604689-119604851
  hyper

SEQ ID NO: 27452 - DNA, 30 bp, Homo sapiens
  chr2:119605356-119605386
  hyper
ttgcacaaactctctcgcttaaaaaaaaaa

SEQ ID NO: 27453 - DNA, 30 bp, Homo sapiens
  chr2:119605745-119605775
  hyper
tgggtctgtgagctacgggagcaggggcag

SEQ ID NO: 27454 - DNA, 159 bp, Homo sapiens
  chr2:119606783-119606942
  hyper
atcttagagctccagcggacctcctcgccctgaacgccctccgcaactgggacagtagagaaaggatccctttggaaatattgtctatttgtgacatgcgaaagaatccccctacctccagttttccagaaaagtcacagagggttaggctaggaggaa

SEQ ID NO: 27455 - DNA, 182 bp, Homo sapiens; identical to SEQ ID NO: 2039
  chr2:119607442-119607624
  hyper

SEQ ID NO: 27456 - DNA, 15 bp, Homo sapiens
  chr2:119607847-119607862
  hyper
cgtccccccacctcc

SEQ ID NO: 27457 - DNA, 139 bp, Homo sapiens
  chr2:119610236-119610375
  hyper
ctcctcttgactccccgcgggaaacggtggaaagatatcaatgatttctgtacattgcacccggtggccaggattcagaaagcgctcctggggccctggtttcctctctgagccccgccggctgtccacaggcccgcgc

SEQ ID NO: 27458 - DNA, 79 bp, Homo sapiens
  chr2:119610540-119610619
  hyper
cgctgggactgtatcacacagccagacaggcctctggagctgagaattttagacttcgctgctccgggaagcaagagga

SEQ ID NO: 27459 - DNA, 39 bp, Homo sapiens
  chr2:119610901-119610940
  hyper
tggtccccacctgtccgagtggccgctctcgcctggatc

SEQ ID NO: 27460 - DNA, 183 bp, Homo sapiens
  chr2:119611566-119611749
  hyper
ctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcagaggct

SEQ ID NO: 27461 - DNA, 59 bp, Homo sapiens
  chr2:119612755-119612814
  hyper
aagccattccaggcacgtccctcccctcccgcgccgatgactcccgccccaaaattgtt

SEQ ID NO: 27462 - DNA, 738 bp, Homo sapiens
  chr2:119613153-119613891
  hyper
cttgtcctctgcacccggcgcgcagcggccccttaaacagtggaaccgtgaggccgctctaagccgaagggctggaatctgggtttctcgggttttattttagaccattcggcaccaagcccgagctcccccgccgcaccgcttccagtcccctttctttccatagagcgacccgaagccggcggtggcgcagggagccgagtctgatgagctcgcgggcggctgaaggccggcttccctgtggggaacgcgccacctgtcggcgccagtgagaactgcgtctgtgtggcgccctcggggtattcggggctgcggggagatgtgtgcctgaagccctgcgcttgcggtggggacgtccggcctctttcctggcaattgacccctgaggcgggagagacaacggaattcccacaaagggatccttctcgggatctccccacctcaagacagctaaagctggaggaaaagcccctccggggggtggggggtgcgggtttgccctgcgattccgaaagcagaaaatacccgagccacacagggacgggcgccgcgttggtagtcggggctacgttcctactccctctacctcccccgcgctgtgtgaccctgggcggaaccccgctgctctctgggcctcagtgttcttattcgtaaactgagggcgttggatgagattggtcctctcccaactctgaccttgaaactgatactgaatctgagcagcgtctgtagacacct

SEQ ID NO: 27463 - DNA, 41 bp, Homo sapiens
  chr2:119614130-119614171
  hyper
ggagagcacccatgtcgtgggtccagcgaggacacaaggag

SEQ ID NO: 27464 - DNA, 976 bp, Homo sapiens
  chr2:119614602-119615578
  hyper
cgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagaccagcttct

SEQ ID NO: 27465 - DNA, 577 bp, Homo sapiens
  chr2:119615975-119616552
  hyper
catgcccataccaagcgggaaacgaagcaccgaatatttccccagctcgtaggaagccagatgggggccagttccctcaggagacgctccaagtcgccctgcgggctccaggtggggacaggagttataaccttccctgcccttccccctgcaacacacgcgaggtctcagcgctcccaggcgctccagtggggccgcgttccccgccagggtgggtcaggggaatactctgcctgcgccctctccgagggtccgcgcagagcgagcgcctctttaggtggggcctctggctccgacccctgctcccaacagggatcttcgtttgcatcacccagaggagctggccagagagccgcgccggaggccgcatctccccttgttggtattgttgtcggcttgctttcttctggcttcccagctcagtgaccccggaaagggtcgagcatccgactccggcatgctggttggctgcccccggaggcggaggtagggggccagaaatgctgacctgggcaggcccccagccctgagctcctggggtggacatctcagggtcccgggcctccaagctcatggc

SEQ ID NO: 27466 - DNA, 150 bp, Homo sapiens; identical to SEQ ID NO: 6359
  chr2:119769161-119769311
  hyper

SEQ ID NO: 27467 - DNA, 40 bp, Homo sapiens
  chr2:119914013-119914053
  hyper
tccctggccagggcccggagccctccgcttctaggcactg

SEQ ID NO: 27468 - DNA, 370 bp, Homo sapiens
  chr2:119914529-119914899
  hyper
cgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaaatagggagaggggaagcttcatgaacactgacccagagtggaagggtgggagccaggggccagggccaagaggaaaggaggctgcagggcaagggggcgacctggagagaactaaagaactgaggtttccgagaagcccacgga

SEQ ID NO: 27469 - DNA, 456 bp, Homo sapiens
  chr2:119915151-119915607
  hyper
ggtcactgacctgcccgttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggt

SEQ ID NO: 27470 - DNA, 50 bp, Homo sapiens
  chr2:119916524-119916574
  hyper
cggctcccaggagccacaagtgggcgcagcgggcgcggtcccaagccggg

SEQ ID NO: 27471 - DNA, 337 bp, Homo sapiens
  chr2:120190015-120190352
  hyper
gtggacttgctgagtcgcgcggacacctcagggaaaggctctggcgagggaagaagcccgtgtctccgaagatttggcttctccttagcgtagtgcacgatgtttatgttggctaagaacctacacattcctacccgctccctcgggcctgctgctccccaaagggaagtcagtgggtggcggtaccgctgcccagcgggcgaacttcctttccgcgcaactcgcccgctgcagagtctatccgctggactgtctccaggattagagaggcccgttgacttcgtgtacaaacgctcagccacaacactgacctagtagacaccgttctgcccattgt

SEQ ID NO: 27472 - DNA, 150 bp, Homo sapiens
  chr2:120281663-120281813
  hyper
aggccggagaaagggcgagactgtcgctccctcgggtccccagcctgcagaagggcgcagtactcaccgagtgcgcggcgcaggcgagcagcaccggcagtagtagctgctgcagcggcggcgacaggtggggacgcatggtgcccgcac

SEQ ID NO: 27473 - DNA, 87 bp, Homo sapiens
  chr2:120281814-120281901
  hyper
ttccccgagggcgccccgacgtccgcctgcccgtgccctctgcccgctcgggagctcagcgccccgcgcagggtcccgggctccggc

SEQ ID NO: 27474 - DNA, 36 bp, Homo sapiens
  chr2:121103048-121103084
  hyper
ccgcggccgagggctcggcgccgcctgtgagcgggc

SEQ ID NO: 27475 - DNA, 47 bp, Homo sapiens
  chr2:121103883-121103930
  hyper
gccacccccgccacccggatccccgggtggctcgcaggacacctgta

SEQ ID NO: 27476 - DNA, 394 bp, Homo sapiens
  chr2:121104242-121104636
  hyper
gtccccgctcgctcccgctctccctctccttgctagctccggctgccaccgccgccaccgcagcccgcgcgccctggggcagcctggactcccggcagagctccttcggccgtggccctgcgcgctccgcccgggttgcagtcctcttcccccaggccgcagacccttgcctgctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggcttagcagtgtggatggagatgtgtgtgcttgttgatatacgtgggcc

SEQ ID NO: 27477 - DNA, 514 bp, Homo sapiens
  chr2:121104696-121105210
  hyper
gagaggcccctggggccgcttccatcaccggcggcgtgggcttgccaggattgctgaagcctcgctggggagagctaggcaacctctcttccgattgtgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagggtatggctcctttctggaatccgcccccccccccggccccagattgcaaatctctaacactgtctaaatataaaaatcagggagagaaaaatctttcggaactttaaaagaaggagaaaaatgtgcccgcgccaaaatgctgcaagtgctttcgactccgctgtccttttcaggacttgaatgagccaggctggcttttgtgcctggagctcggccccatttgtgccgaggggactgcggagaaggtcgcagagggggaagc

SEQ ID NO: 27478 - DNA, 46 bp, Homo sapiens
  chr2:121200039-121200085
  hyper
aggctgatatcatcccgcacaaatgttcctccgagaggaaggcttc

SEQ ID NO: 27479 - DNA, 30 bp, Homo sapiens
  chr2:121200390-121200420
  hyper
ggccatgcacgtcgtcgtcatcccatttcg

SEQ ID NO: 27480 - DNA, 180 bp, Homo sapiens
  chr2:121344837-121345017
  hyper
aaggcctgtcctctgcgaggcttcaggcgcctggaggcagggtgggagggcagggcgcgggggctttgtctgcgcggaaacgccctgcccggcgcccgcacaaaggccgctttgtgcccgcggccggcggaggtgggggccgcgcgtccccggatccccctgccccggcccggcccgcgg

SEQ ID NO: 27481 - DNA, 36 bp, Homo sapiens
  chr2:121412155-121412191
  hyper
gggcctgggcgaggccgggggcggaatgggctgagt

SEQ ID NO: 27482 - DNA, 498 bp, Homo sapiens
  chr2:121493449-121493947
  hyper
ggattgcagaagtgccggcgcttgccagccgaggcagcacggctccgcggactttttttcaaactcccatcaatgagacttcgaggaggagcgggcggcggcggcggctgcgactgcgaacgcggaggaaggccaggagccgcaggaggagccggaggaaagagcttgggccgcgcggcgcgccgcagcctcggggagccgcctgctcgccggcggtaggggctgcgcggcgcccgcccgcctctcggtcccctctcttgcctggcccgccccgccccggctggctggagccccggcacaaggcagccagccgagggtcgccgcgccagccaaggtgggatgggggcccacagccaccgcccggcgcccgagaggccacctgcgtgctagaggcaaacttttgtctctctcggtaaagttgcattggccttcttttgcttgcttttcgtgacgaagcgcctcccacctcggccaagcgcgggccgactgggatgctgc

SEQ ID NO: 27483 - DNA, 88 bp, Homo sapiens
  chr2:121494156-121494244
  hyper
tctcggggtgcacagcgagccggcctccgcgcgccggcgggggtctgttttttcagggggtggagggtgggatcggaggctgggatgc

SEQ ID NO: 27484 - DNA, 30 bp, Homo sapiens
  chr2:121494978-121495008
  hyper
gacctcgagcccccccgagggtgcctcttt

SEQ ID NO: 27485 - DNA, 44 bp, Homo sapiens
  chr2:122042116-122042160
  hyper
ctgcccctccgagcccgccgcccgcccctcgtccaaggaagggc

SEQ ID NO: 27486 - DNA, 30 bp, Homo sapiens
  chr2:122042918-122042948
  hyper
gagcgagcgcgcctccggggcggccagacc

SEQ ID NO: 27487 - DNA, 1072 bp, Homo sapiens
  chr2:124782333-124783405
  hyper
ctgcaagcaggggagcgcgcacaacgttaaaccttgaaaccagaaatcccgatcctatcgagacccatcagcttttcccatttgggaacgagcgcaggggaaattaaatgcgtaattcaagctctgttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccctcccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 27488 - DNA, 30 bp, Homo sapiens
  chr2:127534517-127534547
  hyper
cgccacatctccacccgcccccagccgtgt

SEQ ID NO: 27489 - DNA, 39 bp, Homo sapiens
  chr2:127534774-127534813
  hyper
ccgcggaggcttccccgagtcctgcgccttcctagagag

SEQ ID NO: 27490 - DNA, 121 bp, Homo sapiens
  chr2:127643980-127644101
  hyper
acccagagccccaaacgcaccctcgcggcgcttcagcggggtgggcgtggtctggtcgacccggtggtgccgccccacagcgccccctcgcgtgcgccagccagctcggcctcagctcccc

SEQ ID NO: 27491 - DNA, 125 bp, Homo sapiens; identical to SEQ ID NO: 2044
  chr2:127783043-127783168
  hyper

SEQ ID NO: 27492 - DNA, 412 bp, Homo sapiens; identical to SEQ ID NO: 2045
  chr2:127783169-127783581
  hyper

SEQ ID NO: 27493 - DNA, 390 bp, Homo sapiens
  chr2:127863488-127863878
  hyper
ggcgtcagcagctggcgtgatccaattcaataaaccagaggtggcttgggatagacaactgaccgggtgcagacccccgcccctcaatctctgcatttcctgcacgctctgggcaccctgggaggccccggctccatcccccattccagctctccgcgaggaggggtcgggtttcctgtggcgccttccacgcgcctcctccaggccagctccccacccggccgtgggctcccaaagccagtgccgccacccgctccccggccgccggaaacgctaagcccctgctggggcgagggcacctccttgcggggtgcgtagccctgggctcccggtggggccgggctgggcgggagcttccaggccgcaggcacctctcgggaaaggaaaccc

SEQ ID NO: 27494 - DNA, 452 bp, Homo sapiens
  chr2:127976374-127976826
  hyper
ccagaaataacagtgcgtgctgggccgggcacccggggaggcggacgatgggcgaaggcatcggagggcgccgccgcggctcgggtgcagtgcccctgccacgaagggcgcaacggaggtgggcgtgggaaggacagcactcaggctccaagtgggaagcgtgcggaattcgccggccccaacgccctagcgggtggctgggacccctgggttcctcccacgtccctgcctccagtcccggcgcgaactccaggtgtcgcccccaactccggcttagagcctacggcaccccgagcctccgagcctccgtcccctcttcccccgccattacaaaatacaaaaaggactagaaatgaatacacacggtctcggccacctaaggacaccgagctccgcagagcctagaggagctagggaacctagcgctcccctcgggccggccccaggcagca

SEQ ID NO: 27495 - DNA, 38 bp, Homo sapiens
  chr2:128421812-128421850
  hyper
ggcctgccctgccgccgcagctttccggccattgtccc

SEQ ID NO: 27496 - DNA, 81 bp, Homo sapiens
  chr2:128421890-128421971
  hyper
cggcgggctctgccggtgctggcgccgccggtacagccccgacgcggccagcgcacccagccgggccgccatggcgcgggg

SEQ ID NO: 27497 - DNA, 78 bp, Homo sapiens
  chr2:128432415-128432493
  hyper
gggggacccctgccccgacgggcgctgccgccccggcagctgcgagaatccgacgcgccagggcggagcggggatcgt

SEQ ID NO: 27498 - DNA, 434 bp, Homo sapiens
  chr2:128433069-128433503
  hyper
aagtccttcccaacccgggctctgctcgccacctcctggattccgggcatagctttccttttaaagggagtaaagttataataaacgcgaacaagcacccccacccccacagccccgccgggacgccccgcccggcgccccctctgcagtccctgggccgccccaaccgcaaacgcgtgcaggagatggtaggcgtgggggcgatgctgagaccacctccctcccgggctttcctagcccggagttcccaccgcggatctgggcactgactccctcccgaggcacccgggaccgccgagtccacgcagtcccgcccccagggaggctaaagccgagaggcgtccctcttcagtcgcaaagctgctttccccgggaaattccgatttcatcccccgttgcgggccatcgccctaacttggcgaaagatatttctt

SEQ ID NO: 27499 - DNA, 15 bp, Homo sapiens
  chr2:130737190-130737205
  hyper
aaaactgtgttgagg

SEQ ID NO: 27500 - DNA, 182 bp, Homo sapiens
  chr2:130737475-130737657
  hyper
tactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctggg

SEQ ID NO: 27501 - DNA, 193 bp, Homo sapiens
  chr2:130763484-130763677
  hyper
gcagtcccagcgctccgaacgacggtgcctccggttgacagcaacctgagcggacccgcgcctaggccctccgccaggcctgcgctgcctcgccccgggagaggaagactgagcccggctcaggcggctggagcgcgcgggcccgtttcctttcagcgatcagtcccctggcgtcccagcagcgccttccccg

SEQ ID NO: 27502 - DNA, 104 bp, Homo sapiens
  chr2:130763729-130763833
  hyper
cggcccagacgtgcccgcggacgccgctgacagcgcctgtgccatggggctgcctactctggagttcagcgattcctacttggacagcccggatttcagggagc

SEQ ID NO: 27503 - DNA, 51 bp, Homo sapiens
  chr2:130970991-130971042
  hyper
gcacgtcttgcccaccgccccgtcgccgaccaccacgcacttgagcatcag

SEQ ID NO: 27504 - DNA, 242 bp, Homo sapiens
  chr2:130971062-130971304
  hyper
cgctgctgcccgccggcctccgggcatggtccccccggagcccccgccccggtccccgggctcagccccagcccgcctggggagtccgccgccgtcgccgccgctctgcgccgcaggccgccccccgaccggccccatccagcggctcccctcgccggaggggagggggcggcgggcccggggcgctgccgccgcggcggtcgccgccaggatccccgccccggccccggtcgctgcgcctg

SEQ ID NO: 27505 - DNA, 759 bp, Homo sapiens
  chr2:131484847-131485606
  hyper
taagaccccaaaggccggcgagggtcgttgtgctgggctggacagcagagagaggctcggccttggccctcagccctgcagcacacagggcacccgcgcagagagcgtggcctgcgaatggctctgctgcctctcccggcctggggccgattagaccggtcagagcatctgtaaagtacaaggggcccctagggagtgcaggccagggcagctggggcagggaggcggggtccgccccatggcatcgcggtttctctggaaggggtgatgggctttctcagaaccacctttagtttctgtaccgtaatcggccaaaaaggcgcaggcgctgctgctcctggcagctgcgtaacaggctctcagaggaggacgcggttccgggctgcggcgggcgtggtccggggctgttctgggcgtggtctttggctgtgatgggcgtggccttgggctatggagggcgtggtcccagggctgcgatgatggtggtccggggctgtggtgggcgtggccccgggctgcggcgggcgtggtccccgggctgcggcggacgtggtcaggggcggttctgggcgtggtccctgggctgcggtggacgtggtctcgggctgtgacgagcatggtccctgggcagcagtggacgtggtctcacacccagagtctgaaatttctgcctcttcctggccctaaaaatatcctgcctgttcccacgcggctcctgccttctggagcagtctgccaggccggcggtgggtgttgggc

SEQ ID NO: 27506 - DNA, 479 bp, Homo sapiens
  chr2:131513547-131514026
  hyper
tgcacctgagggaggcgcagccgcaaccgggtgggaggcagagacacccagaaacagagacggggcgatacgaacagacaaagccggctcgagcgcggcccgagcggcggcgcagggaggcggcagcctggcggagcagcccccaccgcggccggcgcgccccctcgccacccctgcgcgccagcgccggcccgcccctcccgctggcctctggcggcttaaccctcgcctgcccgaccccgcggggcccctggagccgcggtgggtgggtgcgggcgccgggcctccccctcccggccgcggcgcgcggcgccgggagctgaccgtggtgctgagcgcggctcgcgctccgacgcggtgcccgagcctgtcgcggccgcgccctgctgcactgcgggcccccagcggtaagtcgccaaggccccgagaggctgcgttggtcctgccccgcggatgtggacccccggggagggcaagga

SEQ ID NO: 27507 - DNA, 150 bp, Homo sapiens
  chr2:131594772-131594922
  hyper
ggaaggacggggctccgttgggggcggtagggacggcggcccggggcgagcccctgagagggcaagggcgagcgcctgagccggcctccccgcacctggaccgtcctgggcgcgcggggcactcggagccgctgcctggaccggcctggg

SEQ ID NO: 27508 - DNA, 280 bp, Homo sapiens
  chr2:131594947-131595227
  hyper
cgcttggcgcagtaccagctgttttgggaaggagggctggtgccggcccggtgggtacgggagaagtggttgctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggc

SEQ ID NO: 27509 - DNA, 313 bp, Homo sapiens
  chr2:131720786-131721099
  hyper
cggccccttaatcaccacagggtgtgtcctgcccgggctgtcaggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtc

SEQ ID NO: 27510 - DNA, 148 bp, Homo sapiens
  chr2:131721437-131721585
  hyper
cggctgagagcctccttaacggagccccatgatgtcagccggcccgcacgcccctcgccctccgactgcgaccccggcccgggctcgcgcgccccgtcccccggcagccccgcggccgccgcaccgccgcccccggcccagccttccc

SEQ ID NO: 27511 - DNA, 83 bp, Homo sapiens; identical to SEQ ID NO: 2049
  chr2:131721866-131721949
  hyper

SEQ ID NO: 27512 - DNA, 55 bp, Homo sapiens
  chr2:131722233-131722288
  hyper
aggatggaagggggccgctggccgagggtggaacggattgcgccacctggctgtg

SEQ ID NO: 27513 - DNA, 298 bp, Homo sapiens
  chr2:131792222-131792520
  hyper
catccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggagg

SEQ ID NO: 27514 - DNA, 216 bp, Homo sapiens
  chr2:131792531-131792747
  hyper
cggcgccggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccc

SEQ ID NO: 27515 - DNA, 164 bp, Homo sapiens
  chr2:131792920-131793084
  hyper
cggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggcca

SEQ ID NO: 27516 - DNA, 49 bp, Homo sapiens
  chr2:132088590-132088639
  hyper
tcctgacactgcaagcgctccctgaaatccgggctgtccaagtaggaat

SEQ ID NO: 27517 - DNA, 71 bp, Homo sapiens
  chr2:132088785-132088856
  hyper
cgccaggggactgatcgctgaaaggaaacgggcccgcgcgctgcagccacctgagccgggctcagtcttcc

SEQ ID NO: 27518 - DNA, 207 bp, Homo sapiens
  chr2:132121322-132121529
  hyper
agcccagagacctcccggaccgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaa

SEQ ID NO: 27519 - DNA, 292 bp, Homo sapiens
  chr2:132152232-132152524
  hyper
ggtgcggccctgacccgaaagcggggcaggggtgcggaggacaggatctccgatgtccctgctccgcgggcgcccgcagtgctgagccgaagctcggcggggctgagctccagctgggggcgggtagctgacagcctctaggcccgggctccctccagaggcagcgttgcaccctgaccctaacttccgcctgcggcgttcagatgcggaaagcagggagcctgaacccaaagctgcgatcagagaatcgtgtgtgtgaagggtttcttgtgtcctccgtgttcccctgtgg

SEQ ID NO: 27520 - DNA, 502 bp, Homo sapiens
  chr2:132182751-132183253
  hyper
ggcgggcgcgggaggcgggcgcgggaggcgggcgcgggaggcgggcgcgggaggcgggcgctggctcggggggcgcgtgagagaagccgccgcgcccggcctcgctcagacgctcagacgcccgcgcctcggcccgcctcgctccccgagccgccgccgccgccgccgcctgccgaggccccctacgccgtgcccctggcagcgagaactcatccaccggggtgtccccgcagcgagcggccgctgaaggctccccgcgcccgctcctcgccgccgcctgacacggctcccgggcgccctcggccctgtccgcgcccaccgcccggctggcgcgcagacccggttccccgcccgcccggcaaccctgtgatgaagttttcacatacgttcatttcattgaaacaaaagtcttgtaggcaccattggcaggggcaagaaacaagcacacaggttatttgcagaagaccacagaactggcaaatgacagcgccaggattcaatt

SEQ ID NO: 27521 - DNA, 282 bp, Homo sapiens
  chr2:132767348-132767630
  hyper
ggcaaaaagcctaggcggagggggcaaaaagccgcggcggcgggggcaaaaaggagcgggggcaaaaaccccacaaaaacccgcggcgacggggggaaaaaaccgcggcggcaaaaagcctcagcggcaggagcaaaaagccgccgcagtggggataaaaagctgcggtggaaaaaacccgtggcggcaggggcaaaaagccgtggcttcgggggcaaaaagccacagcagcaaaaaccctcagcggcgggggcaaaaagctgtaaaaagccgcggcggcgg

SEQ ID NO: 27522 - DNA, 180 bp, Homo sapiens
  chr2:132767750-132767930
  hyper
agcggtgacgaaaagccacaggggcgggggcaaaaagccgcaaaaagccccgacggcgggtcaaagagccgcaaaaagccccagcgtcgggggcaaaaagccgcggctgccggggcaaaaagcagcggaggcaaaaacccgcggcggtggctgcaaaaagcagcggcggcaaaaagccgg

SEQ ID NO: 27523 - DNA, 120 bp, Homo sapiens
  chr2:132795879-132795999
  hyper
gggagcgggggcaaaaaaccacagaaagccgaggcggcgaggggaaagagccgcggcggcagggggcaaaaagctgcaaaaagcagcggcggcaaaaagccgcggcggcgggggcaaaaa

SEQ ID NO: 27524 - DNA, 120 bp, Homo sapiens
  chr2:132796059-132796179
  hyper
ccgcggcggcggggacaaaaagctagggcggcaaaaagccgcgctaacgggggtaaaaagccgcggcgacaaaaagccgctgagagggggcaaaaagcagcgggagcgggggcaaaacac

SEQ ID NO: 27525 - DNA, 180 bp, Homo sapiens
  chr2:133015303-133015483
  hyper
agggacgcctggggaagggagggggcctgcggtaccaggaaaaatctgcgtgcggcaaccttgagccttcgcggtctgggcagggggcctggccgctgcgcgtgcgcgcaatccccgaagggccccctagtccaccagcctcctttctcccaggcaaagcacctccaagtaaacccacac

SEQ ID NO: 27526 - DNA, 156 bp, Homo sapiens
  chr2:133015543-133015699
  hyper
ccccagcccaccgcaatagctcacacggcccgtgcgcagccgccagaggggagcacgggacctgcgctcgccagatcaggcggcacccttccccgcgtgggaggggcgcgtctcactcaaccgcctcgacccccacaccaacgagctccctcagga

SEQ ID NO: 27527 - DNA, 124 bp, Homo sapiens
  chr2:133062361-133062485
  hyper
cgcaagctaggggcgacattgtttggaatgctgggttgagtcccggctggaccgcgcccctctcggaagtgtagccaggagtaggggtgtaggatgtgcagctgtgacccgtccctgtggactg

SEQ ID NO: 27528 - DNA, 144 bp, Homo sapiens
  chr2:133426223-133426367
  hyper
ccactcctgggtctccgggtagggctggatgtggctgacaccggcagggggcggcgcgggtacctagggtcctacggaagaaagtggaatagtgcccgccacccctggaccccggctctagacacaaagcgcccatccattacc

SEQ ID NO: 27529 - DNA, 152 bp, Homo sapiens
  chr2:133427110-133427262
  hyper
caacttggcagggttcgggagatgtcgccccctctccctcgcccagaacccagcaccgctcggaccctccctcctctcaagcccagcttctcccgacggtgcagccggacaagctgcagcccggagtcccgcaaacccgccgctccccgctc

SEQ ID NO: 27530 - DNA, 166 bp, Homo sapiens
  chr2:133427471-133427637
  hyper
cgcaaaaagttgccgcgatgcctaggacccacattctcccggagtcccggggccgggagagggcaagcgcatcagaggaggcgacagcagcggaggctgccccggctgcagcggctgtggctgccgaggctgctggggcccgcgctgctgccgcggagacgacggt

SEQ ID NO: 27531 - DNA, 221 bp, Homo sapiens
  chr2:133427885-133428106
  hyper
gaaggctgggacggtcgcttcacatccccacccccttcctgtcttcctcttctcccgcctccgcacgttcctgggaaaggggcgccggggggcgggagagaactggtagttttctgagatggggaggttgggggagcggcgaggagggcgcagcaggtgccgtggggacctgccgggtgcggactagggtctgaggactgcgtgcccggctggcccttcgc

SEQ ID NO: 27532 - DNA, 39 bp, Homo sapiens
  chr2:135475588-135475627
  hyper
tgaagggtctgcagacgcgccctccggaaacatcaggtt

SEQ ID NO: 27533 - DNA, 506 bp, Homo sapiens
  chr2:135475865-135476371
  hyper
gttctcccaggcagccggcggagccgcaggggactacggaaaggaggatgcaacgagcctgggtccctccgagctgagtagggcccggagtggcccagaagcgctcgactccgaacgcaaaaaatgcctcccgcaaacttttcccgtgggcgccggagggcctggagctggcggagaggagggcgcgagtccaggcggggtcggcctgaaggcagctggggtctgggcttcgagggaaggaaccgcagccgaggcggtgccggccgcagaaggtggggctgccgctctcggctagcggcgttctcgccgggaagtcggggctccgcgcccccgcgcgctccgagccccgcgcctcgcccagcgcggcccgcgagtggggagaggcgggccccgagcagccaccccggtcgccggccgggtcgggcagctcgcgctcacctcggtcctccagcccgtcgctgaactggccgctctcgctgatccgcacctgccgctcctcctccagc

SEQ ID NO: 27534 - DNA, 183 bp, Homo sapiens
  chr2:135476823-135477006
  hyper
agagggaggaaccagcgtgaggacccacaggcggccctggcagagcttggctagggcgtagcggggacccgccccacctgcgccgcgggatggtgcccagaggggacccctcccactggattcctctggggtccgcgaagcccgcggccgcgcgtgggtagcagacagcgcccctaatttggc

SEQ ID NO: 27535 - DNA, 148 bp, Homo sapiens
  chr2:136875889-136876037
  hyper
ctgtttgcgggtggtcggtagtgagtccggagccggacaggacctcccagaggcatttcctaagtttgagggaagcgggatgcgcctgaagacaggtgggaagcgcgggctaggaacgcgtctctctgtggcgcgtccatccttgcta

SEQ ID NO: 27536 - DNA, 654 bp, Homo sapiens
  chr2:136876374-136877028
  hyper
tagcggtaaccaattcgcgaatagtgctttattatcctaaaagtatgctttattataagagtaatttagcgaccagtactttttgtaacagatcactaggaacttgcacagaatcactcattcattctcacaacaccgtgtgggtattaccatcacagagatgcatttagtccgatatttatagaaggacgaactgcgtgccacgcactgttctaggcgttggggatccagcgtgaaccagacaaggcccgcattcggagaaaccagcaaataagcccggagagatgaaatgccagggatgggcagggattccaagccgggcttgaacccaggtcttcggtccccatactcggcgtcttccacgattttgagcagaggacaagctttggcacgaatcagaaattaggttgaagaactgggcggggcggagtgggggtgggggtcagacgtttaaagcgatctcagactggctgaggtttgcagtgggcgcgcagacagtgctttccccctcgcgccacttccctccggcgcggagactgggtggggcgggggagcgagtgtggggcggggccgagaaactgcgtccgcaggcggggtggccgctgcggagatagctgggaccgaggcgcgtgcgtcgcgacacggaccccagag

SEQ ID NO: 27537 - DNA, 409 bp, Homo sapiens
  chr2:137522341-137522750
  hyper
gcacccagctcccggcgtttcccggagtcaccacaatgtttccctttctctctcccccacgtatgctgctaggggtactccccagataggattttctttgtcttttctcctagtaacaccgaagccctctcgtgcccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccc

SEQ ID NO: 27538 - DNA, 34 bp, Homo sapiens
  chr2:137522848-137522882
  hyper
cgagggtcgtgcgggtgcgcggcagaggcggtag

SEQ ID NO: 27539 - DNA, 29 bp, Homo sapiens
  chr2:137523364-137523393
  hyper
actttgctctttcctcgccggacagccat

SEQ ID NO: 27540 - DNA, 78 bp, Homo sapiens
  chr2:137523516-137523594
  hyper
cggggacgccccacgcggcgacctgagcaccgacctcatgcaacgggaccgaaccttgggacccgggcagcaggagct

SEQ ID NO: 27541 - DNA, 886 bp, Homo sapiens
  chr2:139536937-139537823
  hyper
catatagaacataggcgtatatcaggaggaggagagcgtggcgcctcgcgggaagagagaagagagtgacaacgcgaaccccaaaccacattttaatacgtttcttattcctcagcgcctccgagccacccagaccaggcgggcggtctccctgaaaagacagcttcgagatgcccgagagggggctcctgcgcggagctgggcatgaaagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcactatgctgtgctttgggagaagtgtctgtgtgcatctgggcaaaacaccacgtgaaaaataaacaccaccaagcctctcaaactgtgaacaggaggaaggtctttctgccccttctcatcctatcaatttactttccttcctctccttgaccgcttatcaataaaccgcttccttctcccggacctacttcccggccaccttctgcctactttaccccagcgctcaagtcccaacccgtgctaagcccctgagtcgcctgtagatcccgtctattccgttcttcaattcttccctttcgacctctaaggcaacccaaaactccttgccctccgcgcgcccccaaccccacttcccaagcaggcccaggctgggctccaagtcagccgcctgcgcggttttcccgccgaaacgcgtccccggcgtgtgggacggcgcgcgggccgggcactcaccagctgcagcaagccagggaccaccacgaggggcagcggccgcaggcgcatggtgccggctgg

SEQ ID NO: 27542 - DNA, 307 bp, Homo sapiens
  chr2:139537850-139538157
  hyper
cgcctgcctctcgcgcatctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctg

SEQ ID NO: 27543 - DNA, 444 bp, Homo sapiens
  chr2:142888097-142888541
  hyper
cccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctggcaatcggcaataatcccgagagagtgagtaaggcgaggagaaactcggacattgtggtcgcccggtaaggaagcctgcgctggagactgctcggcggcaccttcggcccggcggcggcggcggcggcaggggccgcttggagcctggaatcgagcggcgtcatttacaaatgtcactggaaattcttcagctcaatgagtccagccagtcagccttctcctgcctggagcaggatgtggaaggtggagggatgcgcgcgtgcgggagagaggaggcagagcgtgtgtgagcgcga

SEQ ID NO: 27544 - DNA, 35 bp, Homo sapiens
  chr2:142889151-142889186
  hyper
cccaaagtcattaaccgttgcgtaagaagggaagg

SEQ ID NO: 27545 - DNA, 224 bp, Homo sapiens
  chr2:144694291-144694515
  hyper
aaaggtagtaggcatcggtgtttctggttttgcttagtgcgtcttcatcgtattccctcgctgaggactgagcctggccgactcagggaaccgagttcaatgaaatcctcagacgcataaagcacagggtgccggcccaccgagctgcgctcccttcccgggggtgcccgagagagagcacgcgagcccggcgcagccaaacccgggcaggggtgggtccccac

SEQ ID NO: 27546 - DNA, 704 bp, Homo sapiens; identical to SEQ ID NO: 2056
  chr2:144694553-144695257
  hyper

SEQ ID NO: 27547 - DNA, 67 bp, Homo sapiens
  chr2:144695258-144695325
  hyper
tacaccacattttccacgtgtcagctgacggccgcgacaaaaggaaacagaacgctggggggtgggg

SEQ ID NO: 27548 - DNA, 463 bp, Homo sapiens; identical to SEQ ID NO: 201
  chr2:145273327-145273790
  hyper

SEQ ID NO: 27549 - DNA, 431 bp, Homo sapiens; identical to SEQ ID NO: 2059
  chr2:145274080-145274511
  hyper

SEQ ID NO: 27550 - DNA, 399 bp, Homo sapiens; identical to SEQ ID NO: 2060
  chr2:145274576-145274975
  hyper

SEQ ID NO: 27551 - DNA, 641 bp, Homo sapiens
  chr2:145274976-145275617
  hyper
caggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatat

SEQ ID NO: 27552 - DNA, 39 bp, Homo sapiens
  chr2:145275852-145275891
  hyper
tttgtacctaaaaatcgagagaggcgctgcattttttca

SEQ ID NO: 27553 - DNA, 457 bp, Homo sapiens
  chr2:145277493-145277950
  hyper
aaaaaaacctacctgcgaagtcttgtttgtagttttggccagaaatggtgagaagaaaaagcatgaagaagccgcgaagtgtgggggagaaaaaggtggaagcgaagaaacagctcccggagcaaactgtacaaaaacctcgccaagagtgtcgggaggcaggaccgttattcctgcagagcaggttagaactgatctctttcggccactccaggaaacacaaacctggggacggactgacgtgttacgcctcttctaatgacatttttttctttttcttttctgtaggagagagacgagagaccctgaaacacgcgccacctatctttgtggggagggataattgaagcgccctgagcgtgagcatcatgtgaaaacgtgatcgccaagtttctctctgggaaaggatctgggatagattataccttgaagtctccgcaaacgctttagtggaaga

SEQ ID NO: 27554 - DNA, 740 bp, Homo sapiens
  chr2:145281202-145281942
  hyper
tctagaggaattattcgaccttgtgttgtgactcaggaggtgggcaacttcttttggagttgcaagcaaagggtgataaaggggacccctggactgggtgtgtgtggaggaggtggggggcggcaggggtccaagccaagccaaacggttttctcacgtgcagactcgcaatccaatccattcggagttgagcctaggataggaggggaaagtctattaaaaaaaaaaaaaatcaggagcatctctctgagaagccctttcaaacaaaaccaaaacaggaccagagaagctcagaccgtccctaacatccctgctgcgagacccgcaggctgtggaatctcgcacgtcacctggccccagcagggcggccagctgaggggttgattttattttatttttttgaagtaaaggctgaatctcggcttcagggcttttgccaacgtctccactgacaggaaccagcaaacttcaggacccaaatgagcatcttaatttattgatgctaaacaggtctggttgttgtccccaattttccgcgcgctctgccactcccccccccacacaccccgccccaacccccgccgccagcttcggtccctgcatttgatctccaggaagggccccgctgcacaggcggaggagcgcgtcgcgggggggggcggtgttcggccccctcccaccagaccgccctcccccagacctgtccccgcccgggatcctgcgacccccgcccgccgccc

SEQ ID NO: 27555 - DNA, 36 bp, Homo sapiens; identical to SEQ ID NO: 6423
  chr2:145281943-145281979
  hyper

SEQ ID NO: 27556 - DNA, 115 bp, Homo sapiens
  chr2:145282041-145282156
  hyper
gggaggtgatgccgggggctgattaccatgagaaaggctgtgcctggaaaagcctcctccacgcgactgtcaatctcactaaggcttggggggcggggagcggggggggggacgg

SEQ ID NO: 27557 - DNA, 30 bp, Homo sapiens
  chr2:148601319-148601349
  hyper
cgtgaatatcctgagcgggtggacagccct

SEQ ID NO: 27558 - DNA, 216 bp, Homo sapiens
  chr2:149632642-149632858
  hyper
atcctgtccttcccccggcaggtagagtgactacaagtcccgggatgcgcagcgctcggagtcgggcgggggccgggcggacctctacggtgacgtcaccgtcccggggcgggccaggggagggcggggcggaggggcgggtctcaaggcggcagagcgcgctggtgctgatgcaggatggctgagcgcgcaggagcccgggaggtctgagccggg

SEQ ID NO: 27559 - DNA, 1169 bp, Homo sapiens
  chr2:149632888-149634057
  hyper
cgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagagg

SEQ ID NO: 27560 - DNA, 63 bp, Homo sapiens
  chr2:149645496-149645559
  hyper
aggctggaccctccccgcccctatcactaccccttacccccgcagcaagggctgcgaccccgc

SEQ ID NO: 27561 - DNA, 334 bp, Homo sapiens
  chr2:149645560-149645894
  hyper
ggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctgccacttaccttctgtcaccattctgtcgctaacgctaggaatgatga

SEQ ID NO: 27562 - DNA, 30 bp, Homo sapiens
  chr2:151343094-151343124
  hyper
atcccttgggaggggcgcagacggcttgta

SEQ ID NO: 27563 - DNA, 30 bp, Homo sapiens
  chr2:151343607-151343637
  hyper
cactttccctttccccgcagtctaatcagg

SEQ ID NO: 27564 - DNA, 411 bp, Homo sapiens
  chr2:152954623-152955034
  hyper
actaacttcccggggcggtgcggagacgccgggacgcgaagacgtcaagagcccaggctagagggagagggactgagcccgagcaccggccgaggccgggaagagacgcgcgcgggcttgacccgcagctcccgcacgtgtgggccacggccggctccaggacccccgcgccgcgcgctcggcctcctccccatcctggtctcccgcctccttctcatacctgtctgaggatgaagctggtcgaagtggtgctgccatcggatcttttcaacctgctcctccgggttgtggtgcctcgggccacctggactcgacacacgggggccagagagaagccggtgaggaccgcagcgcagagcggggcgaccacccccggctggagtccgcctccggacccgctccctggggtcc

SEQ ID NO: 27565 - DNA, 32 bp, Homo sapiens
  chr2:152956018-152956050
  hyper
agcagagccaccttccgcgacttcactcatca

SEQ ID NO: 27566 - DNA, 382 bp, Homo sapiens
  chr2:154333349-154333731
  hyper
gcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccagggga

SEQ ID NO: 27567 - DNA, 399 bp, Homo sapiens
  chr2:154334051-154334450
  hyper
agaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggccttc

SEQ ID NO: 27568 - DNA, 214 bp, Homo sapiens
  chr2:154334451-154334665
  hyper
caccgtcggtctccccgcattccaagtaagtagcagcttccaaagttctgcgccctaatcgccctcttcttgccactttctgctgagttcagagtctgggcgctctcctccgactgccaggcatgaggactttcagagggcgagggagaaaccggtcgcttctttccgaaaggccgaagtcgagagaaataattgactccgacaggtttgcttc

SEQ ID NO: 27569 - DNA, 280 bp, Homo sapiens
  chr2:154335184-154335464
  hyper
gtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctc

SEQ ID NO: 27570 - DNA, 51 bp, Homo sapiens
  chr2:154727941-154727992
  hyper
ccccgcagcatctctcggctggagagccgacggcaagggtggggttgccgg

SEQ ID NO: 27571 - DNA, 179 bp, Homo sapiens
  chr2:154729082-154729261
  hyper
gcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcggg

SEQ ID NO: 27572 - DNA, 314 bp, Homo sapiens
  chr2:154729747-154730061
  hyper
ccttgtccaggctgtcgtggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagc

SEQ ID NO: 27573 - DNA, 156 bp, Homo sapiens
  chr2:155555158-155555314
  hyper
ccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggg

SEQ ID NO: 27574 - DNA, 1801 bp, Homo sapiens
  chr2:157176364-157178165
  hyper
ccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctcctagacctccacgaggtgcggacgcgcctctgccccgcccttttgtgcgccctcaccactagaaaaagagttttccccagtgtcgcgtgggaggtcgccccagtccagctcagcgttccaagagaccagagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggc

SEQ ID NO: 27575 - DNA, 142 bp, Homo sapiens
  chr2:157178166-157178308
  hyper
aggcccaggcagggagccccccagcctttactctcggcacctcggcgctgccgcgcggcggatacaaaaggaaacggacgagcgtgcgacgcgaggcggggaactggtggctcgaagacgcgcaacacgcgcgatgcctaga

SEQ ID NO: 27576 - DNA, 214 bp, Homo sapiens
  chr2:160760685-160760899
  hyper
aaggtgaccaagggccgaaggaaaagcgagaacgggagggacgggacgcaagagggcagatggggaaccccatactccagcaacattatataagagaggcgacgatggagcagcgcacccggccaaaaaagcctccgtgcgcctactctacggtgcaccgcgtcccctctgcaccagaagggccctgtcctcccacatccaccgcgccctcctc

SEQ ID NO: 27577 - DNA, 317 bp, Homo sapiens
  chr2:160760959-160761276
  hyper
cggctccagagcccccccgccccaacagcaaagcagccgtgacctgccccaggggcgcagccctgccccaggctggaaggcagcagagctgtggcgtcgaggcacccagcggactgcggggctggcgtgcccgcggttacctgcgcggccagagggctccgcgagatcgaagaaccagaagagcagcatgaggagccccgccgggcggcgaggggtcgcccagcctgtcctcatcctgagctggcgcaagccttccggccgggtcctcgggcgcacgcggctcccgccccgcctgctgagcgcggcctgccccgccc

SEQ ID NO: 27578 - DNA, 50 bp, Homo sapiens
  chr2:160918710-160918760
  hyper
cttggcccctagcttcgccccttcttcctctccttcgaccaccccgaccc

SEQ ID NO: 27579 - DNA, 30 bp, Homo sapiens
  chr2:161560586-161560616
  hyper
cgcaagagcttgagtcgtctccgtgacctc

SEQ ID NO: 27580 - DNA, 30 bp, Homo sapiens
  chr2:162094291-162094321
  hyper
ctcagccccgggttgcgtggttattttacc

SEQ ID NO: 27581 - DNA, 30 bp, Homo sapiens
  chr2:162094680-162094710
  hyper
agagaggggaaaacacgcttctgacagcag

SEQ ID NO: 27582 - DNA, 128 bp, Homo sapiens
  chr2:162095511-162095639
  hyper
cgggccaggagcccccgcgcggcccccagcgccggcccggtggagtgcagccccgcgcgggctcgcccgagggctcggcctgcgccgcgcgcccactccccggggcggtggggcgaggacccgcgctc

SEQ ID NO: 27583 - DNA, 541 bp, Homo sapiens
  chr2:162273417-162273958
  hyper
cgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctggg

SEQ ID NO: 27584 - DNA, 130 bp, Homo sapiens
  chr2:162274308-162274438
  hyper
ttccttgcggcaaagcggacaccaatgtgcaaggcaagtccttccaattaacacattttcttgacacttatttaggtgagaatgattaattaaagcctttgtggactggctcgagcgacttttaaaacga

SEQ ID NO: 27585 - DNA, 395 bp, Homo sapiens
  chr2:162274832-162275227
  hyper
ggtcagtggctcaagcgctcgtgttttctctctctctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggagaagggccctgaggatcgggcggtcggcttcccccttttttccggtgccccggcttatcttcgctcccagaggtgcgaaagc

SEQ ID NO: 27586 - DNA, 128 bp, Homo sapiens; identical to SEQ ID NO: 207
  chr2:162275310-162275438
  hyper

SEQ ID NO: 27587 - DNA, 330 bp, Homo sapiens
  chr2:162275472-162275802
  hyper
cggaggacactagccagcccggccgcgtgcagacgttcactttccctgagactcagttcatcgccgtcaccgcctaccagaacacggatgtaaggagacctaggggctgggggcgaggcgggcggcacagacatctctcccaccctctcacattctcccgccatgcaaggctagggtactagcagcgctaacatcagcaacagctggctccgctgtgcgttttaaggcttagggctcggggcctgcccacggcacctttcctaaataccaagccggtgggaaaaagctttctatttgttttcgtcgctggtcacccgggccacctttgag

SEQ ID NO: 27588 - DNA, 15 bp, Homo sapiens
  chr2:162279873-162279888
  hyper
ccgcaggatctacac

SEQ ID NO: 27589 - DNA, 264 bp, Homo sapiens; identical to SEQ ID NO: 209
  chr2:162280152-162280416
  hyper

SEQ ID NO: 27590 - DNA, 301 bp, Homo sapiens
  chr2:162280740-162281041
  hyper
cgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacc

SEQ ID NO: 27591 - DNA, 30 bp, Homo sapiens
  chr2:162282450-162282480
  hyper
taaggaagactagcccgtccccactccaat

SEQ ID NO: 27592 - DNA, 238 bp, Homo sapiens; identical to SEQ ID NO: 211
  chr2:162283365-162283603
  hyper

SEQ ID NO: 27593 - DNA, 321 bp, Homo sapiens
  chr2:162283782-162284103
  hyper
ggcgctgcccggcgctacccgccgccctcgggacagtcaccgtgagcaaaagagtcggtgtcatgtgcgtaaacgaagctcttaggagccgaggatagatttcacaggaacgtagtgccttgttctgaaagacgcgctttggttgatattaggaagtatttttaaaaaattggggaggtcgtttcccttgcagctccgccaccatctgctgcgtggactgagtcagcgtgaggtaaatttgcagcttcgcgctcctctcggaggcattgtgctgtcttgtccctttaaaacatgatcatttctcctcgcttccaagaagtc

SEQ ID NO: 27594 - DNA, 183 bp, Homo sapiens
  chr2:162284325-162284508
  hyper
ttttcaaaaagaggacgaaagaagaagacgagcgtgcggctagcactgtattctggctcgtgtcttcccgccactcgcaatccgcgccatcttaactaactttcaatgtccctcggggctgagcgtgccggcggcgggtgctgctcgggctgggagatgctgcggcctgggttctcaaccttc

SEQ ID NO: 27595 - DNA, 26 bp, Homo sapiens
  chr2:162930218-162930244
  hyper
ttctctacccctgcccgggttcgggc

SEQ ID NO: 27596 - DNA, 40 bp, Homo sapiens
  chr2:162930245-162930285
  hyper
tgcgttctgtgagtggctctccgggacattcaaagctcga

SEQ ID NO: 27597 - DNA, 260 bp, Homo sapiens
  chr2:162930338-162930598
  hyper
cgtcccttcacctgtcagagggtggccttggggcttccgcctaaggggagtccctggtccggtttcgccagcttttgggccatttggggagtttggcgaagaggtccccacagctcgccccggggacgtacgtggcgcggcactcaccttcatcgtcggcgtctcctcggaagtgagcgttcagagaaggagcgcaggcagaagtcaccgcgggcggcggagacgcgcgtcctgcaccgctgctccgggcggtggagtca

SEQ ID NO: 27598 - DNA, 113 bp, Homo sapiens
  chr2:163694871-163694984
  hyper
tccccaccttggaagcggtggacgccaagtgcactaacaaggcagaaagcgagggcgagagaagagaacaaacgaacttactttgcccttcaaatttccgaatgatggtcccc

SEQ ID NO: 27599 - DNA, 261 bp, Homo sapiens
  chr2:163695246-163695507
  hyper
cggactgccgcgggtgagagggtttgggggtggggaacgggaaggaggcggggtgaggggaggtggcgggggagggaaagagggagggagctgtgggggtggggtgggaagggggcggggagtcacaagggcaatcgatctgtttctcttctcccaaacagcgccaatttcccagtgcaaatgggcttaacctggcggttgcccagagcagtaaggaatggctgaggggggatggaagacttgtgccggttttgctggaag

SEQ ID NO: 27600 - DNA, 141 bp, Homo sapiens; identical to SEQ ID NO: 6454
  chr2:164592629-164592770
  hyper

SEQ ID NO: 27601 - DNA, 125 bp, Homo sapiens
  chr2:164593096-164593221
  hyper
ctgcgttggagggcccgggacagagccgcgctgctccccggcccgcgggctcttccctgccggttcccggccctctcgacagctgcggcccgtccgcccttccccaccccctctgcgcacgggac

SEQ ID NO: 27602 - DNA, 148 bp, Homo sapiens
  chr2:164593222-164593370
  hyper
ggatctggtctcgagagcctggacctcaccggcaccctccccggggcccccagcaccagccagaaaacgacttgatctgcttagaagaggcaacttcggggagaaaattcgcgttcgcccagttcccctcccccgcctccctgtgaat

SEQ ID NO: 27603 - DNA, 149 bp, Homo sapiens
  chr2:165478206-165478355
  hyper
tcctcaggtgggcaccggggcgcgaggctgagcccagggtctgggcggccccggcgccgctggaggcggggacccagccgagcgggcgctcccgctgggcttgccgggaggaccgcaggcgggataggggtccgcgcagccctgaccct

SEQ ID NO: 27604 - DNA, 31 bp, Homo sapiens; identical to SEQ ID NO: 6456
  chr2:167233063-167233094
  hyper

SEQ ID NO: 27605 - DNA, 35 bp, Homo sapiens
  chr2:168149198-168149233
  hyper
gggacaaagtcaccccgcggcgccctttcctgcca

SEQ ID NO: 27606 - DNA, 53 bp, Homo sapiens
  chr2:168149503-168149556
  hyper
cgaggccagagccatcgccggggaagcgcagccgggctcgggtgcttcggctg

SEQ ID NO: 27607 - DNA, 215 bp, Homo sapiens
  chr2:168149776-168149991
  hyper
ggaccctggctgcagcgtccctgtggcccgcgcgccagcccagcggccggagaccacgcgccccgcgggtaaggttctgtccggcagcgcccgcgacgcccccgggacggctggcgtggtctttgggggttacgaggcgcgtggtggccggggcatcccgacgaaggtgttgggacccggactgcgtgtcccgacgctgggctgtgctactgccc

SEQ ID NO: 27608 - DNA, 898 bp, Homo sapiens
  chr2:168149992-168150890
  hyper
cgcccgtgcggctccagctggtgcgttctcccttccgcgctcacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaaagtccaccgtggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggcccgctggggtctggtccatcagacctaggacacgttaaccacgcagagtaaccaggttagggtacccagctgcctccagagcgtttttgtttcata

SEQ ID NO: 27609 - DNA, 125 bp, Homo sapiens
  chr2:170218695-170218820
  hyper
accgggagcagctcccgcgccgccgcccggccctagcccctgcccggacgctctcccctccggcctcccgcggacccgaccctgccacagccggggaagtgggggctccacgagaggctctggct

SEQ ID NO: 27610 - DNA, 298 bp, Homo sapiens
  chr2:170219260-170219558
  hyper
gtgcacactcacacacgcactcatacaggcgcatgcactcctaagtgtcacaccaactgacacagattcactcatacacgccagtcacacacgcgcgcacattccacagtcacacttcaacgccgacatacacagtcccctttacgcgtgcatacaagagcacactcctgtgcgcacactctcacaggcacactcacacgtgcacacgcgctgccctcgcctctccgcagggtttgccccgcacagaagccggcgaggcggctcacggggaaatctgcacggacgcagttttactaaa

SEQ ID NO: 27611 - DNA, 251 bp, Homo sapiens
  chr2:170219911-170220162
  hyper
gtgtcatggccagatcgtgcttcttacaagtctgctcattttgaagcaaaattgaaaaagagcgaacgtcttctccatggttccggtacccttttataagaaggagaaacacgagaggttcagggaacccctagcctcccttctttggggccgctttggacaggctggcaaggggcccggaagccaaaagcacaagtggccttacacccgccctcagcgcacgtcctcagcctgtacgtgacatcagagcc

SEQ ID NO: 27612 - DNA, 65 bp, Homo sapiens
  chr2:170220494-170220559
  hyper
ctgaccccaacagtccggatcgcgtagcttccgtgggctgcagtggtaggcgcagctttaggtgt

SEQ ID NO: 27613 - DNA, 34 bp, Homo sapiens
  chr2:170335909-170335943
  hyper
aagagctgggcgacgcgcgcgcactctcgcggaa

SEQ ID NO: 27614 - DNA, 366 bp, Homo sapiens
  chr2:171568345-171568711
  hyper
gcgcaagtgtcactgcgggttcacctaccggcctcttcctctcgcaggtggcatgcagtcggcgctcgccgcccgcccgcaaagaaacggcaatgcaaacttcccagcctgggaaccccgctgcttggagagcagctccgctgtgccagccgccgccaggagactggtattcaacctccccgccccccgccacggttaaagtttgctccacattcgcagctcccaccccacccccatctccgccccgaggcaggaggaccacataggagttcctgggtccaccgtgcgcaaacacacccaccaacaaaagaaagcccattaaatcttccctcctgtgaactcgcgccccaacggatacctctttga

SEQ ID NO: 27615 - DNA, 15 bp, Homo sapiens
  chr2:171570047-171570062
  hyper
gggagaaggtgggcc

SEQ ID NO: 27616 - DNA, 9 bp, Homo sapiens
  chr2:171570181-171570190
  hyper
cgtccgtcc

SEQ ID NO: 27617 - DNA, 487 bp, Homo sapiens
  chr2:171570470-171570957
  hyper
gggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctgtactgacttttctcccgccttcgggatcctctctcgtatgatttgtggtttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtggcctggggagaagggggcgggacagcacagcttcttcccctcgggtgggcatgacg

SEQ ID NO: 27618 - DNA, 44 bp, Homo sapiens
  chr2:171571200-171571244
  hyper
ggcgggcgggggacacgcggcgggccgggcgctgtcggtcccac

SEQ ID NO: 27619 - DNA, 61 bp, Homo sapiens
  chr2:171571846-171571907
  hyper
agaccgcgcgcggggcgagcgagcggggcgcggcgaggggcaagggcggggagggccccgg

SEQ ID NO: 27620 - DNA, 230 bp, Homo sapiens
  chr2:171572347-171572577
  hyper
cgggccagggaggagcgcgaaggcagtgaggacaagagagcttaaaagatgggagggagagcggccggccggcggggttgtgggtgtttcccgactcttactgaccacggagccgggaggggcccgtcggatgcctccccctcccacttcgcgcctgcttcctctaaggctggatggcgtctcagtgcaccaagtagtttagcaagaagcgctcgcgggccccacgttca

SEQ ID NO: 27621 - DNA, 601 bp, Homo sapiens
  chr2:171669846-171670447
  hyper
aatggaccttagctccgacttaagcagaatgaaaggttaagtaacgcttcccccagttctcgtctcgggagacagacgtttaaccggtgagcactgccattttttttttcctttctggtcataaattagacacttaaaatagattttaaggagccagctgaaacgaaccaataccatggctctaaattacgtttcctggaggctaaaaattctaattgcgtcaaaaaaaattgacgtgtcctgtctactcaccttgactgaccacgttttaggcgtgaagatctccccgcagcccgtttgggcgctccttcaacgcctcacgctcctcctactcacccgtttttccctttgcagaaaaggcttggccccaaatccggttggaatatctttaaacaatcccccacccacccacgacggggaaaggaataaagggcattgtgggcggagggtcgtgttcccaagtcccagcggtggttgacctaaggaaacgttatcctcggcagacagggtggagtagccggggctgcaagctcgcaaatccctaatgccggagagagactggaggggtcgcatatcgccccctccttcttctgcctttgag

SEQ ID NO: 27622 - DNA, 270 bp, Homo sapiens
  chr2:171670471-171670741
  hyper
cgcttcaaatacaatcgaaacagctgggcggacaccactcccttccgggccacccctcatcaccggttcgagtccccggagaggatatcttttttccacccccattatcccaagaatcctcccccaggaatgataaaagattaaaggaagagtgaaagacataaacaaaaatataggtttcaaatgttgtttagagccgaatgacaaccacggccactcttagttcaaattcctaccggagagaagagcagtgggcgaaatacctcaccc

SEQ ID NO: 27623 - DNA, 484 bp, Homo sapiens
  chr2:171671306-171671790
  hyper
agattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcac

SEQ ID NO: 27624 - DNA, 52 bp, Homo sapiens
  chr2:171671799-171671851
  hyper
cgccgtttaggatgttttttgtgtccttaaaaagtgccggggatttcatcgt

SEQ ID NO: 27625 - DNA, 125 bp, Homo sapiens
  chr2:171674091-171674216
  hyper
ctgtcccggggccttcgggcgccatcgcgccagcgccgagagtcgagcaggggcgccgcgcaagatctttgtccgccgcctcctgcgcgctgcgcgcaagttcgtttccccggtgacgttcccca

SEQ ID NO: 27626 - DNA, 316 bp, Homo sapiens
  chr2:171674698-171675014
  hyper
tcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccg

SEQ ID NO: 27627 - DNA, 77 bp, Homo sapiens
  chr2:171675306-171675383
  hyper
atggggctctgaccccgtccctgccagaggtcattcggctgtcagggacgctaggtgactcccagggcaccggaaag

SEQ ID NO: 27628 - DNA, 143 bp, Homo sapiens
  chr2:171675522-171675665
  hyper
cggaatgaagagctaggagccccagcaggaataagagttttcagtccccggctttcgttgagccaagatctgacctcctcctttccccctgggctgtgttcaaagtctataatcagcggaaatttcgacgttaattgcagctt

SEQ ID NO: 27629 - DNA, 234 bp, Homo sapiens
  chr2:171677989-171678223
  hyper
gtcttccccactccccggtctgactgaagagcagccatgcgagcccgatcatctagtcaaatactatttttcacccaattaattcttgaactcttccacgaccccatttcatgccagtttattttaagctgccactaggctggagacccgccaagaaattatgagacgtttcggtcccagatgcctgtgttccctttctgggctgctgtggtcgccctttgagtctgcggggcc

SEQ ID NO: 27630 - DNA, 53 bp, Homo sapiens
  chr2:171678293-171678346
  hyper
cgaccccacctccggagctgccgggcgggggtcgcttacgggcccggaggggc

SEQ ID NO: 27631 - DNA, 57 bp, Homo sapiens
  chr2:171678980-171679037
  hyper
cgcgcaagcagctcccacccggtgccgtgcactctgcctgcgcgtcccaaaggtcgc

SEQ ID NO: 27632 - DNA, 117 bp, Homo sapiens
  chr2:172379586-172379703
  hyper
ccagaaacttgagcccgggcgcgatgccggagcgccgcgcagtcgggccgctgcagcccacgcgccccggaaagtcgcccctgtggaccgagcctgcgcgatcgggggcgcggaaac

SEQ ID NO: 27633 - DNA, 43 bp, Homo sapiens
  chr2:172945124-172945167
  hyper
tgaggcctgaggagccgcccgaaggtcgcggtgacctggtgcc

SEQ ID NO: 27634 - DNA, 358 bp, Homo sapiens
  chr2:172945896-172946254
  hyper
cccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaa

SEQ ID NO: 27635 - DNA, 30 bp, Homo sapiens
  chr2:172946606-172946636
  hyper
gaggaccaggtggctcggaaaagagatgag

SEQ ID NO: 27636 - DNA, 141 bp, Homo sapiens; identical to SEQ ID NO: 6475
  chr2:172947773-172947914
  hyper

SEQ ID NO: 27637 - DNA, 310 bp, Homo sapiens
  chr2:172948183-172948493
  hyper
ggagttgcctggtggcggaatcattagctggctgttgctacaaagcctcaccgtgtggttcggtgattaagaaaaaaaaaatcttttaaacgttggcaaacccgttattggtttggcgtattgggttttttttgcttttgcttttctttttgctccaaccactctgcctgaaatatttctgcccccagcattgtgcccttaaaccaaaggagaggaattctgcgggcagcagcagctggtacagaagttaaaaaaaaagagaaaccccctctactaatatctgtaacgacagcaccgatgtaatttgttt

SEQ ID NO: 27638 - DNA, 97 bp, Homo sapiens
  chr2:172949186-172949283
  hyper
ggcctgggtttgctgcgggtttcggtgtcccccagggactcctaaactctggaagtcgcgctagacctcaggaggccggaaaatgaccacctggcgt

SEQ ID NO: 27639 - DNA, 864 bp, Homo sapiens
  chr2:172949348-172950212
  hyper
cgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagct

SEQ ID NO: 27640 - DNA, 292 bp, Homo sapiens; identical to SEQ ID NO: 6480
  chr2:172951251-172951543
  hyper

SEQ ID NO: 27641 - DNA, 60 bp, Homo sapiens
  chr2:172951983-172952043
  hyper
cctcctccttcttaccggttgggggtggggggagatcctttcctccgccctctcacctct

SEQ ID NO: 27642 - DNA, 170 bp, Homo sapiens
  chr2:172952381-172952551
  hyper
tcggtgttatgcaggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 27643 - DNA, 88 bp, Homo sapiens
  chr2:172952794-172952882
  hyper
ctctggagggtagtgcgttggccaacggtcgggccctgtctgctggctccccacccgtgccgcccggctggaaccctaactcttcatc

SEQ ID NO: 27644 - DNA, 54 bp, Homo sapiens
  chr2:172952992-172953046
  hyper
cgcccgtctccttcttgtctccccggcccaggtccctcccgcctccaggtccat

SEQ ID NO: 27645 - DNA, 323 bp, Homo sapiens; identical to SEQ ID NO: 216
  chr2:172955471-172955794
  hyper

SEQ ID NO: 27646 - DNA, 226 bp, Homo sapiens
  chr2:172957809-172958035
  hyper
gtcacccccacccaccgctttcctaccccctccctcatcccccaatcttcgaggattaacacttcctgaaacatcaagtgtttttataaaaaggaaaaaaataatcctgacatcgctgacaagaagttttgatggaagaattagctggtgcatacataatcactcccccaccctcctactcccggagcgggagccacggcggcgggcgcagcgcagccttccaacc

SEQ ID NO: 27647 - DNA, 30 bp, Homo sapiens
  chr2:172958321-172958351
  hyper
ggcgcctcagagcgccgcaggctttttgca

SEQ ID NO: 27648 - DNA, 107 bp, Homo sapiens
  chr2:172960759-172960866
  hyper
cttttgacttttgagcgagttcgggggacgccaggagtgggggagttgcactcgagttttactgcccgtaagaacgactttttgagaggggacggggcttcttgctc

SEQ ID NO: 27649 - DNA, 372 bp, Homo sapiens
  chr2:172961325-172961697
  hyper
gcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcggcgggctgatcacaggactccgcgtctccgggcgggc

SEQ ID NO: 27650 - DNA, 82 bp, Homo sapiens
  chr2:172961935-172962017
  hyper
tggggaaaggcacaccgtggcccggcccgaccctgtcgtcactgggtgccgggtaaggtgactccggcgagtctgtggggcc

SEQ ID NO: 27651 - DNA, 459 bp, Homo sapiens
  chr2:172963633-172964092
  hyper
agcacggccccgtgtcgttggggtcggcttgcattccagagcagccagccatgcctcccgagggtgactcacagagctctcagttcagtcccgaagggcggtgggacaaacggaggggaaggttcaaagtagggttccgaccctcaggctgctgcagagctcaggtccctgacaggaggtcccccgcggcggctggggtgccgagcctggccatctaggcgggcgcgggggcggtggcgccggcgccggaggggcagggcaggcggaggctggagccgctccgcgctgagtgagtcaccccgccgccggccggagaatccctcgcggggactcgggagggggcggggcgtgaaacccccggtgcggccccacgcccagcgcgcctgtcctctccttgccgcacctcgcggtgtcgcagcctcggaaagatgtaaacgtagctctcggccggctggcttc

SEQ ID NO: 27652 - DNA, 142 bp, Homo sapiens
  chr2:172964747-172964889
  hyper
caggaaggaaagaagcggcggggccgcccgggtcaaggggccacgtgggggagggcgggcaggcgggaccgggaggtcaataactgcagcgtccgagctgagcccaggggagcgggcgaggagaaagaagcctcagagcgcc

SEQ ID NO: 27653 - DNA, 4 bp, Homo sapiens
  chr2:172965295-172965299
  hyper
gggg

SEQ ID NO: 27654 - DNA, 116 bp, Homo sapiens; identical to SEQ ID NO: 220
  chr2:172965647-172965763
  hyper

SEQ ID NO: 27655 - DNA, 802 bp, Homo sapiens; identical to SEQ ID NO: 221
  chr2:172966250-172967052
  hyper

SEQ ID NO: 27656 - DNA, 173 bp, Homo sapiens
  chr2:172970574-172970747
  hyper
ggatttctctgacttcggcattcttttgctccgcaggaacatagagaacggtgggggtaaataaggggagcctgaagtttctgctctgtgcttgcgtgttcgaatcccatcgctgagactttcttctgctttggatcgcttgtcccaggctgacgccgcgctgcgacctctcc

SEQ ID NO: 27657 - DNA, 420 bp, Homo sapiens
  chr2:172970950-172971370
  hyper
caggtctccagaagacggcgagctggagaggacaagtctgcgctttgctctcagacccttgccccaccgctagcctggggcaggattccagccttcgcctagccgggcgctttgctctgccgggctattgggcgtcctccgctgcacagaaagccagcccagttgggtattactggggagaggatgcctcctgtcggcagggagctagggtgggcgcccgggtgccctcagtgcgtggcggggccaggcccattttcactctccttcctcactcgggggatgggagggctgcatgcgctgctgctcctactcctcacagtctcgtcgagggtcccggagacgggagtttccgggccgctggtccaagaggcaatgccagtttcggtacctttgtgttttcgtccccgaagtagtagctct

SEQ ID NO: 27658 - DNA, 53 bp, Homo sapiens
  chr2:172971641-172971694
  hyper
gggccggcaggcagacgcgacccctgactcgggatctgcgtcctgggatttca

SEQ ID NO: 27659 - DNA, 325 bp, Homo sapiens
  chr2:172972930-172973255
  hyper
cgaccgcgcccctctctccccaaagagagtcctggaaggggggttcccctgggagaggaggaggcccgcccggctgcgcagagggtagccccgggaagattcctgaacagactcgagcctctgcggagagggcgggatgcgggtgccccctggcttggcacgtgaagccaagcttgaggacctgatgttttgttcccgctgggattccgccccaagttatctttgctccctgctggggtgtaagtaaaccccaggggcttgaaccgaaatcatcggttactcgacgcttccagccgtggcctttccgcggcgctgggcttctggt

SEQ ID NO: 27660 - DNA, 30 bp, Homo sapiens
  chr2:172974228-172974258
  hyper
cctaggtgttctcatcgttgggttgtcagt

SEQ ID NO: 27661 - DNA, 401 bp, Homo sapiens
  chr2:173099696-173100097
  hyper
cggcgccgggggagccgcgctcggggacagctggcggctcaacggcagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 27662 - DNA, 289 bp, Homo sapiens
  chr2:173100098-173100387
  hyper
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtatacaggcacagagtctcttcctggggctccgggaaagcttggcacgaccctcttgagccttcagtttaaaatgaaacgctggcgccagatgtggcca

SEQ ID NO: 27663 - DNA, 454 bp, Homo sapiens
  chr2:173600547-173601001
  hyper
ggccgcgggagcccgcggggagggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaaggtagctcgccgggggccgcagccgggggccgagctctgcggtgctgcccgggccctgagaccgccgcagctccgcacctgggcgcagcgcggccgggctgcgggtggccggggtccccgagcgggggaaggggttgaggtcctcgtccgggagacaggaggacaaggatccccgcctctcgtggggtgccagcggcatgagattattacacgtggtggagaaaat

SEQ ID NO: 27664 - DNA, 1202 bp, Homo sapiens
  chr2:175190771-175191973
  hyper
gaagaaagagaaactcgcgacaacagagttgccgaaagagaagtgttggcgcctcaaacttgaggatcagcttcttgggccccactccagggtgtcgcgggggtcgggttctttccgccgccccccgaaagattctcagctaaccctttccccgccgagaccaagaggccctcactctgacaccactccgggagccaagctactgtaaggagctgataccacccctcgccggcgcgaaccgcccatctccccagacccgcccaccccctgctgcgaatccctgacgttctagcccggcgaaggtcctcttaaattaggaaacaatagctatttaagaagaagcgcaaataacccgcgctctgcgcgcccaatcgtgggattcttgggagttccccgcgggcaaggaagtctgctgctccccgcagctgcggaggagaggagggagcctgcgtgctggggcagggtgtcgcgaacttggggcaacccacctccagagccccgcccccgctttcccgcctgccggggacctgccgaacgcggaaccaccctccttcctgaggcaaatttgggaggggagaggtccagaagctgtagagtcggggcgccaagcgccagattctgccgctcggaagttgggggcagtccccagtcccgcctcaggcccccgcgctcacagggcgctccgccgagggcgcgggccaggcgcgcggtgtcacctccacgaagtcatttacttgccctgaaggagctggccctcgaccccttggaggatggagattcctcccattccctcctccgcctcccccaggtcggcgaagagacgtggaattgagctggaccgatgattccgcgagctctgtaattatgcacacactgaaatcttcaccgttgacttaagttacttggcgctgcgagggctggggccctgcatattgattaaatgcagcctctatttacctaaacaataaatgtagagattagcaacgttcacttgatcacaataatgggattgacaattaaggggcaatgcatcccagatgtagcggaacctatgggctgcgtgcagcaggcagagggcttctcagagaggggcgctgggcagttgcggcggcggaggtagtgcagagcaggaagcagcgcggaagcacagcgggaggcggagggggacgcccagcctcgtcaaggtcttcggccaccccgcc

SEQ ID NO: 27665 - DNA, 384 bp, Homo sapiens
  chr2:175192084-175192468
  hyper
cgcttgctgatgcctggccgggaaggaggatggacgccgctggcatgtgccctggtaagtgtgtctgtttgtcatcagtgtacattctgcatgtggcagcagggcgagggggaggcgcacgtgtctaaagtgcacggagccttcctctacccctatgtatatacccttcagtcaatgttccaagaagcgggtcagggcggagggtatccatctggactctggaagggcgtgggtttgacatcggtaggtgtgacaggaaagtccagcctgtcagagttgggctctacagtggccgaaatcaagaaaggatggacgtgtcggcccagggctggcctgtttccggatatgtcacgggggtgcctcgttcctcgaggggagttttag

SEQ ID NO: 27666 - DNA, 109 bp, Homo sapiens
  chr2:175193268-175193377
  hyper
tttgggcagggaaggcgggcgggcgggggtgggggtgggggcgggggcctgctttgatcgctccagctctgttgtaattttgtcttcgccagatagattagctggaacc

SEQ ID NO: 27667 - DNA, 267 bp, Homo sapiens; identical to SEQ ID NO: 225
  chr2:175193378-175193645
  hyper

SEQ ID NO: 27668 - DNA, 97 bp, Homo sapiens
  chr2:175193808-175193905
  hyper
cgggtggttctaagctatgacgaactagaggctgggcccggttcttctccagaacagcgtgtggatgtaaaggagatgaaatcgtcctcccccactg

SEQ ID NO: 27669 - DNA, 298 bp, Homo sapiens
  chr2:175196967-175197265
  hyper
aaaaaatctgtcagacgaaaaaaatctggacttcctccgaaagatttccttggggccccaccttagagttgaagtggcccgggtgtttgcctgcgttcgtttggaagatttccctaacttttattgtgatgcagacgcgtgtatctaaaggaatatgcgagtgcccacgtctagagtctgacagctggaactacggggaaaacggcgggagggggaggggaggggatccgaggggaggaggagaagaggaaggcgagcagggcgccggagcccgaggtgtctgcgagaactgttttaa

SEQ ID NO: 27670 - DNA, 65 bp, Homo sapiens
  chr2:175197980-175198045
  hyper
agaggagagaaaacacgggaggcacagttccacatccttgtcacttgcaccggctccgcgacaac

SEQ ID NO: 27671 - DNA, 107 bp, Homo sapiens
  chr2:175199448-175199555
  hyper
cttcagtccccagcccgccctcgccccccccccgcaagtatcccccactactcccccccacccccgcggccctagctagctgacttgactggcacgcgccgggagcc

SEQ ID NO: 27672 - DNA, 14 bp, Homo sapiens
  chr2:175199921-175199935
  hyper
ggagaaactgttgc

SEQ ID NO: 27673 - DNA, 269 bp, Homo sapiens
  chr2:175200172-175200441
  hyper
gaaaacagtcttaatcgttttgcagtccatctagtcacgctaataaacatttacatttccgcggctccccaattcgcccatgactttgaaatctgtctctggccgcttatcctcggattattgttttcataatcgctgtttttgtgtgtatgtaaactttaaaaccaaacgttttctattaaaaaagaaaagtcaagtcgtagccaccctgggagagctgcaagtttcgcccgtccctggcagctgtttcggccgcctccgccctcacc

SEQ ID NO: 27674 - DNA, 144 bp, Homo sapiens; identical to SEQ ID NO: 230
  chr2:175200709-175200853
  hyper

SEQ ID NO: 27675 - DNA, 267 bp, Homo sapiens; identical to SEQ ID NO: 231
  chr2:175200916-175201183
  hyper

SEQ ID NO: 27676 - DNA, 183 bp, Homo sapiens; identical to SEQ ID NO: 232
  chr2:175201359-175201542
  hyper

SEQ ID NO: 27677 - DNA, 54 bp, Homo sapiens; identical to SEQ ID NO: 233
  chr2:175201775-175201829
  hyper

SEQ ID NO: 27678 - DNA, 120 bp, Homo sapiens; identical to SEQ ID NO: 234
  chr2:175202126-175202246
  hyper

SEQ ID NO: 27679 - DNA, 33 bp, Homo sapiens; identical to SEQ ID NO: 235
  chr2:175202568-175202601
  hyper

SEQ ID NO: 27680 - DNA, 78 bp, Homo sapiens; identical to SEQ ID NO: 236
  chr2:175202633-175202711
  hyper

SEQ ID NO: 27681 - DNA, 30 bp, Homo sapiens; identical to SEQ ID NO: 6510
  chr2:175203142-175203172
  hyper

SEQ ID NO: 27682 - DNA, 54 bp, Homo sapiens
  chr2:175204150-175204204
  hyper
ccgtcaaatggccctcgcaggttatttgaatatcagtggcgctgcttctgaaaa

SEQ ID NO: 27683 - DNA, 119 bp, Homo sapiens; identical to SEQ ID NO: 237
  chr2:175204828-175204947
  hyper

SEQ ID NO: 27684 - DNA, 73 bp, Homo sapiens
  chr2:175206833-175206906
  hyper
ggactacccggggcccggctggaaccaggccgattcaaacaggccaccaaaccatcccacccccctaccccct

SEQ ID NO: 27685 - DNA, 693 bp, Homo sapiens
  chr2:175206960-175207653
  hyper
cgggccggagcagccttctgcattgccttcgtcctccggcggacaccccagcccgagtggggcgcggggggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttctctcctctcagcgtatcgtcctccccctgccgcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacctttgcggcgggtaactcggctgggtttgtatttgctgttttaatacaaaccccgccgcactgcctatttcaaagatgtgctaattactacttggatagcagggcgcaaagtccttgtc

SEQ ID NO: 27686 - DNA, 888 bp, Homo sapiens
  chr2:175207981-175208869
  hyper
cccacccttcccagacgctggagtgtatagaaatatgtatgaggtaaatacatacagacatgcctcccccatatattgttgatgtaaatatagactgtgtgtttgcatctccagttaaggaaagggtttcagaatgtccgtggggacacgtccctccagggccggctgtcgaggacccggaaaaccacagcccctaagagttccagattttccaagacccttatactctcttcctgtagaatttcatactgggggttttgcattgttttgcaggcatgtaaccatttctgggtgattcatttatctataaaggaaatgcaaagtggcagggtgtctgccccagtccgcattctgcttgcagattgctgacgaaagttgatatcttcatgtttgtcccaggagcttcataaagcgccctcttcacctgtggagcccgagcgaccagaaaaattcgctcgctttcctaactgctgaaggcgagtccggcccgcgcgggggactgcgcccgaggcccggcaagcttaggcggggactagcagggccctcggcgggcgggcccccagcgaaaaggcctgagaattgcttctggggggtggcttgggccaacgggggcgagggagccgcgcagagggcaggccccgacccttccccgccgcaccttgtgggtcgggtgttgggcggcctcctggcgcgggaggcgcatctgctaggaagggtgtgcgctccccccttctcggcctccccatttcggtttggggtgttttcgcaaggttgccagacggtgcatccagaaggaaaccaccagagcacgcaggggggcgtcgcctcaggatgggaaggggcgacctcagccaggattcatcccatcaccctactccacccccattc

SEQ ID NO: 27687 - DNA, 139 bp, Homo sapiens
  chr2:175208996-175209135
  hyper
cggctccggggcagctcgggccggagggtgcgtttcttttcattccaggcagctctccgcgttcgtcccgcacatcttcgtcattactgctacattctgggcattctgggggtgataagtgtggcgtgaagggaggaga

SEQ ID NO: 27688 - DNA, 43 bp, Homo sapiens
  chr2:175351019-175351062
  hyper
cagagagttcctaaccgaataggctgctcggagagcagctgcc

SEQ ID NO: 27689 - DNA, 1246 bp, Homo sapiens
  chr2:175546822-175548068
  hyper
tgtctctggagagttcgggggatcaccccccctcaacccccgtccccactccgggcgaaaagcactgaccgggactggagatgtctctaaggtcgacgcagacccctaacgcgcgcgtctacgccgacctggggcgagcgggccgcccgggagggccgggagggaggcgggctggagcgcgggaggggcacggttcccatagacaggcaggcgggcggtgccagaacttgagccggccccaggggatgcccgaacgtccccctctgtcctagctggggtgtaggtgcagccccagggcatcgccgcgaagcccctgctcgagacctacggagatagtgggtcccgagccccacggggcggccccgggtccgcggagtccagcggtgagctcagcccgaggcgcgggacccaggctgtccacggccccttcctccccgggccatcagcgggcagcagaacgcgcgggccgctggcctggaattgcgcccctcccgaggccgcgcgcccgcgcccaccgctcgcaggggacgcggcctcgacgtccccagccgccccacccgcgtcaccggtgccaggcggcacttccgtgccccgccgtcgagcccagcccctcccggcgtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaacttcgccgagatgtgggccctcccctccggcgccgccgcccccccgccgccccgccacatgtggacgcgccgcgaggccccgccggcccgcgccctgccctccgcgcgcccgcctgccccgccagcaatggggctctgcgcctgcagcttcggcccgcagaggatcgcggcggggcgggatggtcggggctggagtccgcagtttcctcagtcccgctcccctgcgcggcgaggggaccgaggcaagaggacaggagtttgcagaggggcgggaactggaaggggagtctagcccagggcctttccccccaactcttgaatcttctccaccttcttgcggctgctggcggggggatcgggtgggggtgttccctctgttcgagccggaaggaacgccttttcccacgctttcccgtctgctctcaaaa

SEQ ID NO: 27690 - DNA, 148 bp, Homo sapiens; identical to SEQ ID NO: 2107
  chr2:176940167-176940315
  hyper

SEQ ID NO: 27691 - DNA, 30 bp, Homo sapiens
  chr2:176940611-176940641
  hyper
atgtagttttcatgtcgtttctataaaatc

SEQ ID NO: 27692 - DNA, 474 bp, Homo sapiens
  chr2:176943293-176943767
  hyper
taccaaaatgaaaatcggcaattgagatgataagaacgtggctttcttctgcgaaatcacttcaggtaacagagataacattaaataacatacattctatgcaccaagaacaatgttttatgtaccgagtctcttatccgtctctcctaatgacttcccttagcgggttgttagtacttgacagcaggtctccgtgcggggaacttttctccaattccacattcaaaggaggtccatcagagagcatgattggcaattttcgtcataatctgcacattattagcatcaaacttgacgtggcagttaacactagtgggttttgatgtacctttcttcaagttcaaggaaacccctccagtagccgggttggcagagcgggtctcagcaacccagcggtggctttgcagaggcgaaggcgcaatagacatgcgtgagaaatatgccaagaaccatttcacccgaggaaaaggaaag

SEQ ID NO: 27693 - DNA, 59 bp, Homo sapiens
  chr2:176944083-176944142
  hyper
ggaccgaaaaggaggcggcgcaacggccaccccttccagcacctcggctttgtccttcc

SEQ ID NO: 27694 - DNA, 59 bp, Homo sapiens; identical to SEQ ID NO: 240
  chr2:176944346-176944405
  hyper

SEQ ID NO: 27695 - DNA, 391 bp, Homo sapiens; identical to SEQ ID NO: 241
  chr2:176944456-176944847
  hyper

SEQ ID NO: 27696 - DNA, 132 bp, Homo sapiens; identical to SEQ ID NO: 242
  chr2:176945137-176945269
  hyper

SEQ ID NO: 27697 - DNA, 765 bp, Homo sapiens
  chr2:176945581-176946346
  hyper
cgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctctcccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaatta

SEQ ID NO: 27698 - DNA, 186 bp, Homo sapiens
  chr2:176946682-176946868
  hyper
attggagtcaccattcgggggccttcttagatccgtcaggccggacaaccgttcggattcggtggccgggaaataaataagccaattcctttggtgactaccccccgcggatttccagacccttagctaaatctagccacccagaaaggggaaaggggaaaaagaaacaatcaacccagatgcccc

SEQ ID NO: 27699 - DNA, 52 bp, Homo sapiens
  chr2:176947284-176947336
  hyper
ggaattgatggggtctgtcatgcttacaaattgctgccgttaatggaatcaa

SEQ ID NO: 27700 - DNA, 177 bp, Homo sapiens
  chr2:176947763-176947940
  hyper
cggctgctgactaggggtctaccggctcgctcgggctcttagacacgagcgcagaaacattttctcggactcaggagcgagggcgggtgggcctggtgttccaggctccgcaggcctgagcctggcgggaaagctcaaggagcagaactggaaggcacggtcccagacatgcgtccc

SEQ ID NO: 27701 - DNA, 74 bp, Homo sapiens
  chr2:176947941-176948015
  hyper
cccccgcccgtgctagctcggtgtagcttgcctgtggagggtctgagaggggaaaaggcaccgggaaaggctgg

SEQ ID NO: 27702 - DNA, 476 bp, Homo sapiens
  chr2:176948599-176949075
  hyper
tctaaatattattatcgctttcggagggaggcggaaaaattgtgggatgccagagcgagggaatgactggtcaaaatgacccatacatccttccgatcccgagatgtcattcatcaaaaagtagcgcccgctcgtcattaaggtacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 27703 - DNA, 46 bp, Homo sapiens
  chr2:176949372-176949418
  hyper
gctctcctcccaccccgggagagagagagagcggaagagagggaga

SEQ ID NO: 27704 - DNA, 321 bp, Homo sapiens
  chr2:176949681-176950002
  hyper
tttcctgaggggaaacgaactaggctggacgatttgatagcagaattcgacagctaactttaaacacagtggagatttacagcgccatacgggcgctccgaatccacgctcacgttgccagattttcccctccctcctcaaatagaattatttgcggcaaaggcgctggatttcgaggtcaaaagaggaaagaggagacagccttcttcccctacctccccgctgccctcccttcccctttgcttttcttccttctctctttcctcccctcatcaaccccagccccttacctgcggccacaggtattcccagcgttgggtc

SEQ ID NO: 27705 - DNA, 190 bp, Homo sapiens
  chr2:176950074-176950264
  hyper
cgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggaggacgggg

SEQ ID NO: 27706 - DNA, 352 bp, Homo sapiens
  chr2:176952741-176953093
  hyper
aagccccgcgtctgccgctgccggagcctggctctcctcttacgcggggggctgcgggcaattggggccgacaacttgcggtcccgccttgggacgcatgcttgctcgagagctggggctgcagggtgcagtgggacagtaggaccgcgaaagcctgggcttcgagcctcgggctccctgtcttcaggcgaagtgcggtttccacgggtgcaggtttcgctgcataagggaagactcagatttcgagccctcggcaggccagcttctagctctctgtcccttccgggtctctccggttgcttctgtctttcctcctcccactcccgtcgcaatcccgcgccccacggaggaa

SEQ ID NO: 27707 - DNA, 487 bp, Homo sapiens
  chr2:176956928-176957415
  hyper
agctcactcggatttggggtctagaagtcgactaactgagggattcagcaacaggataaaaaaatgggcctgttttcacatcattctgatcatctctgtccttcgtcttcattttgctgtgcaactcggggagccgaggagaggtggcaaaaacagcggttgccgagacaaggcgcaggccttggcgcccgcctcagtcgcagacagggcctgggatgggccgtcgcgcaatcaactcgtgggggtggctgcagcgcgtacgcctgggtcgggggggagggcgggaatgggaggtggaccctgcaaggggcaggagaggggtgggggccggagtgggtgggtccagccaggcctgggccgggagccaggctcccccgcgttcctacccccacgtggccgcgcgcagccaatggcacgcccccggcgggggccctcggggcgggaggcggccccccgaccggcccaggccccctcccaacctgaactt

SEQ ID NO: 27708 - DNA, 53 bp, Homo sapiens; identical to SEQ ID NO: 245
  chr2:176957576-176957629
  hyper

SEQ ID NO: 27709 - DNA, 529 bp, Homo sapiens
  chr2:176957914-176958443
  hyper
ggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggtaggggcgatggagaaaagggaccgacacgagggagggggaga

SEQ ID NO: 27710 - DNA, 363 bp, Homo sapiens
  chr2:176959148-176959511
  hyper
ctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 27711 - DNA, 65 bp, Homo sapiens
  chr2:176963189-176963254
  hyper
agccacccaattggtcgccataactcacacaataaagtggcagcgcggcggtcagtcttgccctc

SEQ ID NO: 27712 - DNA, 376 bp, Homo sapiens
  chr2:176963321-176963697
  hyper
cgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttg

SEQ ID NO: 27713 - DNA, 33 bp, Homo sapiens
  chr2:176964082-176964115
  hyper
ggataagtcgagaggcgccggttaatggaaaat

SEQ ID NO: 27714 - DNA, 253 bp, Homo sapiens
  chr2:176964389-176964642
  hyper
cggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgc

SEQ ID NO: 27715 - DNA, 36 bp, Homo sapiens; identical to SEQ ID NO: 6538
  chr2:176965474-176965510
  hyper

SEQ ID NO: 27716 - DNA, 358 bp, Homo sapiens
  chr2:176969256-176969614
  hyper
cggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctgggactggaatgaaagcgctctgggttgtggagtgggtcggggggcaagggtccgcgctaaggagccgaaaggggccggccgcccccttcccctatgcaccggcgcgccactgcagatggctcaccctcccccgccaaatcgctgctcccgc

SEQ ID NO: 27717 - DNA, 181 bp, Homo sapiens
  chr2:176969676-176969857
  hyper
cggtcagcaggctccatactgggggcgccgggctgcctgcaccccaccccgtgccgccagtagagagaaggtgcgagaattttgcgaatccccagacacataaagacccgggttgaagtcctcgcagctgccctgggtcctgagctaccgcagggccagtgtgcagcgtccagggagccat

SEQ ID NO: 27718 - DNA, 68 bp, Homo sapiens
  chr2:176970219-176970287
  hyper
ctctgtctgtccgcacggtgggcagagcgcacagcaccggcactgcagcagcccgggccagggaggga

SEQ ID NO: 27719 - DNA, 30 bp, Homo sapiens
  chr2:176970603-176970633
  hyper
gagggagtcaggctccgctgagagccctta

SEQ ID NO: 27720 - DNA, 95 bp, Homo sapiens
  chr2:176971337-176971432
  hyper
tcactccactctgaacgcgctgggcagaaaaatatgtaaatcagggctccctgcgccctggagagtggcgaaattactcccgcccggtgaacaag

SEQ ID NO: 27721 - DNA, 216 bp, Homo sapiens
  chr2:176972742-176972958
  hyper
cgggggcagtccctgcaccaaggcgacccctggctcggagcccaagggggcagcagaaggcagcggtggcgacggcgagggccccccgggagaggcgggggccgagaagagcagcagcgcaggtaggcaccgggtactgggcaagcggtgggcccgggggccgcgggggagggggggggggcggaggcctccctctgcttgcgcctttttatgtgc

SEQ ID NO: 27722 - DNA, 30 bp, Homo sapiens
  chr2:176974082-176974112
  hyper
aatggtaaatgcaaacgtcccgttacaatt

SEQ ID NO: 27723 - DNA, 123 bp, Homo sapiens
  chr2:176976065-176976188
  hyper
ccacccaaggcaagccgaacccgagataccattttccgtttgcaggggcctggagatccacacgagggcgcgctcacgttccagaagccgcgtttgaccaagaggccgcggtaccttgtctgt

SEQ ID NO: 27724 - DNA, 188 bp, Homo sapiens
  chr2:176980750-176980938
  hyper
ggttcctctgagagccgaagcctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggc

SEQ ID NO: 27725 - DNA, 130 bp, Homo sapiens; identical to SEQ ID NO: 249
  chr2:176981376-176981506
  hyper

SEQ ID NO: 27726 - DNA, 110 bp, Homo sapiens
  chr2:176982517-176982627
  hyper
cgcccgggcagaggaaaagcttgccggttttatttttcctgagctagacctgaacacaacaaaagagcgcaaaggagacctgcggctcataaacacgaccacagagcctc

SEQ ID NO: 27727 - DNA, 30 bp, Homo sapiens; identical to SEQ ID NO: 6548
  chr2:176983753-176983783
  hyper

SEQ ID NO: 27728 - DNA, 504 bp, Homo sapiens; identical to SEQ ID NO: 2125
  chr2:176986711-176987215
  hyper

SEQ ID NO: 27729 - DNA, 916 bp, Homo sapiens
  chr2:176993464-176994380
  hyper
gctttgggaaaaattcgtaactttgaggcctgcgcgctctctcggcagtaatttcacaggcttggcggaggaagtaggatcgttagcataagatgggccgcctgcagctgcctggaaccggcgcgatctgaacgccggctgggaggctcctggggggaacttgcggtcgtctgccctccgcactcctccgggaaccgcagccggccctggttcgctgcgcgccggggctgagacccgggagccgcgtcctgcccgaggaaatgtcaccctccccagcgcgagccctttttcccgcctcagaacgtttctgtccgctcttctatttactctctcagcaagcctaatgccccctcctgcattcttcagcctccccctgcgcccagggctgacgtctatcaagggtgaaatgatggaaactatattcatgggcatgatttccattaaatatcaattaacctgagagcctcggccaggcttgcggtgcgtcaagggtaaatgtacatctcatttccacagggcccgctcggctggaaaagaaaggctttgatttgctttgataacgccaggatctggggccacactcgcggcttttaattaaaccacttcgatatgccccaactcaaatgcacggtccggtccgtcaacacctcttgtccacgttccctgggctgcacccgcgtgtccagagctgcaaaagccacgggcaacctctgcttttgcagccaggggctcggggaggcagtcatttgctccgcagcctcctgggagtggcctccttggctcccccaagtctaaggctccgccgcggcccctccctgccggctgcgatccgcattcccgcggccccggggcacacggagcccttggcagtgcgtctttatgggccccctttaaggccggcggaggcatctcgggc

SEQ ID NO: 27730 - DNA, 103 bp, Homo sapiens
  chr2:176994497-176994600
  hyper
cgccggtgcgcaccgggtcggcagcctcggcggcgggggcgagattggcgggaggggggcgcggggggggcgcggtaagaggtggcggcgggcagagggtgtt

SEQ ID NO: 27731 - DNA, 44 bp, Homo sapiens
  chr2:176995072-176995116
  hyper
ggccgccgccgctgacgccccaatgagttcgtacttcgtgaacc

SEQ ID NO: 27732 - DNA, 337 bp, Homo sapiens
  chr2:176995331-176995668
  hyper
gggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccac

SEQ ID NO: 27733 - DNA, 38 bp, Homo sapiens; identical to SEQ ID NO: 6554
  chr2:176996261-176996299
  hyper

SEQ ID NO: 27734 - DNA, 185 bp, Homo sapiens
  chr2:176997536-176997721
  hyper
gggttacacacattccgcgctgtttaaaaaaaaaaaaaaaaaggccgcaggggccccttctttttcagagaggactggctagtctatcttgctctaaataatcttgctaagatgctctgagagctttgatcctcttaaaggactcaagttgtaggcccagtgggggacaacgcaaagtccatgtt

SEQ ID NO: 27735 - DNA, 43 bp, Homo sapiens
  chr2:177000770-177000813
  hyper
ggtagctgtggggatcgcttccccagagcgtgagcagtacatt

SEQ ID NO: 27736 - DNA, 57 bp, Homo sapiens; identical to SEQ ID NO: 250
  chr2:177001206-177001263
  hyper

SEQ ID NO: 27737 - DNA, 432 bp, Homo sapiens; identical to SEQ ID NO: 251
  chr2:177001264-177001696
  hyper

SEQ ID NO: 27738 - DNA, 267 bp, Homo sapiens
  chr2:177001781-177002048
  hyper
cgacccccttgggcagctcagtccggctgctcccctacatttcccggggaagtggggggtcgctgtctaagccccttcccccaatcacttcgttcctagggcgtcccctggggcctggggtggagtccggctgggttcagaagtctaagggggcagtattatttcaaaaattctgagatacgggtagccacagacaggatcccactgcctagatggagagcccctcaatcctaccctaggaaagtgtatagacgggttactactgaa

SEQ ID NO: 27739 - DNA, 320 bp, Homo sapiens
  chr2:177003734-177004054
  hyper
cgatagcatgtccgggccttggtgacgacgggtcaggccatgaactgggcttgagatctctggcgaggaccaggagaaagacgaagctcgaaattataaatgtggccaagcacgagagctgaaaacaaagcgtattttcccgtcagatgtttctacaaataaatttcgccagagttctgttttctgaatcagagaggcaagggaaatcgaacaaagacagtatttcaccctgggctggcaggcagctgttagaggtatttacggccttgccgcagtgcggcggccaggcagccgggtagggtatgcgggggcaccggaag

SEQ ID NO: 27740 - DNA, 48 bp, Homo sapiens
  chr2:177004450-177004498
  hyper
ggcgtagaagcagtgcgcggtaccttatccgcactgcgcggtgcaagc

SEQ ID NO: 27741 - DNA, 151 bp, Homo sapiens
  chr2:177004555-177004706
  hyper
cgcatgtgcagtgaaatggcctagcccgggaattcgatcggcaaagcacgggtgtgggggcgggggggtgggggggggcgagtggactcgagcaggaagatacacccgatctttccattctccctccgtcaaggctcgctactcatcttgc

SEQ ID NO: 27742 - DNA, 697 bp, Homo sapiens
  chr2:177004982-177005679
  hyper
ttcaggccaatccttcggcctgaccattcccggatcttgttatgccagcacagcacattcgagggctctggggggcagcagctcggcgaagagcagtcaaataaataaataaataaacaaataaatgaacggacatataagggcttttcccgcctgggttcgcttaaataatgggggacaagcgcctctgggccacgagcttgttgtttgtcctgggatggggggtaggggatgagaggtggcctcaggtccctcttgctccttccagccgccccaggggacactgtagaaccagcctctggtgcggggagacctccgcctgccggaggaagtcccagcctcaggtttccggggctggtggtctccctgctctgctgtctggcgcctcgtccaggaggaggcgctgtaggacaagcgtctcgccggctgcggcgggccggggagggcgggagcggagggatcggtacccgctcctcccttcccgcgcactctacctccgcgcgccaagtgtgtggggcctcgaacaagggtcgacggtgctgcgccccgtcccccaaggggttcctttccccagactggcagtggaagcagctccgaggcctgggagcctagggccgttccgggttggcgggccacctcgctttctccgcgctcccggagggggcgcgatttcctcgtgctgcgcttgtaggagcag

SEQ ID NO: 27743 - DNA, 224 bp, Homo sapiens
  chr2:177042579-177042803
  hyper
ctcctctgcaagggtcgagcggaagagtaggtctggtgagctgagctctagggagctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctg

SEQ ID NO: 27744 - DNA, 86 bp, Homo sapiens
  chr2:177042913-177042999
  hyper
cggccaggctgcgggcggggtgggctggcgctcctgatccacctggaacacttttgcaaagacagacggtgagttaatcaccctac

SEQ ID NO: 27745 - DNA, 290 bp, Homo sapiens
  chr2:177043266-177043556
  hyper
ggcgcctgctggggagctgcgcagccaggacagcggtcggcagcacagggcctgggcgcagggcccgccgtcaccacctcacgtcggaagccagcactgctgcccgccagccctgccgcctgccctcggacttcccagggcgcccagggtcctcccaacgcgcctgcacccacacccgcccctgagccacagtgaccttgcattccccgccccctgccacacctcctgcgtgcccgagtgtcacccttaaataccgctctacacccagagagggacgaatacacctctga

SEQ ID NO: 27746 - DNA, 132 bp, Homo sapiens
  chr2:177052963-177053095
  hyper
gcagtctccaccggccgcgcgtcacgctcccatttaaccttttccatgccgcgacgcccacactccgccctcgagggactagccccccccacgatccagagcagaagcggctcgccccgctgcatccacggg

SEQ ID NO: 27747 - DNA, 100 bp, Homo sapiens
  chr2:177053335-177053435
  hyper
ccagcgccacgtggccgcccccgccggtatattaggccactatttacctccggctcactcgccatgggttggagagggcagctcgggtagagagggctgg

SEQ ID NO: 27748 - DNA, 85 bp, Homo sapiens; identical to SEQ ID NO: 6564
  chr2:177053618-177053703
  hyper

SEQ ID NO: 27749 - DNA, 48 bp, Homo sapiens
  chr2:177053906-177053954
  hyper
cgacggcgggtctcacgtccactacgccacctcggccgtcttctcggg

SEQ ID NO: 27750 - DNA, 364 bp, Homo sapiens; identical to SEQ ID NO: 254
  chr2:177053999-177054363
  hyper

SEQ ID NO: 27751 - DNA, 42 bp, Homo sapiens
  chr2:177502246-177502288
  hyper
cagcaaagcgagggccggctgcaaaggcgcaggctggcagtt

SEQ ID NO: 27752 - DNA, 374 bp, Homo sapiens
  chr2:177502526-177502900
  hyper
gggaagaggggtccccggggccccggatgcgctgaactccggggaggggatgggcaggagagagagcacactcctggagccgcgacgtccaaacccggacgcacttgaacccgcagcgaggcccgtggctcgcggccttcggagagcacccgcgccccgcgcagaccggacgccggccttgcccgatcctcggcatccttcggcggggcggccagtcccagggcgctcgctgagggccacaccctggccccagagtttagcaccgccgcgggcagggcgctccgctcccggaccccgaatctgaaagcggagaccaagggctgcctgcggcaaagctcgacatacacttgattttcttccgatttggagaaaat

SEQ ID NO: 27753 - DNA, 441 bp, Homo sapiens
  chr2:179278428-179278869
  hyper
cgctccctctgaattcgccgggcagggatacagccgcccggggcctcttgctcgtgcttggttttccggaccttgcttcctaaagggtctttaggggttcccggactcctccgcctgggagcctctatccgcctgggagcctctatgcgccccgcaaagcccccggcagagccgaggggaggcttcattggcgacctggtggggcctcgcggccctgctccctgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtaagtattgatatcgtcctatagcattt

SEQ ID NO: 27754 - DNA, 487 bp, Homo sapiens; identical to SEQ ID NO: 6570
  chr2:180725172-180725659
  hyper

SEQ ID NO: 27755 - DNA, 146 bp, Homo sapiens
  chr2:180725935-180726081
  hyper
gcgcagacgttctcccgcgatctgctgcagcccaggcggtggcggtggcggtagcagcggcggcggtggaggtggcgcgggcgacagctcggcccggcgcggcccctgaactgtccaactcttgcccgcgccgggcttaagcgccc

SEQ ID NO: 27756 - DNA, 30 bp, Homo sapiens
  chr2:180726333-180726363
  hyper
cactgcagagcctcccgcagcatcgctgcc

SEQ ID NO: 27757 - DNA, 58 bp, Homo sapiens
  chr2:180726645-180726703
  hyper
catatttggcggagccgggaaggcccggagcgcaagaaggcatcgcagcctcgcagca

SEQ ID NO: 27758 - DNA, 158 bp, Homo sapiens; identical to SEQ ID NO: 255
  chr2:182321397-182321555
  hyper

SEQ ID NO: 27759 - DNA, 79 bp, Homo sapiens
  chr2:182321759-182321838
  hyper
aacgaaagaactggacggctccccgccgcagtcccactccccgagtttgtggctggcatttgggccacgccgggctggg

SEQ ID NO: 27760 - DNA, 154 bp, Homo sapiens; identical to SEQ ID NO: 257
  chr2:182322038-182322192
  hyper

SEQ ID NO: 27761 - DNA, 643 bp, Homo sapiens
  chr2:182322399-182323042
  hyper
cgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagct

SEQ ID NO: 27762 - DNA, 242 bp, Homo sapiens
  chr2:182521404-182521646
  hyper
ggtggagcaaaagctcgtgggtgtaggccttgggccggggagagggaggaagcgcggagggaggcgaagacgcttggggccgggcactcacccgccgggcgctcgggctgaatgggccgccaccgcagtgctcgctcgctcagcaccacgtcacaactgtccctcccgatctcgaagatgccccggagcagaatccgctcggccgccgcctccgtctgctgcggggacgttaacagcgccgg

SEQ ID NO: 27763 - DNA, 37 bp, Homo sapiens
  chr2:182542469-182542506
  hyper
taagcacagtgggttcgtttcccggaaatggtgaaac

SEQ ID NO: 27764 - DNA, 440 bp, Homo sapiens; identical to SEQ ID NO: 2139
  chr2:182542878-182543318
  hyper

SEQ ID NO: 27765 - DNA, 344 bp, Homo sapiens
  chr2:182543758-182544102
  hyper
agtgttttataatggcgcgtgcgtgtgccccgctagtacgtaggagtgaggacaggactgggggagggtagtgaatatgtatatgtgtacaccactcacgcatatgtgtttgtatcctagtgattaacttaaatgtgtttatggtggttgcccgacaggataatgtgtgtggaaatgactgtacatttcagcgacttcatgtttatccaaatgtgttcaaagttactcacaactccataaaaaaaaaaaaaagctgtaaaatcacacattctacttccatttctgtcctggcttccagatacttagcgatttaagttgaacagccattgcgtaatttactaata

SEQ ID NO: 27766 - DNA, 30 bp, Homo sapiens
  chr2:182544495-182544525
  hyper
caaccgcgaagttgccgcttctagtaagga

SEQ ID NO: 27767 - DNA, 751 bp, Homo sapiens
  chr2:182545197-182545948
  hyper
cctggggcctccggacgccgcgcctcctgcgtgggcgaattcctcgtgtcgtggccgcgcgggcgctcaggttatatagcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattgg

SEQ ID NO: 27768 - DNA, 84 bp, Homo sapiens; identical to SEQ ID NO: 2141
  chr2:182546001-182546085
  hyper

SEQ ID NO: 27769 - DNA, 147 bp, Homo sapiens
  chr2:182546388-182546535
  hyper
gttccctggccagcccgccctggacggcctcggctctctagtccaggcattgaccacaagtacggtggtggacacctcgccacagccggacctgcgctcttgctcccctcagtctcgggtctgtataagatacttgattcagacaag

SEQ ID NO: 27770 - DNA, 189 bp, Homo sapiens
  chr2:182547199-182547388
  hyper
acttggctgacaaagcgcataggggaggataaaataattcacccaggagcctgggcccaggatttacccctgtactgtctgtatcttcagtgttgggctaaaactcgagggcgtcggagtactagcccttagaagatagtacacagcccgacgtttgcggcagggccaggttaagtactgcccctcacc

SEQ ID NO: 27771 - DNA, 495 bp, Homo sapiens; identical to SEQ ID NO: 259
  chr2:182547437-182547932
  hyper

SEQ ID NO: 27772 - DNA, 100 bp, Homo sapiens; identical to SEQ ID NO: 260
  chr2:182548061-182548161
  hyper

SEQ ID NO: 27773 - DNA, 389 bp, Homo sapiens
  chr2:182548400-182548789
  hyper
gcgcgcggcgcgggccgggcgtcccggccgttacagcggcagccggagcgcccgcgggaaggggggcgggaggaggcgtgtggccaggggtggggagaggggagtgtggcctgggccgggcggaggggaagggggaggcatgtgggaggatgggggtggggaagggatggaggcgtgtggcccggacgtagggggtgggaagcgtgtggctggaggcgaaagcggggagcgggaggtcgggggcgaagcattcacagggccaagataaagcgcaggggccgggccggcgtccctggcggtgacctgtttctcagggaaacagatgctcgctcttgcaaagggaggtttgcgttcaatgaaaggatcaagtgtggccagggcagcccggc

SEQ ID NO: 27774 - DNA, 207 bp, Homo sapiens
  chr2:182548819-182549026
  hyper
cgccctgcctaggagtggggtgtcggggcctgggcgcgggagagcggagtgagggggccgggtggctgaggggcccgcgagaccgtggggctcaggggccgcaggaacggagggctgagagctgcaggtcctgcacaggctgggtagctcggaggctcttgagagcttcgggggatgaaggggggttgatgcgggttctgaccagac

SEQ ID NO: 27775 - DNA, 508 bp, Homo sapiens
  chr2:182549037-182549545
  hyper
cgcctccgccccgggggaggcagttgggctcccgggtcctggcctgaggctggagctgcccaggctcgacaggcaggcgacccgggagagccaagagcaacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttagggagtgatttagtgccgggcttccccagctcggcctgcctgggcctttttatttattatttatgccctcccggtcccgacggggctttggtggctcctttgtcggctcccacaggccttggaaggacttgtctctgattccctgtcaggatccaggggctttccttaaaccatccaacactcagaatcaacaacgtaaaatcaactca

SEQ ID NO: 27776 - DNA, 131 bp, Homo sapiens
  chr2:182549876-182550007
  hyper
cgcacacctgtttcccggggatcgaggaacagcttgctgtccaaaggggatcgcagggccagggaactgacaagcacacgctatttgccaacctttgccttaatagaaagaagcaagcaaacaaaaatcct

SEQ ID NO: 27777 - DNA, 71 bp, Homo sapiens
  chr2:182550053-182550124
  hyper
cggcgccggagcgtcgcaagaacaatggttgctgcagtgggttgggagagaggacccggacaagttcctaa

SEQ ID NO: 27778 - DNA, 319 bp, Homo sapiens
  chr2:182819030-182819349
  hyper
gcgcgcacacacacacaccccaccccaccaccccgacctccacatacattcccccgaccccctccagcagtgaagtctaagagcaccgcgaagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcac

SEQ ID NO: 27779 - DNA, 159 bp, Homo sapiens
  chr2:183731173-183731332
  hyper
tcacaggctgcagcccgagccccgggcacccggagcaggcagagagcagccagggcaagcagcccggcccgcagcagcagcatccctcccgggctgccgcagaccatgatcccggcaggatggggcagggtgcagccgcgcagtggacgccaaaaggcc

SEQ ID NO: 27780 - DNA, 640 bp, Homo sapiens; identical to SEQ ID NO: 2146
  chr2:183731466-183732106
  hyper

SEQ ID NO: 27781 - DNA, 1157 bp, Homo sapiens
  chr2:185462639-185463796
  hyper
acaactaccctcccccgaaactatcatcaacacaagcacttacggtatctacaaatgtgtgggagcaggggtgggtggggggcatattttctttcctcgcctttccctaagactgaacagggtaccagcctccataccaaacacacattaaataacaaaatcaaataagccaaacccagtggatagcaattatcttgagaaagaagccgctgctggcaccggcctggattcgctgcagtcggaagcgggtggctttcggtattgaattattaatttatttatccccctcgcccccacccccacgccgactgccaggcaagaaatcgcggcctcttcgcttcctctccgcccccaccttccaggagtctcccacttggcggtggccgtcgcgtccccggccctctgcggcagcggcgccgcgcggggcgctcccactcgcgctcgggctggcgcggccgcgggtcccggcggcggggtgggcgggggaggcagcgggtgacagatgtactcctctgacagctctcagtatcagcccagtggctccctgccattggctcagtgcaatggaccggcaacgccgctcactataataacactcatgcctgccagcagcagcaactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaagggagttttccggggccctctcagcaagaacgggaacaaaactct

SEQ ID NO: 27782 - DNA, 210 bp, Homo sapiens
  chr2:186603443-186603653
  hyper
ccctcaggaggccaccgcccttctggggccgctaccattggaagcctggaacgcggggggcggggctgaggtcgttgggctctggccattcctggtcaggtccggacagagggacaacggggtgctagagaaggagagcggggcgggtgaggaaggggctgagggggctgtgccggccatggagctgtacctcggcgcctgctccaagcc

SEQ ID NO: 27783 - DNA, 210 bp, Homo sapiens
  chr2:189156634-189156844
  hyper
ccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcag

SEQ ID NO: 27784 - DNA, 75 bp, Homo sapiens
  chr2:190445180-190445255
  hyper
ggtcatgacactaggcgaccccgctggctcttctgcggctgctatcgctgctgctgctctcgctgaggtgcttgt

SEQ ID NO: 27785 - DNA, 61 bp, Homo sapiens
  chr2:191045133-191045194
  hyper
gagctcaggagagttcgcagcccagggggccgagaccaggggcagggccagcgaaatgcct

SEQ ID NO: 27786 - DNA, 32 bp, Homo sapiens
  chr2:192015371-192015403
  hyper
ctcactttcagcctccgcgaggacacacctcc

SEQ ID NO: 27787 - DNA, 307 bp, Homo sapiens
  chr2:193059011-193059318
  hyper
ggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcag

SEQ ID NO: 27788 - DNA, 205 bp, Homo sapiens
  chr2:193059344-193059549
  hyper
cggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggaga

SEQ ID NO: 27789 - DNA, 56 bp, Homo sapiens
  chr2:193059661-193059717
  hyper
cgtttgggaagcagcaggtcctcagcccgcccggggtcacgtgggaagaggcagtc

SEQ ID NO: 27790 - DNA, 1228 bp, Homo sapiens
  chr2:193059718-193060946
  hyper
ggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgc

SEQ ID NO: 27791 - DNA, 1078 bp, Homo sapiens
  chr2:197457183-197458261
  hyper
agacctctgcagtctcgcgtcctcggaaacgtctacgtctaaatctgcagccccagtttgctccaggccccaagctccagcagaggatgttcacggcacattcccaaccaaaaaggaaatgaagcgtcctctccctcaactgatgctcaaatagaccccaaagtcccagtttccctggagaaccaaaccatccaacacatcctgggcagcggaaaccgaaatggcaaatgaatgaccgcgccggggcgcaagggaggaaaaacaaagccacctcccgccgtccgctacctgcggcgagggccgcgcgctcacctgggctttgcgcccgtcgccacaagctgcgggtggggacccggccgcggggcgggagggcgcccccaaagtcgcccggacccgcggccccggcgccctgcggccggtccgtgcgcgccgaggagaaagcaggcggccgggggcgccgccgcgcgttgcatgcagctcacggctgctgcggccgctgccacggagccgagagtctctgcgctgcagtccccgaccccgagaccgcgagaagcgcccggagagacgcggcgcaggggcagagcgcgctcggcgcgcccctcagcggctcttcccgccgccctccgcagcgggctgggtctcggctcgcctttgtgctggcatcttcctagctcccagcgacacccagagctctcgaggcggctccgcgccgccacccacccccgggttacgccacggcccccgcgcgacccgccgattgtgtcgagtcagcagcggcagcggggacgcgcgaagccatggctcccgcccgcgctcgggagggcgccgggggtcctgcgcctccgggaggtttgtggccgagcgcggcgcggccccgagcggccccgcagcgcccggctccccgccgctcgctctccaggcgccgacccgcctgcgtcgccaccctctcgccgctccctgccgccaccttcctcccgcccgggtgccgggcgtccgctccagccgcggtgccccggtccgcggagagcgaagagtccggcctcctcacctccagccgcgccggcgcccttcccgctag

SEQ ID NO: 27792 - DNA, 90 bp, Homo sapiens
  chr2:198651504-198651594
  hyper
agcgggtcccggccccgctgagcacctccagcagtggcacagcctctggaggggtccgggacgaagccacccgcgcggtagggggcgact

SEQ ID NO: 27793 - DNA, 35 bp, Homo sapiens
  chr2:198670222-198670257
  hyper
ctcagctgtcagccacgagacgcacaagtgacttt

SEQ ID NO: 27794 - DNA, 60 bp, Homo sapiens
  chr2:200321938-200321998
  hyper
tccgcctgcattccccgacttcgcggtccgagaggccgagagcggcggggaggggacttc

SEQ ID NO: 27795 - DNA, 29 bp, Homo sapiens
  chr2:200327423-200327452
  hyper
ggaggtagagactgtggaggtcctcctcc

SEQ ID NO: 27796 - DNA, 219 bp, Homo sapiens
  chr2:200327575-200327794
  hyper
cgagggtctggggctagtggggccgaccgttcaggagccgggtgggcgggaagggaattgccaaggtcggcccaggagctgcctcaggcgaggacggggagctttctgcactgggcttcccggggtaggagatgggcgtcgggtgtgggcactgcctgccctgggggaagaaagcgaggagataggtttcagagctgggggagtcgttggtgggagatc

SEQ ID NO: 27797 - DNA, 133 bp, Homo sapiens
  chr2:200328171-200328304
  hyper
ggcccaaggtggctgcgaagagccccgaggcctcggcttggcgtcaatgtcccgccaccctcgagcccgggtcactgcccgggtcccggcccggagccccagcgtcctctcccgacagcgccaccgcgtgggc

SEQ ID NO: 27798 - DNA, 18 bp, Homo sapiens
  chr2:200328667-200328685
  hyper
gaggctatgggcccacgc

SEQ ID NO: 27799 - DNA, 365 bp, Homo sapiens; identical to SEQ ID NO: 2153
  chr2:200329029-200329394
  hyper

SEQ ID NO: 27800 - DNA, 313 bp, Homo sapiens
  chr2:200329432-200329745
  hyper
cgcctactcccttattattggctgggacctgttcctttccaaagtgtgatgcccggtgtcctaccctaggccacgcggagctctctcccggcgtgtcgggccctgcgcccctgcccagtggctcacctcggctcgctgcgcccgccttcgccccaagtgcccaggacggagcgaggggctgtgggtcggcgcagggacgctggctgctcacctccaggagccgacagaaggtgccttcggcgtcacgcgtccaaccctggggctgatttaaataactaataagctcagagaaattttacgaggggaacttttc

SEQ ID NO: 27801 - DNA, 15 bp, Homo sapiens
  chr2:200333744-200333759
  hyper
gtctgcgtgcctcac

SEQ ID NO: 27802 - DNA, 34 bp, Homo sapiens
  chr2:200333800-200333834
  hyper
cgagaaagggcccacatctcgagtctccagtctc

SEQ ID NO: 27803 - DNA, 30 bp, Homo sapiens; identical to SEQ ID NO: 6604
  chr2:200334190-200334220
  hyper

SEQ ID NO: 27804 - DNA, 184 bp, Homo sapiens
  chr2:200334978-200335162
  hyper
tcgcagcccctgccgcggaggatccccaggaagatgctggggacgctctgagcatcggcctttctttacccccgactccctggagcttggtctcgggatgccaacttggggcacggaggcgacgggctgctccgaagctggagggtttctgcttgggtcagagggatcacgacctcagcagagc

SEQ ID NO: 27805 - DNA, 15 bp, Homo sapiens
  chr2:200335437-200335452
  hyper
acaccagtgggtacc

SEQ ID NO: 27806 - DNA, 361 bp, Homo sapiens
  chr2:200335591-200335952
  hyper
cgtgtaagcaacctcccactttgaaactaattcgcacccgggtctttcaccccaaaggactttgctgcggacgctgctctgacccaagacgcgggagagaagtcccaaaggctacagccaggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctg

SEQ ID NO: 27807 - DNA, 82 bp, Homo sapiens; identical to SEQ ID NO: 6607
  chr2:200336264-200336346
  hyper

SEQ ID NO: 27808 - DNA, 81 bp, Homo sapiens
  chr2:200524136-200524217
  hyper
attgtgggaacggcccgcggcccgttttcgggaggaggcggagggcgcgaagcgagctggtggatccgtaaagaacccagc

SEQ ID NO: 27809 - DNA, 253 bp, Homo sapiens
  chr2:201450490-201450743
  hyper
caatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggc

SEQ ID NO: 27810 - DNA, 178 bp, Homo sapiens
  chr2:201450744-201450922
  hyper
ggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggc

SEQ ID NO: 27811 - DNA, 65 bp, Homo sapiens
  chr2:201451013-201451078
  hyper
cggctttgccttcgcattcccacccctgcctccggggcagctaaaggctgcgttttcagggactg

SEQ ID NO: 27812 - DNA, 253 bp, Homo sapiens
  chr2:202899715-202899968
  hyper
gccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatg

SEQ ID NO: 27813 - DNA, 30 bp, Homo sapiens
  chr2:206546689-206546719
  hyper
agctgccgaccggctcgctaccccaaacac

SEQ ID NO: 27814 - DNA, 30 bp, Homo sapiens
  chr2:206550029-206550059
  hyper
cagctccccaaaatgcgatctcaagccgtg

SEQ ID NO: 27815 - DNA, 429 bp, Homo sapiens
  chr2:206550262-206550691
  hyper
actgagcaaataacacggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctccgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtga

SEQ ID NO: 27816 - DNA, 42 bp, Homo sapiens
  chr2:206550973-206551015
  hyper
ccagggaaaagcctgcggcatttcttcaacgctgccctatgc

SEQ ID NO: 27817 - DNA, 292 bp, Homo sapiens
  chr2:206551071-206551363
  hyper
cgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttcccaccgggtcgcaggcgtccagcggctgggtggcgggcgccggtagccctagtgtttggaggtgggggagggatttggaatagacttgt

SEQ ID NO: 27818 - DNA, 24 bp, Homo sapiens
  chr2:206551450-206551474
  hyper
cggcttctgcggctccggctgaat

SEQ ID NO: 27819 - DNA, 105 bp, Homo sapiens
  chr2:207139050-207139155
  hyper
tagctctcttagccccgttttcttttctacattcatacgttgctttgaattggcaagcagtttttatttggaccctcaaacgctaaaaccttggtctctacttcg

SEQ ID NO: 27820 - DNA, 606 bp, Homo sapiens; identical to SEQ ID NO: 2158
  chr2:207139217-207139823
  hyper

SEQ ID NO: 27821 - DNA, 120 bp, Homo sapiens
  chr2:207140044-207140164
  hyper
gggcacctgtggggccgagatcccgagccacctgtccacacacccccttcccccagtgccctgcgttgggtccagctggccccagacctaggcctttcccagcctcgggcgattatagtt

SEQ ID NO: 27822 - DNA, 15 bp, Homo sapiens
  chr2:207307463-207307478
  hyper
tctgtattgcttccc

SEQ ID NO: 27823 - DNA, 1373 bp, Homo sapiens
  chr2:207307547-207308920
  hyper
cggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccc

SEQ ID NO: 27824 - DNA, 30 bp, Homo sapiens
  chr2:207309199-207309229
  hyper
tgtttcctcaaatttcgtatccggcgcatt

SEQ ID NO: 27825 - DNA, 440 bp, Homo sapiens
  chr2:207506716-207507156
  hyper
ctcatgtccctcctccgaccccaagagtccacagtcttccctcacacccctttattctcggacgaggcccgtgtggtgagcgggaacccctgctgtcccctggaccagcgcggagctgggccctaactttgcagttcccgccgcatcggcacgcacccgcgaggtgggagcgggaagcccagccgcattagaggctcaattccggcaggtgcagagtgggtgcgggtcaaggccaatgagagtgtgtgtggccaagcccgctggtttcctgaaccgaaattctccggggagggagagaagaggagggtgcgggagacggacttggaggcgagaggtggcggcagtttccaggagctttgacgtagacttggagaggcgccgagcactcccactgcttaagtagaggcacggtagcctccaggacgcggaagctggggaca

SEQ ID NO: 27826 - DNA, 60 bp, Homo sapiens
  chr2:208030115-208030175
  hyper
cagagcccacaccaacgcagcccctgcgtctccgccgccaccacacgatttacacaagta

SEQ ID NO: 27827 - DNA, 87 bp, Homo sapiens
  chr2:208546197-208546284
  hyper
cgccgcggagccgcgcggagcggagccggcgagctaacccgagccagccggcgggcgtcccggaggcggcggcgcagggaggagccc

SEQ ID NO: 27828 - DNA, 30 bp, Homo sapiens
  chr2:208633276-208633306
  hyper
cctcgtcctgcgtgtcgtggttgaactggt

SEQ ID NO: 27829 - DNA, 131 bp, Homo sapiens
  chr2:208635643-208635774
  hyper
ctggcacatagtagccgcccaaatggcaaccctgggattcgaacccaggtagttggtcagcggcactcaccatcgtagccgcccctccccccatactatcgcagcctccctggcttcgacctttacttttg

SEQ ID NO: 27830 - DNA, 15 bp, Homo sapiens
  chr2:209271322-209271337
  hyper
gaagcagaaacattg

SEQ ID NO: 27831 - DNA, 48 bp, Homo sapiens
  chr2:210636334-210636382
  hyper
gagtgcagctcggagcggggaaagccgaattccgggggctgaagaggc

SEQ ID NO: 27832 - DNA, 261 bp, Homo sapiens
  chr2:210636429-210636690
  hyper
cgtacccctgcggctcaagctgccccggattcgcttctccggccgtgcagcccggcgcgggccgctgtccacagtgggaggtgctgaaagcagggagcgggtgcgggggcggcgaggcggaccgctgctccgagcgcccccctcctcgctccgcggctcctccagccctcccctcctcccgcagccatgttccacgcgcggggaggggtggggggaggggagaggcacgggggatcagggcggagagagccggctctgcct

SEQ ID NO: 27833 - DNA, 140 bp, Homo sapiens; identical to SEQ ID NO: 6623
  chr2:210636737-210636877
  hyper

SEQ ID NO: 27834 - DNA, 31 bp, Homo sapiens
  chr2:210636933-210636964
  hyper
cgctcctggggccgcccgggtcgccgctgcc

SEQ ID NO: 27835 - DNA, 170 bp, Homo sapiens
  chr2:211089565-211089735
  hyper
caaaacgcaggctcccgggtcccactgcaggccgctgaactagacgggttggattggggctccggaatgaacttctggagaaatctttcggctttccccgacgtgggctcggcggtctgttctcggggcggcacggctgacacccctttttcctccgcccagatgctggt

SEQ ID NO: 27836 - DNA, 30 bp, Homo sapiens
  chr2:211090029-211090059
  hyper
ggctactcggcgactcggggcagggtcccc

SEQ ID NO: 27837 - DNA, 330 bp, Homo sapiens
  chr2:213401235-213401565
  hyper
ggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtc

SEQ ID NO: 27838 - DNA, 381 bp, Homo sapiens
  chr2:213401566-213401947
  hyper
ccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcg

SEQ ID NO: 27839 - DNA, 887 bp, Homo sapiens
  chr2:213402687-213403574
  hyper
cacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtgggggtgcgaggggggcgggcgcggcgcgcgcggtgtggcgactcccagggcgggcgaccgagtccgcgcccgcgggtccagggccggggcccgaggagggggcgagtgtgagcgcgtgtgtgcgcgtgtgggagtgtgctcggtgtgtgcgcttggcgctctgggccggactgtgcagctatttccccgcgtgagccttcgcttgctcgctccctcctcact

SEQ ID NO: 27840 - DNA, 88 bp, Homo sapiens; identical to SEQ ID NO: 6628
  chr2:213403913-213404001
  hyper

SEQ ID NO: 27841 - DNA, 81 bp, Homo sapiens
  chr2:216300213-216300294
  hyper
agcgtgctcaaaactcggtccttttgtgtgcacagctggtttctctcagtaaagcgcgcacacactcgcacacacgcgcgc

SEQ ID NO: 27842 - DNA, 261 bp, Homo sapiens
  chr2:216301526-216301787
  hyper
gcttctactaagtaccgggagttccgcggggcgctttgcagatcccggggaagttcagagaatgaagttttcttttgcaaggacaaagtaacagtttacttttttacacatgcaggaaagccttcctttcctggggatgggacgcccgtttccactgaaagtgaaatcactgtgaacaacctgaaaattggaaagttggaccagctgtggggagagaaaggtcttcgtgtcctttcccacgttcaccgtgccagttacaca

SEQ ID NO: 27843 - DNA, 55 bp, Homo sapiens
  chr2:217236010-217236065
  hyper
cacccctgctgcagtcggcaaatccgtggcgccctcccctcggttccatcaaagg

SEQ ID NO: 27844 - DNA, 69 bp, Homo sapiens
  chr2:217237047-217237116
  hyper
ctgcattcagcaccccgggcgagtggacagctcccacccagaccccgcgcgtcacgctcgtgggggcct

SEQ ID NO: 27845 - DNA, 182 bp, Homo sapiens
  chr2:217497788-217497970
  hyper
cggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcaggga

SEQ ID NO: 27846 - DNA, 71 bp, Homo sapiens
  chr2:217557250-217557321
  hyper
caccttacgttctttcggtgtgactggattgttacccagggcggtggctcccaagccgggaaatcaattaa

SEQ ID NO: 27847 - DNA, 620 bp, Homo sapiens
  chr2:217558904-217559524
  hyper
agtagggggagggggcgggcaacgtgtgggtaggaggaaggagaaagagcgaaagctgggatagactcggctagacagttcccccgggtagcaggatcctccagggctccaattccggggtgcaaggaccctccccgactactcccgagctgcaccccagctcgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgccgcacgactgcccctcggccagggcgcaggtcatgcagcagccgcagcccggctccttgaccagctcgcagcccagggggctgggggggcacatggagagggctttctcgtcgcagggctcgcagtgcacgaaggagcccaggctctgggccggccccgcataggcggccagcagcaggaggaccgcggtgagcaacaccatcttctcttagtcgccccctttacctc

SEQ ID NO: 27848 - DNA, 155 bp, Homo sapiens
  chr2:218806147-218806302
  hyper
ggaagcagctgggtgcggacctggtaggcagttgagccacgggtgtgagggaggggcacagtgccagggcagagcgtcgggctcttggttccttacacattggcaggaaggagggggcccctgcgagtggtctgcgcccacgccccaggccagag

SEQ ID NO: 27849 - DNA, 30 bp, Homo sapiens
  chr2:219232829-219232859
  hyper
agcgtccctggctagcgtctagtgtctcgg

SEQ ID NO: 27850 - DNA, 30 bp, Homo sapiens
  chr2:219723919-219723949
  hyper
tcaaggagaggctgacgaaggggcatgagg

SEQ ID NO: 27851 - DNA, 301 bp, Homo sapiens
  chr2:219724722-219725023
  hyper
cgccccctgcccacccgggcggccgtagggcggtcacgatgctgccgcccttaccctcccgcctcgggctgctgctgctgctgctcctgtgcccggcgcacgtcggcggactgtggtggtgagtccggctgtcctggcgcggctctggaccctggagggtggggaccccgggacccaggacagactggggtgttccgcagcctcccggctctacctgctctccgagcccagctttctggcctcggccgggggcgtttctgaactccacttcgacgttcctaaccctcgggaacattctatt

SEQ ID NO: 27852 - DNA, 73 bp, Homo sapiens
  chr2:219735785-219735858
  hyper
atctgcaggaaggcacggcggctggccgggcggcaggccgagttgtgccaggctgagccggaagtggtggcag

SEQ ID NO: 27853 - DNA, 470 bp, Homo sapiens
  chr2:219736117-219736587
  hyper
ctggggcagccctcccgccgcaggtttcaggtcccaggccccagctgaccgccccagcccgcgctgattgcacctgtctgcattcacagacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggtgcgtacgggcaggatggagtgagtgtgtgcggaaatgtgagtgt

SEQ ID NO: 27854 - DNA, 142 bp, Homo sapiens
  chr2:219773737-219773879
  hyper
caacctcaaccaacacgtaggcgaggatgcccagggtgagcgccagcggcgagaagacgcgctatcgcgagatcggtgggacctacgcgtttacaggccggaagtgaggggcgggcctaagggggcgcgctccttttgaaac

SEQ ID NO: 27855 - DNA, 56 bp, Homo sapiens
  chr2:219823921-219823977
  hyper
gaggagccagtgcaacgcgacccatctgggacctgggcatccggtgagggcactca

SEQ ID NO: 27856 - DNA, 69 bp, Homo sapiens
  chr2:219824277-219824346
  hyper
atcaggagtgcaactcgggagcggattggccgcgtgaggcggggcacggcgcgacgaaaaaaggggccc

SEQ ID NO: 27857 - DNA, 307 bp, Homo sapiens
  chr2:219824786-219825093
  hyper
aggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccgg

SEQ ID NO: 27858 - DNA, 419 bp, Homo sapiens
  chr2:219825130-219825549
  hyper
cgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgg

SEQ ID NO: 27859 - DNA, 30 bp, Homo sapiens
  chr2:219826854-219826884
  hyper
ataaagcgctggaagcgcctgcagatggtt

SEQ ID NO: 27860 - DNA, 466 bp, Homo sapiens
  chr2:219846405-219846871
  hyper
ccaagtgcgaggctgcggccacggccccgaagggcccgggcgggggctgcaagctgggactggggtagagcgcggcggtggcggcggcagcggtggcggcggggcccgggcccggccagtaggagaagccggcgggcgcgaccccggccgaggcggccatgaggttgagtttggagaggccggggaagggcagcggggcgaggccggcgggcagcttgtagagcgcgccgtcctgggcggccgcggcggcggcagcagctgcggcggcggcatgagcgtgcgcgggcggcggctggcaggcctgcgccaggccctggaagtcgaagcggtaggcgtagcgcttgccatgcaccttgctcatgatgttcttgtcgtagtagtagcgcagggcgcggctcagcttgtcgtagttcatgttgggcttgctcttgcgctcgccccaccgccgcgccacctcgtccgggtc

SEQ ID NO: 27861 - DNA, 295 bp, Homo sapiens
  chr2:219846894-219847189
  hyper
cgccctcccacgcgatgcagccggcgttcgcgcggtcagccagcagctccagcagaaactgccacagctggatctgtccgctgcctgtggggaggggggcggtcagccacaggcgggagcggggaggcgggaactggggaagagtgctggcgggaaactgacccaccccggcaggaaccggcactgggggaggaaaagtgcaagtcaaactgcagctgcgttcggcgggagaggccggccccggaggggctgatcagcagagtggtgtgtagccttaccgcgcttttgcacaatg

SEQ ID NO: 27862 - DNA, 83 bp, Homo sapiens; identical to SEQ ID NO: 6640
  chr2:219848809-219848892
  hyper

SEQ ID NO: 27863 - DNA, 542 bp, Homo sapiens; identical to SEQ ID NO: 6641
  chr2:219848935-219849477
  hyper

SEQ ID NO: 27864 - DNA, 276 bp, Homo sapiens
  chr2:219849996-219850272
  hyper
ttccagctaaggggccgcttggaaccctccggcccccgcgcggcccggggccgcaatttccgttttaattaaagcgctgccgcctcggcccccaggaccccgcccccgcccctcttatcgtcccatcgcaataaagtctccaacgcgccgcgccacagccaagcgcacccggcagccccccgcgccccgcagccggggagacgcgcgggggatgggcccgggccatgtgccctgatgggagcctagagcgcgtgtcttttccgcctccctgactct

SEQ ID NO: 27865 - DNA, 30 bp, Homo sapiens
  chr2:219850482-219850512
  hyper
ctgtcgctgcgcgcccggccctgcagccgt

SEQ ID NO: 27866 - DNA, 343 bp, Homo sapiens
  chr2:219857780-219858123
  hyper
cgcgctcgcagacgttcgcacagtcgcttagcagccgacagcgacggccctggaagtcctcctcgtcccagagcgtgaggctggcgggcgccgggcccggcgcgggggcgctgctcatgccgctgcggacaggaagggtggcaccacgcgctcagcgtctcaagagccccgtttcgagccacacacagcctgcccaacctgggtagcggatgaagaacccgggggctggacccggcctagctctggacccggctgccaggggctcgcagtcttcccgcgctcccctcccttccccaccccagcagagggcattcaccgggtgggtgagcgcggcacgcgaggg

SEQ ID NO: 27867 - DNA, 76 bp, Homo sapiens
  chr2:219866496-219866572
  hyper
ctcagtgctgcacagcgccccgctagcctccgccctcacctgaacgcatctgcggctgacacgtcggcggccgcgg

SEQ ID NO: 27868 - DNA, 224 bp, Homo sapiens
  chr2:219867715-219867939
  hyper
cggcagcagcgtgtccggggtcagactcctggaagacaaaaagtcccaggtaggcgtgggggcgaggcttcgggcagagcctggctgcccccgtggcccctctcgcgcggtctgcgcggccgctggtcccggcgcccttacctgggcacgcagaacggcggcagggcgatgacgcgtggccgcgaggtgagtaccacctccccgcggctcgcctccaccaggat

SEQ ID NO: 27869 - DNA, 30 bp, Homo sapiens
  chr2:219924566-219924596
  hyper
tacctccgggtgcagcgtctggctgagctg

SEQ ID NO: 27870 - DNA, 59 bp, Homo sapiens
  chr2:219925148-219925207
  hyper
aggcagaagtgcagtcggggccggagccgggcgggagacatggccggggagcccggggg

SEQ ID NO: 27871 - DNA, 69 bp, Homo sapiens
  chr2:219925544-219925613
  hyper
cgggctgcagggccccgcggttagcaccccggcccggcggtcaggcggctcgggcggagcgggagctgc

SEQ ID NO: 27872 - DNA, 97 bp, Homo sapiens
  chr2:219926046-219926143
  hyper
ctacggtgtcccctgcggggaagcaaacccaaaaggcaggaggccactcataacctggtgccccaccctggcccgggcgacgcgccctttcagcttg

SEQ ID NO: 27873 - DNA, 38 bp, Homo sapiens
  chr2:220173999-220174037
  hyper
gcagccggagacccccggatcccccgagacccccaggc

SEQ ID NO: 27874 - DNA, 285 bp, Homo sapiens
  chr2:220174059-220174344
  hyper
cgagctccgggcgctcgctcccgggccggagccgcagcgacgctggcgggagcctgccagaggggctgaggcggggcttgccgctccccacctccctacgaggcggggtctacatgcccctctcgctgcaacgcggccaaccgcaggcgggtgctgacgacacctccacccccggctcgtaagctaatttgcgtcacatatggcgtaagagccctgtcggagcgggggacctacctagcccatccctcctccatcaaatagtaggcgcctcgctagaattcccac

SEQ ID NO: 27875 - DNA, 280 bp, Homo sapiens; identical to SEQ ID NO: 2164
  chr2:220196354-220196634
  hyper

SEQ ID NO: 27876 - DNA, 344 bp, Homo sapiens
  chr2:220197187-220197531
  hyper
cccacttctcaggatcgctttcttggccctgcccgcaccccccagggttcctcctgaccgtgggcactagtgtcgctgcagccccccgggcagctgttcagcagcaggaagcagacaagcagctggagcccctcggagctcccaggccacagtgggtgctgtatcctcccaggctcggcgcgctcactccccggccaagtctcagtgaaggtagcggccacggccgaggggctgagcggggctgcagcttcccaccagcccgcgactccgaatctgtttaaccctcctcggcagttcagccaatcgtgagcgggccctgcccctgcggtcgcctccccagctcc

SEQ ID NO: 27877 - DNA, 753 bp, Homo sapiens
  chr2:220222947-220223700
  hyper
ggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagagaatcagaggcacccccgctgggccccgagccccatgcgcgcgcaggggcccc

SEQ ID NO: 27878 - DNA, 4 bp, Homo sapiens
  chr2:220283127-220283131
  hyper
cggc

SEQ ID NO: 27879 - DNA, 118 bp, Homo sapiens
  chr2:220283172-220283290
  hyper
cgcgccgtcaccatgagccaggcctactcgtccagccagcgcgtgtcctcctaccgccgcaccttcggcggggccccgggcttcccactcggctccccgctgagttcgcccgtgttcc

SEQ ID NO: 27880 - DNA, 264 bp, Homo sapiens
  chr2:220283362-220283626
  hyper
cgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagc

SEQ ID NO: 27881 - DNA, 27 bp, Homo sapiens
  chr2:220283711-220283738
  hyper
cgacgtcgagcgcgacaacctgctcga

SEQ ID NO: 27882 - DNA, 158 bp, Homo sapiens
  chr2:220299477-220299635
  hyper
cctccacggctccctcgcaacccgagccggggggcctaaaaatagcccccaggcgcaatcgccggccgccccggtgaccttctgggtagcacaggccgaaggcgggcgggcagcaggaaggcaggccgccggccccccagacttgtctcctagggcac

SEQ ID NO: 27883 - DNA, 212 bp, Homo sapiens
  chr2:220299885-220300097
  hyper
cgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggaggtaaagggca

SEQ ID NO: 27884 - DNA, 743 bp, Homo sapiens
  chr2:220349054-220349797
  hyper
cgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcaggtg

SEQ ID NO: 27885 - DNA, 48 bp, Homo sapiens
  chr2:220361419-220361467
  hyper
gtttaggggtctggccggtccagggggcaggtaggagatggtgcgctc

SEQ ID NO: 27886 - DNA, 76 bp, Homo sapiens
  chr2:220361826-220361902
  hyper
tcctcgtggaaggtacgcgcgccccgggcgcagcgccagggcgcagaccagcaccactcagccagagcccgcagcc

SEQ ID NO: 27887 - DNA, 105 bp, Homo sapiens
  chr2:220361983-220362088
  hyper
cgccgcgccagccaagtgcgtccttccctacctcgggatccagctccacccgggctgagcagtcagctgtggacttccatcacgcggctccgggtccccaaggtc

SEQ ID NO: 27888 - DNA, 53 bp, Homo sapiens
  chr2:220379221-220379274
  hyper
cagcagaggcagcagcggcagaggcagcaccagggctgcggagctgctgggag

SEQ ID NO: 27889 - DNA, 1347 bp, Homo sapiens
  chr2:220416340-220417687
  hyper
ggctgtgggtggggccgtggctgcgcatctcatacttatctcccgggcacagctcggccccctcccgcagccagcacacgtggccccccgagcgggacacagtcacctccagcaccgcccggcggcccaccagaacggtcttctcgcgaggggggtggcggcacatctggagaggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagtagagccagggactgggcgggccccgcctggaagcggacttcaccggcgtcctcggcgcgcagctcgctaagcaccagaatgtgtttcttccctgggggtgagggggtcgctagcgaggccggagccacctctgaggagcgttggggacgaaggtgggggcccagcaggcccctgggtcggttcggacgccgttagtgtatgctagggtgggcggaacagggatgcggagcgggaagcctagaggtccgggactaggggctgggggcgggggaaagaacagggacgaggctcacagggccgtggggcggggcccgtcggagccaggggcggggcttgtcccggtggggcgggatctgttcgagcctgggcggggcagcgaggggcccgaaagggtaaccaggcgggcagaccttcctgtcggatgcggacgcgggctccgggtctcagcgggcggcctccgagctcccagcgccccgtggtctcgacctccgacacggtgcactcgaacgtagcgccgtcgccttcgcgggcgctcaccgaccgcagctcggagagtaccgccacagtacgctctggggcggagcccggggcgtgagcggggcggggcagagggcagttaccggtcacgccccctccacgccccctttctagaagcacgcgcggtcatcagggtccggggaagacagctccgcaagtctcgcgcccaaagcagtgcccagcctccacatcaccccgtacccaccgcgcacggtcaggcggaccggtccggcgcgggccgtccccaccgcgcagctgtaggtcccggcgtccgaggggccgcagcgtcgcagctggagaagg

SEQ ID NO: 27890 - DNA, 492 bp, Homo sapiens
  chr2:220435486-220435978
  hyper
ctcggggaggccccccgcccggcacgtcagcaccacctccgccccccgcagcacccactgggatcgaggccccgtgaggaagaccggggcgccctccccggaccccggcgatggcagcgggcgctcggcgggctgcagctcggggtcggaggccggcggctccagcacggtgacggcggccgccgcgtaggcctcgccggccgcgttgcgggcgcggcacacgtagacccccgcgtcggtgggcagtgcggcggtcagcagcaggccgtgctccgcgccgtccgccgggaagctcaggcgttccgaggccgccagctgctgcccgcccttctcccacaccactacaggcggcggctcccccaggaccacgcacttgagctcggcctcggcgccacttaccacccgcacaggccgcgggaagcgcaggaagcacggggggctcccctgatcccccgagctcgccttcatcgcggcggccgaccgcctgcagcg

SEQ ID NO: 27891 - DNA, 103 bp, Homo sapiens
  chr2:222435773-222435876
  hyper
cactcaggacatctgcgcacagacatacaatcctccgcgtccgcttccacgcaggcattcgcgcacctacatacacgcagttgcacgcgcgcgcacacacaca

SEQ ID NO: 27892 - DNA, 462 bp, Homo sapiens
  chr2:222435996-222436458
  hyper
tcgcctctccctgggtttctcagaaactaaatgatcaccgcccccccgccccgccccacctcccgacacagacacacaggcacatacaatcctcccagcacgtccgaacggatgcacagaaaactgagcacccagacgggtcccgtcgaccccgcacgttagctctaaactgtgtgcaattctggggcgaaaagctaaaactcgactgcgttcaacttgccggcgggttccccaagtctgcggggcgaagagctcgggcccctcaggcccgcaatcgcaccctcggggcgctgggcttggcgaggagaaaggtgtctgactccgggtgctagaaatcaggtcactggcgcctgacgagcggcgccacgaccgctgcgctgcggagcaggccccgcagcccggtcccgagaagcgcagggctcgggaaactttgcagaaaccagagctcgaaaggctttcgct

SEQ ID NO: 27893 - DNA, 41 bp, Homo sapiens
  chr2:222436920-222436961
  hyper
aatcccgaagagacacgaaaatagggcgaaatagaaaatcc

SEQ ID NO: 27894 - DNA, 36 bp, Homo sapiens
  chr2:223104874-223104910
  hyper
ggttatgaatatggccggccacgggggcagtacagg

SEQ ID NO: 27895 - DNA, 366 bp, Homo sapiens
  chr2:223155822-223156188
  hyper
cccagcccattgtggcggcgcccgcgggcccgctaggccgagccgggggaggaacagaggcgcccattgagcggccgctgcgcagggcggtgcccacagccccggatgcctcggccaggacttggctcccccggctgcctctgctccagtctcagcgcgggccaggggctagggggattggggatagcgggcggggttcgtgttagtgaaccgcccagccctctcctttctcctgggctatggagctggagggatgtatccagcaagggtgcatcatgcttagcgcgcgcccgttagggagcgcgggcctgagcgcaccagcaccgctagcggctcagctcttgaattgagcgagggaaaagggaa

SEQ ID NO: 27896 - DNA, 1076 bp, Homo sapiens
  chr2:223158730-223159806
  hyper
ctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggac

SEQ ID NO: 27897 - DNA, 248 bp, Homo sapiens
  chr2:223159868-223160116
  hyper
cggcaaagtccctcccggcgcgggccccatctcccttcggttggggttaccaaaacatttgtttctctttaaaagggaacatcaatattaataaacgctctgcctccgcctcacgtttcctgccctgcctcctcgacagaaatcttctttggggcgtcctcagcggtggtctcgccaccctccgtccccaggacaagcagctcacccctccctccataaagtgccaagaacaccgggttggcaaatat

SEQ ID NO: 27898 - DNA, 37 bp, Homo sapiens
  chr2:223160342-223160379
  hyper
caattttcttctccacgtcaggcgttgtcacctgctt

SEQ ID NO: 27899 - DNA, 30 bp, Homo sapiens
  chr2:223161247-223161277
  hyper
gggggagactgagggcggggtttgggagac

SEQ ID NO: 27900 - DNA, 159 bp, Homo sapiens
  chr2:223161526-223161685
  hyper
cagggcgcgtgcacacgtacacacacacacgcgcgcctttacgcaccttcacaaacctcagaaataactcattggagagccccagatgtcagccgttaccccccgcccggtcttccccaacacaggggaccacagtctgggagccaggagggcaaggcc

SEQ ID NO: 27901 - DNA, 257 bp, Homo sapiens
  chr2:223161806-223162063
  hyper
cgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcg

SEQ ID NO: 27902 - DNA, 326 bp, Homo sapiens
  chr2:223162565-223162891
  hyper
gaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaattccaatcacaatggcgcggcgttagccaccacaactttgcagggcaaaaaaaaaaaaatacttcctgaactaacatatgtttcacaagtgtgggcgcagccgggacaattt

SEQ ID NO: 27903 - DNA, 297 bp, Homo sapiens; identical to SEQ ID NO: 270
  chr2:223162928-223163225
  hyper

SEQ ID NO: 27904 - DNA, 337 bp, Homo sapiens; identical to SEQ ID NO: 271
  chr2:223163472-223163809
  hyper

SEQ ID NO: 27905 - DNA, 193 bp, Homo sapiens; identical to SEQ ID NO: 272
  chr2:223163810-223164003
  hyper

SEQ ID NO: 27906 - DNA, 210 bp, Homo sapiens
  chr2:223164407-223164617
  hyper
ttcttttgtcttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctctacatatagatccccgatgcgtcgacagagatgtgtctg

SEQ ID NO: 27907 - DNA, 69 bp, Homo sapiens
  chr2:223165434-223165503
  hyper
attttctttttaaggcgttggggccaccaaagcctgtgtccgtacgttttaagccacttctcagcgata

SEQ ID NO: 27908 - DNA, 223 bp, Homo sapiens
  chr2:223166003-223166226
  hyper
gaatcaggaggcgactcattttctctcctttccggcctctttcttttctgccgagcgctctgagattcatatgtacccagatgatcagcccggcccttctcaccggccagtggccagaggtccctggacacccggagaggggtgggagggcacccttaggctctggacagctgggccacatccaaagacttaatgaatctaaatttcttgtggcctgtgtccc

SEQ ID NO: 27909 - DNA, 557 bp, Homo sapiens
  chr2:223166293-223166850
  hyper
cgccgccaaacctaacccggctcagagccgtgactccgcagaacagggcgcaacaggtctcaggaatgccgggtgattccagccactctttctctgtctccgagtcttgggcctcccctttatttctttctgaagtctctccggagcccaagccaccccacacccaaaccccgcagctggatgggagtccaggccacttccctatccgcagccggtgggccaaggagtcctggtgccaaatttggccgcggtacaggcgctaattggtaaagggatgacccagcggtggggcttggaaggcgagggcccgcgccctgcatccttgaaccctggtttgggaggcagtgacttttacctgggctaacaaattacccagaaagcatcagtgggactctccacaacggtgttgtgaacgagtgtagggtccactcacgctctgtgcacgttcgaaatgaaacgggagccttgaagacgatatttggataatttgacaaaaaaaaaaaaaaggtgggcgggggagatagcttctattgtcccctctgcgcctctgcccccag

SEQ ID NO: 27910 - DNA, 347 bp, Homo sapiens
  chr2:223167226-223167573
  hyper
gcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgggatgagttcggattaagggacta

SEQ ID NO: 27911 - DNA, 395 bp, Homo sapiens
  chr2:223168437-223168832
  hyper
aacaggtctttctttcgctcggatcaggactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcc

SEQ ID NO: 27912 - DNA, 972 bp, Homo sapiens
  chr2:223168916-223169888
  hyper
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgat

SEQ ID NO: 27913 - DNA, 1010 bp, Homo sapiens
  chr2:223170354-223171364
  hyper
cttctttccatccctcggccccctcccagagggcagcgacgaaagccctggccgagcacaaggatcggtgatctgggctcctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttccaaatgcaaatcaaacacccttggcgccccgcttcttcattaattaagaggaacgtttcgacaaaaccggcgtaatctttattaattacgcagcccttagcgcgccgttcgcatcaatcacgcccaaagcgaaagtgcagggggcgcctaatcccttcccagagcgcgtttggagaaggagccgcgtggccggcgtttccaccgtgacttccacctttctgggctcgcctggcactggctgctcagccggcgcgcagggaggcctttccggaaacaccggctggctgcgcgctagcaggaccgctctagatcccctgacaggccggaaaataacccccactcactatttgggcacgcgctcgtacgcagaaactcgcacagggactcgcgtggacactttatggcccatttcctccgtcccctcacccttaggctcagtggggaccacgcggttctcagtcctcctcttccctaggaccctctaaaaaggagcctggggcgaaatgacagagggaggcagaaaacctcctgttgccccaggacgccccgaaaaactgctctgggggatggggcggggaagaccttagaagttgtcagggcgaccaactcctccc

SEQ ID NO: 27914 - DNA, 218 bp, Homo sapiens
  chr2:223171861-223172079
  hyper
cgggcgcccttggctcgagggcctttcggagcctccgcgggaagcagaaagtcgcacctcacactgagcctttccttcgagcgctctgccgggagctactgagccccagcacgcagccttgggcacccggtggcgggcgaaggaacctgccccattgtgctgctgggctgcactagcggagacgagagtgcgtgtgggagtggcccactagcaccacc

SEQ ID NO: 27915 - DNA, 185 bp, Homo sapiens
  chr2:223173045-223173230
  hyper
gagcctcctcccttccggtgatcgtggctcaaaaatccaggatggacctgggcctcttcatctagcccccatcggctgaaaagtgcatttttatttgacagaaaatgacagcgcgccttcttggtgtccagatccccactctacaggacctgtcactcccatttcccatacgagaggaaactccc

SEQ ID NO: 27916 - DNA, 416 bp, Homo sapiens; identical to SEQ ID NO: 273
  chr2:223176096-223176512
  hyper

SEQ ID NO: 27917 - DNA, 489 bp, Homo sapiens
  chr2:223176719-223177208
  hyper
cgtgggcatcttggaatattaaaaacgtcatccggttgtaaataacctactccccagcccttgaaatccgggacgtcacaggtgaggctgaataccaggttcgcacaaaggcaaaccaaactcagccgggatgccgagtgatggggttggcaagatagtgtggcctctggttccctccacgcgtgataagtgggatcatgacagcgtccttgtgccttcgatttgtccccaagccctcctctgcctttccgatctcaaactaacccgtaatggagctggcaagtgggacgaacgggacagcctaaagcgtcgttggcccggccaagaggggctcaacgcctgtcaccccgggcggccttgggtcctttgcagtcggagaggctgcaggggaggaggaagacccagccagctccagggtgcaggattctgcccttccacccgagagcctcccccggtgtcccagtggcagtggctgccccgggctgcggt

SEQ ID NO: 27918 - DNA, 410 bp, Homo sapiens
  chr2:223177244-223177654
  hyper
cgccctgccccttgggctcagctgcgagccaccgccggcgtgcgcacccacaaggagagaaatggaggtaatcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccctcgttgtcactgcatt

SEQ ID NO: 27919 - DNA, 41 bp, Homo sapiens
  chr2:223185352-223185393
  hyper
accagtgatgtaatgcgggacccgcgcggggaggggaaacg

SEQ ID NO: 27920 - DNA, 133 bp, Homo sapiens
  chr2:223536428-223536561
  hyper
ggcacttcccacaggcgccgcagagcagcgtgggtgcaggctgcagtggctggcgccgtcctcgcccggccaggccatgaaggtagagtttgcaccgctcaacatccagctggcgcggcggctgcagacggtg

SEQ ID NO: 27921 - DNA, 45 bp, Homo sapiens
  chr2:225906010-225906055
  hyper
ttccggtccaccaaacgcaggccaagagcgcggctgctgagcccc

SEQ ID NO: 27922 - DNA, 375 bp, Homo sapiens; identical to SEQ ID NO: 6682
  chr2:225906404-225906779
  hyper

SEQ ID NO: 27923 - DNA, 572 bp, Homo sapiens
  chr2:225906790-225907362
  hyper
cgctgcctcgctgaggtggcgccgggggagcccgcagaggcggcgggggagggagtgcggaggagaggacccgtgagctgcggggacctgggcccgccgagcttttggggaagctgggctccgttccccccgggcgcctggggcgcgcgggaaggcgcggaggacgcgccgcactcacccgctgctgctgccggctgctgactgccaccgcggcggcggacgcggcgctgtgccggagctcggccgcctgcccaggtctcaacaggctccgggtgaacctgcgggtccgctcaccggccatcgccggtcacgccaatcgcgccgcgggcccggggcgcgcctcccgccggtcttccccgcgccaaccttctctatccacccgccgttcaggaagcggaactcggagccttcccccccctcttcctcgctcaactcgcaagaggcgggtttttctctcttgcacccccactcttcccacccccttccctcctctgaagcttctcgaagactttccaaactctgcgctcccccgggcgcgcgcggccaactcggctggcggccgggccctgcag

SEQ ID NO: 27924 - DNA, 128 bp, Homo sapiens
  chr2:225907439-225907567
  hyper
cggccggggctgtccacgccgcccgggggaactgcaggctgcgggggagggcggggggcggccgccgaggggctccgggcggggcctgtccaaggccgtcgcctgtccaaggccgtcagcctcatttg

SEQ ID NO: 27925 - DNA, 174 bp, Homo sapiens
  chr2:226896159-226896333
  hyper
ttgtgagagaggctgcggatgcgacccagctccggctcagctgcgcgcgtttgcaaatgcggctgcgtccagacagggcatggaacacatttccaagctcacgtccccgtttcttgtttacagctgagattataagcaatctatgtgccctcttatcatcgtgtcaggcaatga

SEQ ID NO: 27926 - DNA, 85 bp, Homo sapiens
  chr2:227663424-227663509
  hyper
gaagccatcgctctccggagggctcgccatgctgccaccgccaccaccaacgctgagcagagggaggctccgaaaaacaaccggg

SEQ ID NO: 27927 - DNA, 67 bp, Homo sapiens
  chr2:228029415-228029482
  hyper
cgcccaggctctgagcgcgcgcccaccatgagcgcccggaccgcccccaggccgcaggtgctcctgc

SEQ ID NO: 27928 - DNA, 2 bp, Homo sapiens
  chr2:228582794-228582796
  hyper
ca

SEQ ID NO: 27929 - DNA, 15 bp, Homo sapiens
  chr2:228582819-228582834
  hyper
cgtccagacctttca

SEQ ID NO: 27930 - DNA, 134 bp, Homo sapiens
  chr2:228736154-228736288
  hyper
tagctcctctgaggtcgcccttagtgaggacacgaggtgccctcacctctttcactctagacacctccagaacactcgccccccgcgcgccggagccccgggtcgccaccaaccgcccgcggagccagacctcc

SEQ ID NO: 27931 - DNA, 385 bp, Homo sapiens
  chr2:229046118-229046503
  hyper
ccagcgaggctgggccggacttatttacaagtgcagtgacccctgtctcctcgctgggagccccgtgcaaaccgaagcgctctggggcaagttggtgagcgactcacaacgcggaacggagtttgatcgacatggtattgggcatagaaagaagcgggtcttaccttggtaccgagagcagggagttgccatccattgttggtgggcgcccagagaagaaagacggaaagtgcaggcgaaggataagtctgtggtgctaggacccagctcccagagtgccagactggcgcgcgccaggagagaggcgcgcaggctggggcggcggcggcgcccacggagactagctcctccctggccagcaagctctgtgcgctgcgaccgcccg

SEQ ID NO: 27932 - DNA, 15 bp, Homo sapiens
  chr2:229046730-229046745
  hyper
ccctgaagttgttca

SEQ ID NO: 27933 - DNA, 593 bp, Homo sapiens
  chr2:230578129-230578722
  hyper
ccggtgccctgctcacgccccggctgccagccccaagcgtgcgccccgtggagcgtccggcaggaagggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttacacacacagggtccagccggacgtggagcgtggaccacctggacattgaacacctcgccggggacgctcggagccggctcctccgcgctgccaaggcgggcaccgctcaagtggttcttggctcggcccggcctggaggggcgcgccactcagtggccaaccggagcgtctagagccccgcgcgagaagtgccgagccccggagcggcacaccccgagagcccggctggccccgcccgggaaccagggcgggtaagggaatcagggtcggcccgggggtccgcgtccacgcgggcca

SEQ ID NO: 27934 - DNA, 34 bp, Homo sapiens
  chr2:231191860-231191894
  hyper
ggtgagtcagtctgtcggccgacttcctgctccg

SEQ ID NO: 27935 - DNA, 87 bp, Homo sapiens
  chr2:231693406-231693493
  hyper
cgccccagggctggggccttggagcctgggaaagcaaccgggggtctctggggagtcctgagcgcaggcgcccgcccacggccaaga

SEQ ID NO: 27936 - DNA, 46 bp, Homo sapiens
  chr2:231714930-231714976
  hyper
ttatgttctcaagtgcgccccctggcggctgcggggagaacagcct

SEQ ID NO: 27937 - DNA, 132 bp, Homo sapiens
  chr2:231903040-231903172
  hyper
cctagagccaggcctcgcagctagcggagagcgggccgtgcgtagcggatcgagtctgtcccggaagggtccggagtgcacgggagatgcctagggggcgtgggaaagctgaggggccgagtagaaggcaga

SEQ ID NO: 27938 - DNA, 82 bp, Homo sapiens
  chr2:232394940-232395022
  hyper
ccccggtggcggggacggggggcaccccgacggagccctcggacccttcccgccctaggacgaccctgcccgcaccgagccc

SEQ ID NO: 27939 - DNA, 365 bp, Homo sapiens
  chr2:232395054-232395419
  hyper
cgcctgcgcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggc

SEQ ID NO: 27940 - DNA, 41 bp, Homo sapiens
  chr2:232526765-232526806
  hyper
aagagggcccagctgcgccattagcgcgtgcgagggaaaat

SEQ ID NO: 27941 - DNA, 32 bp, Homo sapiens
  chr2:232527207-232527239
  hyper
ctccgccgcgtctcccgcgtctggggcgcggc

SEQ ID NO: 27942 - DNA, 499 bp, Homo sapiens
  chr2:232791530-232792029
  hyper
cgcagccctgcttgtcgccaaactcttccctgggcacctgacagccgcgggatggcattgcagctccgcctttcacctgccggtcagggcgggagcgcagaccacagcgacgtcgttaggttggggaggcagaggatggggttggaggactggggtgggaggcgcagggagagcggggttcgcctgggccgcaggggggagcgcaagtcttccacactggagagtgcaggggtgtcgccagcctgagtgtttgagcgcaaggcgggaacgaggggactgcgagcgcggaaccaagatattcatgctcatgcgtgtgctccgcggcatcgtatgctcgccagttactgctctaggttcacgttcagccggtttcggccacacagaacgtcccggggtctgactccgctggtgaactccctctgtgggaacaatgcgcacctgaccttgcctgcacccacgcgaggatccgctgctgggggaagcccgctccagtatcctg

SEQ ID NO: 27943 - DNA, 30 bp, Homo sapiens; identical to SEQ ID NO: 6692
  chr2:233283450-233283480
  hyper

SEQ ID NO: 27944 - DNA, 63 bp, Homo sapiens
  chr2:233283709-233283772
  hyper
cggccgctggctgggcgctcgggaatcgcactcaggcggatgacgtagcgcgaggagttcctg

SEQ ID NO: 27945 - DNA, 30 bp, Homo sapiens
  chr2:233285064-233285094
  hyper
agacgcttcgcaaaacggccaaagaaccaa

SEQ ID NO: 27946 - DNA, 66 bp, Homo sapiens; identical to SEQ ID NO: 6694
  chr2:233285777-233285843
  hyper

SEQ ID NO: 27947 - DNA, 277 bp, Homo sapiens; identical to SEQ ID NO: 275
  chr2:233350263-233350540
  hyper

SEQ ID NO: 27948 - DNA, 436 bp, Homo sapiens; identical to SEQ ID NO: 276
  chr2:233350843-233351279
  hyper

SEQ ID NO: 27949 - DNA, 319 bp, Homo sapiens
  chr2:233351415-233351734
  hyper
cgtggccgccggcctcctcgtgggcctccgcatggccctggggccgcagctgcgggaagggcggaagcaggctcaggaggcgccgcagccggatggggctcagggtcaccgcgaggagggacacaggcctgggtgcagaggccccagccgcgggcctcattcactgcggaaaccagggactatgagggttcggcggggccaccacccccgggtgcacagtggagtcttcccccctgtcccctccctgcacacacttgagggccgcagggttgggagggctcttattggaagcaagaggcgccaggcaaggggcctggca

SEQ ID NO: 27950 - DNA, 218 bp, Homo sapiens
  chr2:233351789-233352007
  hyper
cgacctgccccagccaaggccgggtggagtgggggaagaagcggaggctggagtgaggaggtgcggtcaggggcgcgtctatgcgacactttcagctctccgcgctggacccagacagacgctccgcaaagcggccaaagaaccaaactttgtcctcgcggaagtccgcgggatcgaccacgccaaccccgctccctggctccttctgctcggtggcc

SEQ ID NO: 27951 - DNA, 351 bp, Homo sapiens; identical to SEQ ID NO: 278
  chr2:233352101-233352452
  hyper

SEQ ID NO: 27952 - DNA, 257 bp, Homo sapiens; identical to SEQ ID NO: 279
  chr2:233352506-233352763
  hyper

SEQ ID NO: 27953 - DNA, 150 bp, Homo sapiens
  chr2:233352775-233352925
  hyper
cgagtgagggcagcgagtactcccgtgaagggtcccctccgatccagtgtccccactcccagccgcccaccagccggctggaaaggggctggagctggagatgaggagccgaggactcctccgaagggctgggggcggtgtcagtagtgc

SEQ ID NO: 27954 - DNA, 38 bp, Homo sapiens
  chr2:233367784-233367822
  hyper
caaacacgcactctgcggaaggccggggcgggcctggc

SEQ ID NO: 27955 - DNA, 152 bp, Homo sapiens
  chr2:233368141-233368293
  hyper
tataggtcaatgtcccgctcagcctccctcccccagcaccgtgaggaccgaggcctggggcctggcgcccgcctggtggacctcgggggcaggctggggaccgggcccctgcgggacgcggcgcggcaggacgctccccgcgcctttctttc

SEQ ID NO: 27956 - DNA, 451 bp, Homo sapiens
  chr2:233388723-233389174
  hyper
gctccgactcctgtccggtccgcagagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggtaccccgcgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccggaaagggcttacc

SEQ ID NO: 27957 - DNA, 182 bp, Homo sapiens
  chr2:233498345-233498527
  hyper
cgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcc

SEQ ID NO: 27958 - DNA, 303 bp, Homo sapiens
  chr2:233498571-233498874
  hyper
cggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtgagctcccgctgcgcgcccttcgcccccgggaccagggagggagcgggagggctttctggtccgaagtcccgggccctgtttgtgtggggaggggtcccggggtgcaggtagcatttggcccaacgcagccagatcttgcgtgctcgggtctatct

SEQ ID NO: 27959 - DNA, 385 bp, Homo sapiens
  chr2:233498895-233499280
  hyper
cgaagaggggggacaccaggagcaggagctctccgggacggagcccaaaagttctcggcggctgccgggcccgagttccaggtcccccaaccccgaccactggtcccgccccctccgcccgccagtccggagatttgctccgaaagcaacttctaggaaagggagccgtcgccgcgcctcacctgccagctttcactgtatccccccaagggaaaaattagcccctgttggccttttatcttttaaaacaaaaggggaaagttaatccttggctgcagcgcggggtctgatgaatgagcggaggccgagaacggggagtttggtaaagtcgttgtaagagattcaggactttcctggagcaggcgcggcccgggagcctcctggg

SEQ ID NO: 27960 - DNA, 621 bp, Homo sapiens
  chr2:233740929-233741550
  hyper
ggtgacatggtcctccgtcctccgcagggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcctcacgcgcctgtatgtccgcgcgtgcgtgtccgcgcatgcaggtgtgccagagcgtgagcgcgcgcaggcgagcgctcagggcgggggtgcgcgcggggccgagggtgggtgccgtgcacgcgcgcgggtccggaggcgcgcccgaattccccgcaggggcgccggggcgtgcgtgagcgcacagcatgtccgagcccgcctgcgtgtggcgtgcacctgagcgcgcgcagggccgcgcggctcggcgtccccgtgcaccacggctggagtgcctcaggagcgcgccgcatgtgcgtgcccggtgcgcgtgcgccggggccgccagggcatcggagcgggtgtgcggccagcggtcttagcccgtccgggggcaccgtcacggtcagggccacgccacgggcggccccttctcccggcgccgcctcctctgcctg

SEQ ID NO: 27961 - DNA, 67 bp, Homo sapiens
  chr2:234475179-234475246
  hyper
ccgaaaccactgccccgactccaggagagcgccgcgtcctcaggcaggcctgggcagcctctcgcct

SEQ ID NO: 27962 - DNA, 30 bp, Homo sapiens
  chr2:234475473-234475503
  hyper
cgccggcccctcgcacggggccttatggga

SEQ ID NO: 27963 - DNA, 117 bp, Homo sapiens; identical to SEQ ID NO: 6710
  chr2:235404416-235404533
  hyper

SEQ ID NO: 27964 - DNA, 19 bp, Homo sapiens
  chr2:235404550-235404569
  hyper
cgcgggttctcgctcatcc

SEQ ID NO: 27965 - DNA, 273 bp, Homo sapiens
  chr2:235404629-235404902
  hyper
ctccccggtcgctccgggcgcattaccgcttcttcttctgcttgagggacttcctgcgtttcaggatcatctcatagagcttgtccatgccctcggtgaggccctcgccgatgatggcgcacgccggctggacgtgataggtggtggccgggataagctcgtgcagcgccagctgcttctcaatctctgccaccggcagcgacttgggcaggtcctgcttgttggcgatgaccagcagcggcgtgccctggttctcggcgaacttggtcacct

SEQ ID NO: 27966 - DNA, 30 bp, Homo sapiens
  chr2:235860068-235860098
  hyper
tttatgattttcagccggactgccttccct

SEQ ID NO: 27967 - DNA, 52 bp, Homo sapiens
  chr2:236402749-236402801
  hyper
ccgcggcttgcaaggcgcctgcgactcggtcccaggtcggcgggcggcgcac

SEQ ID NO: 27968 - DNA, 155 bp, Homo sapiens
  chr2:236403151-236403306
  hyper
cccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgc

SEQ ID NO: 27969 - DNA, 30 bp, Homo sapiens
  chr2:236403854-236403884
  hyper
caggccaggcctgggcgtcttgctggacgt

SEQ ID NO: 27970 - DNA, 89 bp, Homo sapiens
  chr2:236577966-236578055
  hyper
gatgcctcatttaaacgcgcagcaggtgagacatgcccctcgttttgttcttgcaggccaagccccagagtgggcgtggttttagggtg

SEQ ID NO: 27971 - DNA, 44 bp, Homo sapiens
  chr2:236579046-236579090
  hyper
cagctggaactggggcggctccggccgtgcgcacgcggcctgga

SEQ ID NO: 27972 - DNA, 163 bp, Homo sapiens
  chr2:237068390-237068553
  hyper
ttgggggtgggtgcccggagtgacgtccgcccccccaccccgggcccggccctgcctcaggcttttgcctcgggcccaggccgctctcgagccgtgggcgcgccctcggggctcggcccccggtttcggtctcaggcccccgggagtatcaggagaacaaggt

SEQ ID NO: 27973 - DNA, 21 bp, Homo sapiens
  chr2:237068626-237068647
  hyper
cgcagccgggcctcctgcctc

SEQ ID NO: 27974 - DNA, 16 bp, Homo sapiens
  chr2:237068925-237068941
  hyper
gcggtggaggctaggg

SEQ ID NO: 27975 - DNA, 357 bp, Homo sapiens; identical to SEQ ID NO: 281
  chr2:237072641-237072998
  hyper

SEQ ID NO: 27976 - DNA, 16 bp, Homo sapiens
  chr2:237072999-237073015
  hyper
ctcacactcgctggcc

SEQ ID NO: 27977 - DNA, 440 bp, Homo sapiens; identical to SEQ ID NO: 283
  chr2:237073056-237073496
  hyper

SEQ ID NO: 27978 - DNA, 28 bp, Homo sapiens
  chr2:237073564-237073592
  hyper
cgcttgcctcctccgggcacccacctcc

SEQ ID NO: 27979 - DNA, 55 bp, Homo sapiens
  chr2:237075130-237075185
  hyper
ctttctccttcccaccgtcatttggacattccgcgccccccgccccccacccttt

SEQ ID NO: 27980 - DNA, 47 bp, Homo sapiens
  chr2:237076012-237076059
  hyper
tctcccgcgggaacccggcgctggcccgcccccgcctcctcccgccc

SEQ ID NO: 27981 - DNA, 34 bp, Homo sapiens; identical to SEQ ID NO: 6720
  chr2:237076602-237076636
  hyper

SEQ ID NO: 27982 - DNA, 91 bp, Homo sapiens
  chr2:237076656-237076747
  hyper
cgccgcgccgccgccgggaagcccgccggacgccgggagcaccgccgggagcgccgggcaggggccgagcgggacccggagagcagacgcc

SEQ ID NO: 27983 - DNA, 171 bp, Homo sapiens
  chr2:237077033-237077204
  hyper
cgcgctcctctttctcattcacattttgcctgccgcctggcccggctcgcctcacgtggggctgggcgcctctggccattggctgagcggggcgggggtggggcgaaagcggggccccgccctttccacccaagctggcctcgagcgggctgcgggcgccaccgtcggagc

SEQ ID NO: 27984 - DNA, 200 bp, Homo sapiens
  chr2:237078315-237078515
  hyper
ttaaaaatcagctcacgccgaggagctagtggttggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccggggga

SEQ ID NO: 27985 - DNA, 30 bp, Homo sapiens
  chr2:237079095-237079125
  hyper
ttacgtggctacagccggggcccttccggc

SEQ ID NO: 27986 - DNA, 121 bp, Homo sapiens
  chr2:237080173-237080294
  hyper
cagcccagcccaatccggaggaggaagcaccgcgaatggcgcgcttcgctgccgccgccagagtcgaggtaacgggtggtcgtggagagggtacggtgtggccacccgtggtctcggagga

SEQ ID NO: 27987 - DNA, 245 bp, Homo sapiens
  chr2:237081182-237081427
  hyper
cagaaacaaaacaaccgcaaaatagaaatgtgaaggggaggggcttttcttcttcttcatttcctcctgggagttgaaaaatgttatccgcaggcctgaaggctgggaaacgtgacccttcacacctgcgccgccctctccactccagcgacgaggaacaggaggagccacagccgctcggcccgcgaggcgagccctcgtggcatctgggaatgggagggtgggggtggaatgctacacagccc

SEQ ID NO: 27988 - DNA, 18 bp, Homo sapiens
  chr2:237081536-237081554
  hyper
ggccgggatccagatgtc

SEQ ID NO: 27989 - DNA, 377 bp, Homo sapiens; identical to SEQ ID NO: 285
  chr2:237082343-237082720
  hyper

SEQ ID NO: 27990 - DNA, 49 bp, Homo sapiens
  chr2:237086349-237086398
  hyper
acatttcacaacatacgacgcctctcctgggaagggagagctcgcgagc

SEQ ID NO: 27991 - DNA, 107 bp, Homo sapiens
  chr2:237086399-237086506
  hyper
cctctactgggtgggcgcagcgccatccccattgcacgaaccgagacggaggtgcggaggccgtgtctggccctggagagtcctccctctgtcgtctgctctcagca

SEQ ID NO: 27992 - DNA, 340 bp, Homo sapiens
  chr2:237086712-237087052
  hyper
cagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggccccttggaaagagggaaataggctgcgcgcgccggggcgggagaggcgctgcctccagtcctcccgggtgggggtctcccctccgagatccccgagggaacccgtcccgtgcactaccggatttccggtctctgaccagctggggcttcatttctacgcgtgct

SEQ ID NO: 27993 - DNA, 30 bp, Homo sapiens
  chr2:237087461-237087491
  hyper
gccccccaactcccccgcctccccggcctc

SEQ ID NO: 27994 - DNA, 200 bp, Homo sapiens
  chr2:237088039-237088239
  hyper
attaggacttcaaatcgcatttctgattgggatcgctctgccgccgtcctcccagcgcctttcaaaccccagcgcttggctttcaaaacatctttttgaatttaaagcctcacatccttttgtcttccgacgccccctcccgccccacccctcccggcggctgcaagctcttcgggcctccttcccggggcaacagccct

SEQ ID NO: 27995 - DNA, 301 bp, Homo sapiens
  chr2:237145136-237145437
  hyper
tgtacgccttaaacacgtgccgcttgctgaatgtcaatcacacctcggtaaagctgcttttaaagagcattgctagaaccttgtttccttcctctttctcaagactggcgggggtccacgtggccccctgatcccccctctgaactcaaatgacctttcttaggtgggtcccctgcctgagtccctgaatgcccagcagtcccgcctgcctgcgttgctgcccctgctgggcaggacatccaggcaactttgacagtcggtggagaagcagcaagggcgatgcggtttctgagagagccgc

SEQ ID NO: 27996 - DNA, 33 bp, Homo sapiens
  chr2:237145438-237145471
  hyper
cgggttcccagcactaaacgtgggcgactttcc

SEQ ID NO: 27997 - DNA, 26 bp, Homo sapiens
  chr2:237145723-237145749
  hyper
ggcctccctagaggccggcacagctc

SEQ ID NO: 27998 - DNA, 38 bp, Homo sapiens
  chr2:237145963-237146001
  hyper
cgctaattaaacccgcgggggccggggccggggcgcgg

SEQ ID NO: 27999 - DNA, 291 bp, Homo sapiens
  chr2:237146260-237146551
  hyper
tctcgtggggggaggcgggcgtctggtctcggggcggggcggacgccgcgggcctgtcccgaggtccttacccgagcgaggcggccgtgcggcagaggtgcagaggcgccaggccctcggcgctgagcaggtcggggtcggcgcggtgctgcagcagcaggcggacgcaggcggtgtggcccccgaggcaggcctcgtgcagggcgccgcggccgccggggctggcgtctgggtctgcgccgcggccgagcaggtgtcgcacgcaggcggtgtggccgtgggccgcggcga

SEQ ID NO: 28000 - DNA, 325 bp, Homo sapiens
  chr2:237416070-237416395
  hyper
cgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgcttggcgagcctgctccgggccccagcactt

SEQ ID NO: 28001 - DNA, 321 bp, Homo sapiens
  chr2:238395134-238395455
  hyper
tgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgagggtacgctctctgcagcagaaagccctgggcttaaagtcctatttattatttggcgttgccacttactg

SEQ ID NO: 28002 - DNA, 41 bp, Homo sapiens
  chr2:238395845-238395886
  hyper
gcggggcgcagcccacgtggttcgggcgggaggcgccggga

SEQ ID NO: 28003 - DNA, 30 bp, Homo sapiens
  chr2:238535948-238535978
  hyper
cggtccctcaggtcccgcgtgcccggccct

SEQ ID NO: 28004 - DNA, 505 bp, Homo sapiens
  chr2:238536208-238536713
  hyper
ggccggggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgg

SEQ ID NO: 28005 - DNA, 43 bp, Homo sapiens; identical to SEQ ID NO: 2193
  chr2:238864588-238864631
  hyper

SEQ ID NO: 28006 - DNA, 573 bp, Homo sapiens
  chr2:238864726-238865299
  hyper
cgcggcccgggtaaccaggtcccatgtaaccgcagcctggtgaagccgtgcgccctgggcgcggctacttggccctcacggcagggcggagatgcgaggccccagggttcggccccgcagcgccgctgagtccaaggaccgagctgggagtgggggcggagccaagaaggggcgcccctgcgcccacaagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactcagccctcggagggacgcccacctcccgcggagctgggggactgtggcttcctcctgcgcggggaggtcggtgggcgccgtggacccgtcccgcccctgtctgaggagccgagtcggccacagaggggcagcagactagggagggctgatgggccgtgcacttagctccctccgggctgctggccggggcccttgaacggacagatgccaactggcagatgagggggctgcgtccacccccaccc

SEQ ID NO: 28007 - DNA, 106 bp, Homo sapiens
  chr2:239072183-239072289
  hyper
gagggaaacgggagccgctgcagggtcaggacgcaaagactccgaggcccttcaggccgaggggacgtcgccctcgccccacccctgcgcccggcaggcccctggt

SEQ ID NO: 28008 - DNA, 267 bp, Homo sapiens
  chr2:239140138-239140405
  hyper
cgggggctgcagagccttcatctcttcctccgtcccgggatgtcggagagacggcagcccagcctccgccaccgcaaagctgcttaacgggcagcgcgagtccctcgggcaccgttggaggccgttgctcaccgttgggcaagtgctttaagaagcacgaggatgtcgagtgtcaaatgcggcaaagggctcagagctcgccgccaaggggcgtggcctccgggccgcggcggcctctgggagttgtagtcccgcctcaacttgtgg

SEQ ID NO: 28009 - DNA, 46 bp, Homo sapiens
  chr2:239755121-239755167
  hyper
ggagggcggtcaggccgggtggggctgggtgcggtggctctgcaga

SEQ ID NO: 28010 - DNA, 30 bp, Homo sapiens
  chr2:239757311-239757341
  hyper
cgcgtggtccatgtccgcctcccactagcg

SEQ ID NO: 28011 - DNA, 127 bp, Homo sapiens
  chr2:239757604-239757731
  hyper
gaccggtgactcccccggcgggttctgaagatacttagacagatggtcgcagttttcattctcggtggtgtgtgggtgtccgtggttggcggtggaaggagcgagcatcagaaaaacctcctggggc

SEQ ID NO: 28012 - DNA, 163 bp, Homo sapiens
  chr2:239757898-239758061
  hyper
cgcgcctggggtccccggccgtcggcgccctggcctgcccagtgggcgtagaggtgcgggcctgcggctccagggtttgcctggggaggacgggaggaaactgccctgcgcttcggggccagagcagccacagggccgggtgtgcccgagaagggccctgggc

SEQ ID NO: 28013 - DNA, 330 bp, Homo sapiens
  chr2:239758125-239758455
  hyper
cgcccgcaggcaggtggagctgacctaggaactgggagccctgagtcccaaccttgaccctggagtacccgggaggggccccgcccatccagccccgcagggatgggcgaggggtccaggctgggaaacgggtctgggggacagggaggctgtgcgcgccgggccctgcgcgaggagaaggctcgggggacacagctgccaggagcactccaagttctggtttcctctggaagagcgattagggcgtcctgcaccgggtccttttcaccagacaccttccaagtccctttagacaagctcgagccacggaggcgccgtccttaggctctg

SEQ ID NO: 28014 - DNA, 138 bp, Homo sapiens
  chr2:240874074-240874212
  hyper
agagtcatcctagagcggtagagggcgctggacctcattcgtcctgtcagctgcgattgtctgtcctttgacaggtctcagcgcagcgttctcactgtgacctccgtgcagcatcaatcacttcgttcctttctctgg

SEQ ID NO: 28015 - DNA, 26 bp, Homo sapiens
  chr2:241393141-241393167
  hyper
agacccctgcgcacccgctccggctg

SEQ ID NO: 28016 - DNA, 252 bp, Homo sapiens
  chr2:241393198-241393450
  hyper
cggctggcgactggcatcggggcgcccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgcagtgcgcggcggaggttctgcggcggcggaggggctccttg

SEQ ID NO: 28017 - DNA, 684 bp, Homo sapiens
  chr2:241758324-241759008
  hyper
cttggaaagggctgacgcttggggaaggggtcctccagtctctgggggaaagtccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttccttcgtgtcatccgagcccgggcgccgggggcgcgccgccagcctagaccctgcggccccgcagcccctccctcgccgccgggccacacctgttacaggggcgctggctgctgagacgcaggcagtgctcgccggcggcccctcccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcc

SEQ ID NO: 28018 - DNA, 821 bp, Homo sapiens
  chr2:241759042-241759863
  hyper
cgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctcccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagg

SEQ ID NO: 28019 - DNA, 572 bp, Homo sapiens
  chr2:241760224-241760796
  hyper
ccggatgatgcaacccgcccgcggacccgccgcctcgcctctaccgcggctcgtggggaccccccgccctcctctcgccccacctctccaggcccccattgtcctcaccccagcctgtccagtttaacttccttggacccccaagtcacacgccgctcgggggccaccccggcaaaccccagcctgcgtcacccgcccccagccgccttcctagttccaggggctgactggtatctctgtgcgcgccaccgtcctccctccaccgtcccagggctgggcaacttcgacaaagcctctgggcagctcgcccatgggaacctccccgcactgcggtgcgggggtgcacggatttcgggccaccctgaaccccggggctgggtcccctccagcccagcccctgccatcgagcccctgccatgggcatcctggcgtcgcctggctaagcctccctggcgcccagcaggggcctgcgctgccctagcggcctcgccgttaaccatttcatccacactcctgggagagccggcttcacctcagtcccgacagctgcgtgcgagcgccttgcaggtggc

SEQ ID NO: 28020 - DNA, 234 bp, Homo sapiens
  chr2:241771123-241771357
  hyper
gggatgcgcggatggcgggggtgccgaggtgggcaaagggatcacctggggtcagtgcggggagctctgtggacaccaggatggcaagtcaggaagacgctgcccgccacggtccccctcgggcctgggaagcctggaaggtcagggcctggaggggagctgggtccaggcagggaactcacagcagagacgccccgagggtggggtcgggccaagagccgcagccaggggatg

SEQ ID NO: 28021 - DNA, 137 bp, Homo sapiens
  chr2:241771622-241771759
  hyper
gaactgcaacagccccgcagtctggaaagaagccgccagcagcccgcgcggccccgcggttccacggggcctcgtccccgcccctgccccgctgtaggccccgcctgctataggccccgccccgctgtaggccccgc

SEQ ID NO: 28022 - DNA, 53 bp, Homo sapiens
  chr2:241772052-241772105
  hyper
tggggtagactatggcggctgggcgcgtgcggcctgtgcggggcctccccggc

SEQ ID NO: 28023 - DNA, 43 bp, Homo sapiens
  chr2:242550007-242550050
  hyper
ctgcttccccagccacggggtcttctcccggcccctcatctac

SEQ ID NO: 28024 - DNA, 490 bp, Homo sapiens
  chr3:238226-238716
  hyper
ggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgc

SEQ ID NO: 28025 - DNA, 120 bp, Homo sapiens
  chr3:239006-239126
  hyper
gggcgcccgaatccgccgggtcccactcacgcccgccggccgccggtaggttggccctcccgcttccagcctccgccaccccatccctcgctgctctctgaggaggattccagacccccc

SEQ ID NO: 28026 - DNA, 711 bp, Homo sapiens
  chr3:239158-239869
  hyper
cgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccgg

SEQ ID NO: 28027 - DNA, 153 bp, Homo sapiens
  chr3:240109-240262
  hyper
gggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatac

SEQ ID NO: 28028 - DNA, 32 bp, Homo sapiens; identical to SEQ ID NO: 6753
  chr3:2139944-2139976
  hyper

SEQ ID NO: 28029 - DNA, 158 bp, Homo sapiens
  chr3:2140277-2140435
  hyper
cgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagc

SEQ ID NO: 28030 - DNA, 169 bp, Homo sapiens
  chr3:2140827-2140996
  hyper
ggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaa

SEQ ID NO: 28031 - DNA, 579 bp, Homo sapiens
  chr3:3840498-3841077
  hyper
tcaaagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctga

SEQ ID NO: 28032 - DNA, 430 bp, Homo sapiens
  chr3:3841494-3841924
  hyper
cctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaagatcgcgggcctgagggggacgagggggcgcggctcacggagctggggaaaatgacgaagtcgggaaacgagaatatagtgccccgtttccccccgtcccccttgccaaaaaaaaaaaaaaaaaggtgtgggagagcgatagttgggaaggcaggccagatagaaacaggcaaaaaaaggcagtgaccggagccgagcctgctggatt

SEQ ID NO: 28033 - DNA, 422 bp, Homo sapiens; identical to SEQ ID NO: 6759
  chr3:3842186-3842608
  hyper

SEQ ID NO: 28034 - DNA, 262 bp, Homo sapiens
  chr3:4910288-4910550
  hyper
gcctcctgtagggagcgcgggaccctcggctggcgcgggcacttcccagcccagcccggggcgccggcttcgccgcgtgcgcgtgcgcatggtggggtttggctggctgcgggatgcggtcgaggccgccgaggccgcaaactccagtgggaaggcggcgtgccgcggccggcttcggtggaggagggggcgtttccccggaaaaggaaggaagtgggtgtcacgggcctcaatacggcccctttgacgtcttgagtgggaa

SEQ ID NO: 28035 - DNA, 104 bp, Homo sapiens
  chr3:5018985-5019089
  hyper
aatataaacaggaagcgggagctctccaaggcgacctgaaggaaatacactgccagtttggtcaacttgtgaatgccagttctctaggtcgtcaagggcactgc

SEQ ID NO: 28036 - DNA, 220 bp, Homo sapiens
  chr3:5137799-5138019
  hyper
gaagcccctgcagtgcgccccgcgaccaccagctggaaccaaaaggcggcgcgcaggcgcggagcccacggggagcccaggctggggcgcgtgtcagctccgcctgacctgccaccttccctaggcagcggggggcgggggtggggggtggtgcggggagtcacatgcgtcccctccgaagctgggctggagttcatttacagctcgcttttctaggcct

SEQ ID NO: 28037 - DNA, 305 bp, Homo sapiens
  chr3:6902321-6902626
  hyper
tagctagggtcttcccgcgcccctccctcactggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctccccccattccccagccgcccacccgtttcc

SEQ ID NO: 28038 - DNA, 130 bp, Homo sapiens
  chr3:6902969-6903099
  hyper
gcccctgggctttcccggaggagctcgccctgaagggcccggacctcggcgagcccaccaccgttccctccagcgccgccgccgccaccgcagcagccggagcagcatggtccagctgaggaagctgctc

SEQ ID NO: 28039 - DNA, 86 bp, Homo sapiens
  chr3:6903624-6903710
  hyper
cacagtggctacctgcgcccttaaccctaaaagctggcttggactccggtggtgcgggtcaggtcagccttcgctcatttcctccc

SEQ ID NO: 28040 - DNA, 65 bp, Homo sapiens
  chr3:6904142-6904207
  hyper
ctcgggctgatttcccgacctgtagccagcctccgcgagagcccagggcgcgaggtgctgggacc

SEQ ID NO: 28041 - DNA, 318 bp, Homo sapiens
  chr3:8809397-8809715
  hyper
gcgagcactgccaggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagc

SEQ ID NO: 28042 - DNA, 132 bp, Homo sapiens
  chr3:8810151-8810283
  hyper
cgccaccccagaaatccccgttggaggtacctcctctgagccactgcaaatgagcgggaatcctctaccggccacaagcccagagcccccagcgtgccagttcctcgggatgttcagcggcttccactgggg

SEQ ID NO: 28043 - DNA, 97 bp, Homo sapiens
  chr3:8810791-8810888
  hyper
tctctcggaacaccccgagctcctccaggaacaaggagtgcgaggcaccccaccacctccactcgggtcccgatggctccaccggccctagccatcc

SEQ ID NO: 28044 - DNA, 302 bp, Homo sapiens
  chr3:8811111-8811413
  hyper
gatgggtacaggaggcgagcgaggagcgcctcccaggctgcgcgcgcggacagcgtctggatgcggcgctgtgcgctggggctgaggctgcactatcgcacgggtccgctagggggcgggcgaggccagccgcgcagacccctccggagcggagctggttcgcccagcgttggtcccagagccttaacaaatgggtttattttgcagtggtttaaaactgcgagagggagggaactcgtcaataacccgcccgtttcttcctttcttggtttagaagctcttgactccgagacacataggag

SEQ ID NO: 28045 - DNA, 135 bp, Homo sapiens
  chr3:9177995-9178130
  hyper
cgcccagcgccggggctggaggcagcagatgccgggccggggtcagccgccgcgcgccgttgccacggcaaccgtcgctgggaccccccccccccccgaccgccccgccccgccccgcgcgccacgtgcagcagc

SEQ ID NO: 28046 - DNA, 360 bp, Homo sapiens
  chr3:9541700-9542060
  hyper
tctccacctctgccccgtctctctcgatctctcctcctcgcgctgtttctctgtgcctgtgcgtccccctcgctccttctccaatcatctctcatctccctgtctctgcacccctcttctcctcaccccagtgtcttctcccattcccagtcgcttgctgcgcccctcccctcactctctcctaactctgctctccccctccaacgctgggcttggtttgcatctttgaggaactccctcctaccccaactccctcccacggggctcccgcatcctcccgcatttaactcggaccctctgtcccgcagcgcccctaccccaggccgactggactgtccgggaaggcgccggcggggaagg

SEQ ID NO: 28047 - DNA, 33 bp, Homo sapiens
  chr3:9542307-9542340
  hyper
cgaccctctcccctccgccgaggcccgaggcgg

SEQ ID NO: 28048 - DNA, 57 bp, Homo sapiens; identical to SEQ ID NO: 6770
  chr3:9593979-9594036
  hyper

SEQ ID NO: 28049 - DNA, 42 bp, Homo sapiens
  chr3:9594366-9594408
  hyper
gcccggaggcggggccggcggcggcggcggctggcgggggcc

SEQ ID NO: 28050 - DNA, 108 bp, Homo sapiens
  chr3:9595395-9595503
  hyper
gggactggcacggcctaggcgccgcggctcggcgctcccagcagcggctgcctcggcccaggcggcggcctctgcgcggcctccatcttgctcgggttctccccgggg

SEQ ID NO: 28051 - DNA, 83 bp, Homo sapiens
  chr3:9595598-9595681
  hyper
cggggaagggtgctcctggttctggcagttggggggaagggtggccacgatacctggggtcccccagccggggcagcaagcac

SEQ ID NO: 28052 - DNA, 125 bp, Homo sapiens
  chr3:9745353-9745478
  hyper
caccccagagacttgcgcagggcagactctaccaaggtgtgggttggagttgggagtcggggtgaggttccccgctggctccaggctgctccaatggggcgggggccgcccgcagggccgggcgg

SEQ ID NO: 28053 - DNA, 30 bp, Homo sapiens
  chr3:9745793-9745823
  hyper
agccccagccagccgcggggctcagcctgg

SEQ ID NO: 28054 - DNA, 428 bp, Homo sapiens
  chr3:9904233-9904661
  hyper
tcgcgtccaggcaggcggcacttaggaaggacaaactccaaaacccagggatccaaaggatccatgggaagatcgggtggctcaggggagtgactccccggcttggtcggcgctttgaggccccggggacccagcggagagggctcgggtgaggcatctggaggcgctgaatggggccgggagccgcgggacccgcagagggcgcctgtccgtgtgggcgcagcagcgcctagagggaggcggccccggcagcccgcaggggtcaggctctgctggagcaggggcgtccctgtctccgcttcccagcgcaggctgggtggggccgatggccattaaagccccgccccccgcggctcaccgccgcctggccccgtccccgaggccagaaaagaggagacccgaggccgtcagaccgcctgtcaagggct

SEQ ID NO: 28055 - DNA, 823 bp, Homo sapiens
  chr3:9956827-9957650
  hyper
gcgggggcggagaggcgagcaccctacggtatcccgagagggtggggagaagagggctgagcagtccctcagccgcccagccttcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagccc

SEQ ID NO: 28056 - DNA, 25 bp, Homo sapiens
  chr3:9993908-9993933
  hyper
ccgtgcaggcctggtcgcctgcgcc

SEQ ID NO: 28057 - DNA, 64 bp, Homo sapiens
  chr3:9993964-9994028
  hyper
cggggtcccgccatcgccccctccctgggccagctcctcacctgcgcgccgcagcccccgtgtt

SEQ ID NO: 28058 - DNA, 280 bp, Homo sapiens
  chr3:10206828-10207108
  hyper
cagcgggtcccgatccgagggcgtgcgagctgagcctcctggaccgggtccgccgcggacctcggcctgtcacctgaaggtgccgcgtggtctctgaggacgtctgtcgacgagcaggggccgccgccactgcgctctgagtccagagaacggtgggtacgggggccctcctgtcagcgctgctggctcggtgacgtccccaggtggcctctcatccagcccacaacagcctgcaaagtgcgagcctcgaccctgtagggacccacggtgctgtcacttc

SEQ ID NO: 28059 - DNA, 32 bp, Homo sapiens
  chr3:10547210-10547242
  hyper
tgcggcagctggtgccgcggctgagcccagcc

SEQ ID NO: 28060 - DNA, 694 bp, Homo sapiens
  chr3:10749237-10749931
  hyper
aatagggggttctagcgtcccggacgcccccccagctccggggctgctccgagcccggaaagttttcgcgcagcaggcgcaaggcgcgcccccttccctcacccgcaggcgccgggtccgcggacgcccaccccggcccgccccgcccgccgcctggtgcccgctcaaggtcactgctgacaaggcgcctgcctccgcggggcgaagggaccaagacacgctccggctcacgctcccgccctggcccggcgggggtctccggggccgagcgcccgcggaagggaagccagcagggaaagtgacaagagaccgagcgagaggggaagaggcccagagcccgggcccggccgcccctgcctcacctgcgccggctccgagagcgagatgctgccgccgccgctgccgccgccgctgccgctggtgcgcgcccggcccggcccggccccgctgcggctgcggctcctctgccgcggctgccccgcgctcgcctgccccgcggccccgccgccgcccgcccgcctccctccctccgccgccgcctctgccaccgctgcactgcgctctgcccgcctccccctcccgccctccctgctcactcctccccgcgcgctccccctcggccctccccaaactcctcacggagagcgccccgcgggaccggagcgcgcggtcccgcccgcgtcctcctccgcgc

SEQ ID NO: 28061 - DNA, 92 bp, Homo sapiens
  chr3:10857625-10857717
  hyper
ggagccggcctaggccggaatgggcgcttccactcttggcccagcaggccagtgggcagggccgcgggaaggacgggcgctgcaggggctcc

SEQ ID NO: 28062 - DNA, 40 bp, Homo sapiens
  chr3:10858369-10858409
  hyper
ccacctgtgccagtgcgcacgcgcacgtgccaattcgcac

SEQ ID NO: 28063 - DNA, 62 bp, Homo sapiens
  chr3:11034439-11034501
  hyper
ggaagaccgagacagcggagaggttgcgggtgagctgcgctgagcccaggagccgaggagtc

SEQ ID NO: 28064 - DNA, 5 bp, Homo sapiens
  chr3:11034502-11034507
  hyper
ggagc

SEQ ID NO: 28065 - DNA, 637 bp, Homo sapiens
  chr3:11034716-11035353
  hyper
ggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccc

SEQ ID NO: 28066 - DNA, 52 bp, Homo sapiens
  chr3:11035382-11035434
  hyper
cgggcagtgcccattgggttctgagcacacgtccccacgggtggcacccaca

SEQ ID NO: 28067 - DNA, 84 bp, Homo sapiens
  chr3:11196531-11196615
  hyper
gtccgtctttgagctcgggcgagcagagggggagcctcgttttctttgagcctccccagggtctgagttcgctgctaaccgtag

SEQ ID NO: 28068 - DNA, 365 bp, Homo sapiens
  chr3:12045988-12046353
  hyper
ccccgtagccccgcgcgcccccagacctttaagccagatgatgaacttcctgcggcgccggctgtcggacagcagcttcatcgccaatctgcccaacggctacatgaccgacctgcagcggcccgagccccagcaagcgccgacgccgccgccccccggcccgggcgccgcctcggcctaggcggcgcccccgaccgcctcgccgggaccggagcggacgccgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtgga

SEQ ID NO: 28069 - DNA, 222 bp, Homo sapiens
  chr3:12046377-12046599
  hyper
cgccaggaaggccaaggtgctgctggtggtcgacgagccgcacgccgactggtaggtgccgggcgccttcgccctcgggggtcggggtccgccggcagccgcaggccaggagaggacggtcccaggtcgccgaggaaacgtttcagaccaataaaaaggagggtccccgaggtcccgctgggaggaggtgcgggctgagcgcgcgcgcgtttgcggggtgag

SEQ ID NO: 28070 - DNA, 301 bp, Homo sapiens
  chr3:12329724-12330025
  hyper
caggacccggactgacgggtcgcgggcgggcggctcacgggtgaccgggtgaaggggtcttgggctgagggcacccgggctgagggtcgcgtctaccggagcgcgcactaggggcggagggcgcgggcacagagagccgcggccggtgccgactcgagtggacgcgagccggtgcgtcccggcttccaggacagcccccctcgggagagcgccgggtgggcgcggagccggggacacggggacctccgcgtccccggcggaggtgcgcaagcgtcgggagccgctccgggggaactttgga

SEQ ID NO: 28071 - DNA, 79 bp, Homo sapiens
  chr3:12838044-12838123
  hyper
agccaggcccaggcccgcccgcctcccgcggccgccacggccaaggcgtgagcacggggcggggcgggagctgctattt

SEQ ID NO: 28072 - DNA, 94 bp, Homo sapiens
  chr3:12917599-12917693
  hyper
cagggccgggagccacgggacccgcagagggcgcccgtccgcgtgggggcagcagcgtctggagggaggtggccccggccgccctcagaaatca

SEQ ID NO: 28073 - DNA, 590 bp, Homo sapiens
  chr3:13323439-13324029
  hyper
gcccgaaggtccacacggtgaggctgctccgggtttcgacaccgacactcatgggaggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctggg

SEQ ID NO: 28074 - DNA, 114 bp, Homo sapiens; identical to SEQ ID NO: 2205
  chr3:13324234-13324348
  hyper

SEQ ID NO: 28075 - DNA, 255 bp, Homo sapiens
  chr3:13324419-13324674
  hyper
gatccgggtcagctcctgcaggtactcggccgcctggccggggggctcggcggcgctggccatggccccccgcccggaggccggccgcgcctcaggcgagcgggcggcggggcggcggcggcgcggccatggctgcgcggcggggacggcggctcggcgcggcgcggggctgccgcggccccgcctcggctcccgcctccgccggcgccgcccccggggcccccgcgcctcctgctccccgcgccgccgcgctcc

SEQ ID NO: 28076 - DNA, 198 bp, Homo sapiens
  chr3:13324740-13324938
  hyper
gaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcggacgattttagga

SEQ ID NO: 28077 - DNA, 194 bp, Homo sapiens; identical to SEQ ID NO: 290
  chr3:13590447-13590641
  hyper

SEQ ID NO: 28078 - DNA, 78 bp, Homo sapiens
  chr3:13590973-13591051
  hyper
cgggttcccccaccccaggtccgcagcttcctccgctctgggtttcacttctcccccctgggccggctcccaccagtc

SEQ ID NO: 28079 - DNA, 125 bp, Homo sapiens
  chr3:13696641-13696766
  hyper
gagtgtccctgatcccgggtggtcgctctccagcccgccaggctctccgacgggctcaacccgcagcccctggccggggctggggccgggacgccaggcccctgtggggacggttccctccagca

SEQ ID NO: 28080 - DNA, 1064 bp, Homo sapiens
  chr3:13919665-13920729
  hyper
gggaggccgcggcgccggcgggagggcggcccgcgggcgggcggggcggccaggggaggttattttctgctgttttccctttctgtctcccccgccacccgtgtccctcctccccgtttctaattaaaaaggagataaagccgcacgcggcccgagtcaatcggctcgagccaatcggccctactggcttcctggatgctgaatgtgcgcggggcggcggggcgcgggccaagatgaagattaaagcaggggaaaaaaaggaaagccacccagacgcgggcgaatcaataacacttaaaacacaccggcaggctggcggtactggcgcgagccccgcagccgcctctccgccgctggtcgggctggcggcccctggtcggctctgcacgcacctgctagcggccgcggccggacaacttgcgaaatccccgctccagagacgtggactggggaagtgacggggtaggggggtagtagtgacaaaacacaaagggtctgccacgcacatcccctcgccgcagcccctgcggtccacccctcctcaaaagggatggtaatgggttcactgctgggggctggaggggcagggtgtgtgagacctaccaagcgggcccttcagcgccagaacctctatccatgcccagatccccccgcccccacaccgctccgagcctcacacgcgttgtcttaagtacaaagggtgaccggctttgcacaagcagctccaggacgcgtcccgagctgccccctcccaccttccagccagagcgcccccgagccccacctccacagaaacgctaggtgaagccggagggctgctcgcgcgcccggccgcctctgctgcccagttccagggggcggggtgtcccgcctctctctagcgcttgtctccctctgtgtctcagaccgcctctcgtcccacctttgtgtgtgtttgttgggggtgggacgtgctgtccccttggcccgggaaggggctctgggagtctaagggcccctggaaattgggtggtgccaaggctccgagcggcggtttatgtttttgccagcgaatgtccttcctc

SEQ ID NO: 28081 - DNA, 804 bp, Homo sapiens
  chr3:13920980-13921784
  hyper
ctggagcgtccctaccggctgtctctggtcctgggggattccagactcagacgtcctcaggatggccagtccccctgcctatatctcctggggtgtcctgcggggggcctttgtgcgtccaccgctcccacaccgcacccacccggcctctcagagaagctgtggaagttggccggcagaggctcgcaggcggcacacctccctccccgggccgtgccaactttgtcgaaacacgcgcggaaagggcgcaggcagcccttacccgatccggaggtagaccatgcccaggctgagaaagaggtggcccaggcagcgccgcgctttccggttcatagtcccgattggccgccggggccgcgggccgggctgtgctgatcccgcgggccggccccggcggggcaatcaacatagcccgcccgggaggcgcgagccgaggcgtccccggggccgtctgtcggtgcgcccgtccgcgcgctccgcgcctgagcctcgccaggagcacgggagccacggagcgggaggagggagggaggagcgagcgcggcgtggggcgacgccgggctgcgcgcgagcgaccggtgcaagtgtgcgagacgcggggagtgcgggggcgctgctgcctccagcccccgcccctccctcctttcccccgtccctcccccgccccctcccccgcccgcctccccggagcgcccgcccagcgcccctgcgcccgcgggacagggccgcctgcacaaggcgcgcgctcgcgcctttccatgcgcgctcccgggggccccctccctgctccggggtgcaggtggc

SEQ ID NO: 28082 - DNA, 757 bp, Homo sapiens
  chr3:14643752-14644509
  hyper
gtcagacaacaggtacgcggggagcagcccgggcggccccgcgcaggggttgagccgcagcgctgctgtgcaggggcaggcccgggcagggggcagtgcggcgagtcagccccctccctggcctcctcgcaactttgagtaaccgcggactccggggtcggcatgggggtggcgccgggcgttcaaaggaaagttgggtgcgacggaccgcagcctcgggggccaaaggacccccaccgtgagcgcggccacctcccgacacccggcgggctggctggagggagcaggtgaggcacgtggccgcctcgccaagccagggctccctccaggagcccgacccgccggccgggccggtggatgccccctcgagggctcagacccttcgctccagcccccggcgggcgccctgccccgggtcccacactcccgcgccccgtgggccccactgctggctttccgggaccaggctccgctccgcagctcgcgtcctgaggtgatcctccaggctccccactttgggaccccctcctgcgcctcgggtgccggcgcctgtcttcgcctcccgcggggaccctccccggcgccccaggcgtgtgcgccccgggccagctcagctctgggtccgccctccgcaccccgcgccgcgcgcgcgctcaccggccgggcagcggccgcgtcttaccttcgtccggcagccgctgcaggcagagcgcgaggttcctccgccagccccgcatccccgcggccgccctgcggc

SEQ ID NO: 28083 - DNA, 102 bp, Homo sapiens
  chr3:14851825-14851927
  hyper
aactcgctgagttctcgtccttcgaacccccagcgcctcccgcggtgcccatggccacggcccctttaaatgtgcgcagggacgccccggccctcgcctccc

SEQ ID NO: 28084 - DNA, 35 bp, Homo sapiens
  chr3:14852170-14852205
  hyper
cggaggctcgcggctcgcgcccccactgccctgcg

SEQ ID NO: 28085 - DNA, 298 bp, Homo sapiens
  chr3:14852212-14852510
  hyper
cggagtccgaggcgcgccggggccgggcgggcgccagggggtgcgggccccgcggggcggccgcggagggaggcggtgtgcggagtcgcactgggacccgcggacggactgaaacgccgacggcggcccgggccccgcgcgctgaagatgaacagagcaggtaggaggcccggcgacctccggcgccgaggcacgagcgcgagggaccccggccgggcgctccaagttggagctcccggggagcccggggctagctgcccgaaatcctccgaccttccagtgccgctcggcctcggcc

SEQ ID NO: 28086 - DNA, 136 bp, Homo sapiens
  chr3:14852735-14852871
  hyper
ccctccattccccagcgtcccggaccggtccttgctcatctctcaggggcaacacctgacccacggggcccgtcccggagctctcttcgactccgggaccagttcccagcccttcagtactcggcataccggaagg

SEQ ID NO: 28087 - DNA, 414 bp, Homo sapiens
  chr3:16554052-16554466
  hyper
acagacagcagggagcgtgcctggttctacaaccttggcctccacgcggttcttgctgccaaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcacc

SEQ ID NO: 28088 - DNA, 443 bp, Homo sapiens
  chr3:16554467-16554910
  hyper
cctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtc

SEQ ID NO: 28089 - DNA, 450 bp, Homo sapiens
  chr3:16554911-16555361
  hyper
acaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctcccc

SEQ ID NO: 28090 - DNA, 30 bp, Homo sapiens
  chr3:16925675-16925705
  hyper
cgaggagggaccacgcggcctgtagggggc

SEQ ID NO: 28091 - DNA, 475 bp, Homo sapiens
  chr3:18485177-18485652
  hyper
tggtttcccaaaccccggttctgccggcccgggagccttagcactggagcaataggaaaaggccaccgcgctcgggtctggacagcaggagggaaacacggtgtggactgcgaggctgcacctgtgatgtcccggcccctgctaagaggacggccctttcttctgcctcttgcccaactccaaacccacattcacgccagcagcctctccaggaccggcctcgctacagccagcgagggctcgaaatgaggagtgccgcggctttcaaactccgggctccaacttgagcgccccggcgcccgagtagctcccgggatgcagaagttgccacaaacttcccaggcccctcttcgccgatgcttacaatcagccgcgcaggcagggagcggagggaggcggagatggaccgggaaaggatgctgagcagactcgcgatccggtgggggaacattaccactcccgcagcccactcctc

SEQ ID NO: 28092 - DNA, 231 bp, Homo sapiens
  chr3:18486970-18487201
  hyper
cggcgcggttctcgtcgcccgccaaccctgccccctcacctctccgggggcccccaacacgcgcactcctcctcttgtcgcctgcggcttcctcttgttgcttgttgtttggctgggttttggggggtgagtagagggggttactgtagtgtgtgtgcaggcggaggaggaagtcaggtgagaggccgcgaagcacccccaccccaacccagcctgcgtggggtgtatgct

SEQ ID NO: 28093 - DNA, 133 bp, Homo sapiens
  chr3:19189373-19189506
  hyper
tcggggccagtttcccggactaaaagaccctggtgactggggatgggcctcacaactaactcgggctgccctgcccctgtcgcgtgggctcgcaatggcaagtgctccggaagggggccgcctccccgtgggg

SEQ ID NO: 28094 - DNA, 394 bp, Homo sapiens
  chr3:19189778-19190172
  hyper
cccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctg

SEQ ID NO: 28095 - DNA, 247 bp, Homo sapiens
  chr3:22413664-22413911
  hyper
gagaccctccagctccgcgctcttcactctggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaac

SEQ ID NO: 28096 - DNA, 119 bp, Homo sapiens; identical to SEQ ID NO: 6806
  chr3:22413959-22414078
  hyper

SEQ ID NO: 28097 - DNA, 116 bp, Homo sapiens
  chr3:24535479-24535595
  hyper
cagaggaagatgctgcgccaagagaagcaaagcgaaggagcgcgacccaggaggctagcgaaatccccgccaagcccccaggaggcggagagaagcccagtcgccaggcaccggcc

SEQ ID NO: 28098 - DNA, 203 bp, Homo sapiens
  chr3:24870641-24870844
  hyper
ggcagcagtagcaggcgcggccgccgccgcctccggctcagctcacgcggaaaccccactgggccgtcgtggctccgcgcggttgcgggccagcgtggagaggcgggacgtggcgcccgggggcggggcctggcgccagggggcggggcgcagcgagccgggctcccgctgtctgctctcagcggcggcggcaggggctgagg

SEQ ID NO: 28099 - DNA, 15 bp, Homo sapiens
  chr3:24871162-24871177
  hyper
ttgctattgtcttag

SEQ ID NO: 28100 - DNA, 97 bp, Homo sapiens
  chr3:24871789-24871886
  hyper
aaaaggtgtgcacgccgatgtcttgtaggtggactcccggaggtgggggtgggggtgggtacgagggataagttttacctagagctagagctggcgt

SEQ ID NO: 28101 - DNA, 156 bp, Homo sapiens
  chr3:24871946-24872102
  hyper
ccgtggctaaggatgctcgggtgctggaccgcccgctgtgcctccacacccctccgccccgcccccttccagctctcagcgcggggtgagtttccctgacactccccgccggaggcaagcaggcagaggcgaagtgatggtcgcggagtggaacag

SEQ ID NO: 28102 - DNA, 44 bp, Homo sapiens
  chr3:25469358-25469402
  hyper
ggctggggggcgaggcggtgggcgggaggcgagcgggcgcaggc

SEQ ID NO: 28103 - DNA, 55 bp, Homo sapiens
  chr3:25469403-25469458
  hyper
gaacaccgttttccaagctaagccgccgcaaataaaaaggcgtaaagggagagaa

SEQ ID NO: 28104 - DNA, 51 bp, Homo sapiens
  chr3:26664089-26664140
  hyper
acctcagctggtctccggcagccaacgctcagcccccgcctcctctctcca

SEQ ID NO: 28105 - DNA, 893 bp, Homo sapiens
  chr3:26664739-26665632
  hyper
ccgcctgttgcttttcgcagagcgcgggatcatccctctgcccgggtacctaggccgtccctccaaggaacaagtagaggagaactattacaccagttctaagccgtgcctgtctaagcctccctgatcccttttgcgcagaccctgggagagacctcctcctggagagagagagtcgaccctcttcgctcctgttcagccggctgctatacaatagtctgcaaacttttgtgaccccttccctgcgcggtgctcaccccgtgctgtgcaacttgcaggtttagttcttgcccttcccccagcccctcttgccatatgcatctgcccatttctctctgtgtgttcttgccagtcgacttttcactccccgcagctctggctcctgaggcgagggtttgggacccagcagtgctcgtcctgcctctaggagctgggtagggacagagaaggtgaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgggtgaagtaagtggctcagggagggaaaggctgctcgtgcggtggaggaggaagctgagggtcgggtagatctgcccacggttgagggaaatgaaaaggtactgctaatgtgggcgagcggccagccctgagaggccatctgacgaagaggaaaagggatttgagtccggagggcgctggcctgggtatgtaaatacagatgggggaggggctgggtacctgggggcgcgtggagacaaggaatggagccccggaatgccgggcccttgggtac

SEQ ID NO: 28106 - DNA, 170 bp, Homo sapiens
  chr3:27410909-27411079
  hyper
caggccaccaaccagcgctggccaggccaatgccgacaattcttcctccgccacctggggcgcctcagccaatcgggagcagccatgctgcgcagtgcagaacgccatagcgacggatgacgcctgccggggaatcgccgtagcaaccagagacgcgctagatccaccac

SEQ ID NO: 28107 - DNA, 411 bp, Homo sapiens
  chr3:27754121-27754532
  hyper
ctccatacgtgccctcggcgacacacagaggactcccagagttgaagaagggggtggatgtgtgtgtgcgcactcgcccacgtctcgtgttttacttttcatttaagtcgtaataaggagaaattcgatgaccagcaaggctggagtcccatcgtcttgttgggggagaggggggagaagaaaaaggtgcctgtaacttcagactgtccaagatatcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaagacacgcgccggtggaccgggtcctgggattggcttactcccgggctggaccttgg

SEQ ID NO: 28108 - DNA, 114 bp, Homo sapiens; identical to SEQ ID NO: 6813
  chr3:27754814-27754928
  hyper

SEQ ID NO: 28109 - DNA, 120 bp, Homo sapiens
  chr3:27756087-27756207
  hyper
ggggtgtggggaaggcgctgaccaggataggggggctatgagtctcccttccggaatctaaatcagtcatccacagtacatatatcttaaaaagcacatcttcaacgcttttgtccttgg

SEQ ID NO: 28110 - DNA, 30 bp, Homo sapiens
  chr3:27756685-27756715
  hyper
ataaacggaactaagcgcaaggtgaactgc

SEQ ID NO: 28111 - DNA, 30 bp, Homo sapiens
  chr3:27762343-27762373
  hyper
aactttctcgcgcaccgaacccgagccagg

SEQ ID NO: 28112 - DNA, 1461 bp, Homo sapiens
  chr3:27762701-27764162
  hyper
gcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccgtgagttggaaagcaggaggtggaaactaacccagaagccctctccttttccttcctcgtacctcttgctcctcaggacccccaccctcctcccaggctcacacgctggaagaaggtgacttagatctttgtccccatccacccactagcccgcgcctttctgccctt

SEQ ID NO: 28113 - DNA, 49 bp, Homo sapiens
  chr3:27764423-27764472
  hyper
tctgtaatttcgccggaatttagggggacaaagtttggggtctccatag

SEQ ID NO: 28114 - DNA, 257 bp, Homo sapiens
  chr3:27765105-27765362
  hyper
tgcgcctctgctctgcggcaaatacagaaggtagaataattagtgaaataatcagtttgatattgaattaaactccagctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttc

SEQ ID NO: 28115 - DNA, 507 bp, Homo sapiens; identical to SEQ ID NO: 6819
  chr3:27771497-27772004
  hyper

SEQ ID NO: 28116 - DNA, 1213 bp, Homo sapiens
  chr3:28616731-28617944
  hyper
ttcctcctaccccatcgaccctctgttgccgacctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttctagtcctcgccgccaccacctcgcacaggtcggagatccctcctttccttggctcctttgcgttggggagggggtaaggctgagggtcggcgcttggtcagcgggcggggaaggtagatttcacttgcacctgagagtccctattcttgccagcttcgccgggcaaagcccggcgaccaggttggttcttccagcaactttgttcagaaggttggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaagggagggcgcgcgggaggcggcccctcctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcga

SEQ ID NO: 28117 - DNA, 30 bp, Homo sapiens
  chr3:29322482-29322512
  hyper
ctggagaggctctctcggttccacccaccg

SEQ ID NO: 28118 - DNA, 168 bp, Homo sapiens
  chr3:32433865-32434033
  hyper
ggcaaagttccttttcgtctttcttcctcttctctgggccgcgccgcttcgaacccgagccgggggtggaagagtcgcccaggcggcggcgctgagggagcgaaacccgacctcttccccgtccacggcctcctctttcctccgaacccagcgcggcagggcttccct

SEQ ID NO: 28119 - DNA, 294 bp, Homo sapiens
  chr3:32443174-32443468
  hyper
cctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgactt

SEQ ID NO: 28120 - DNA, 1241 bp, Homo sapiens
  chr3:32857718-32858959
  hyper
gagttctttaaaaaacgtaaaaagaaaaaaagaaaaggtgggtaaaaaccgagatctcccgggcagtggatatgtctcggttgagccagggattcagaatgaaatcttttcttttcttttttaaataaacggaagagtcgttctctgctcctcgctcagaaggtttcaaaggtcgtcacactgaagcccgggggcgttcatctccccagcggccgggagaagggaggaggttggagggcggagggagggagcacacaaaagcgggccgtgctgagagggctaatgtttcctgtttgcctggagccccctcccctgcctcccctcccccagccccctcccagcactcgggcggaagtgagtttgctcctttggagattaaaaggattccgaattccgatcagtcccaataaccggcgtactgaagagaagaggaggaggaggaggaggcagaggcggcaaagcagagaaagagggggcgcgcgcgcgcgcacgcaacccgaactgggggagttgtgcaaagccccaggaggccggggcacggcgggagcaaagctcggtaggcgcagcgcggccgaggccacccgcgtccggatcggcgactcctttcagaaagaagatgacgcgggcgcgagccggcggcgttggccacgcggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgcgtgcgtactgcacgcgtgcggccgcggctgggccaccacgagctgcagctgctgcggggcccaccgccctgcaggggaggccgtgcctggctgtgcgcaagccccaagcgcagcacgc

SEQ ID NO: 28121 - DNA, 30 bp, Homo sapiens; identical to SEQ ID NO: 293
  chr3:32859255-32859285
  hyper

SEQ ID NO: 28122 - DNA, 846 bp, Homo sapiens
  chr3:32859417-32860263
  hyper
gggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgc

SEQ ID NO: 28123 - DNA, 1077 bp, Homo sapiens
  chr3:33259719-33260796
  hyper
cccactcatctttcacgtcttcccggaccaagccaaaatatccgagggagttttctaaccatcggcggtgtcctcaggggcacattaatagacgttgagaaactgagggacggcggaaaatcaccccttagcagaggaggttctagggcaccttagaggtgatttcattcgagctttcttggagaccttaggaaagccagcggcgggactgcgggacctacgcgctcggcgctaagggagggtccaggcaccaggcgggcgtttgggcgcacgggcacgcggagacttggtgggccaggagagggatgctgggtcgcaggaccgcggctcgttcgttcctctcaggcttgcgcttgccgcttgccgggccggtcagagggagcagccccggcgagctacgccctccctgcccggaccccacgctccaccccccgccccgccgcctcccgcacactcaccatccgcccgcaccgaaaggcgcggcagaccgagcaggagcagcgccgccgcccagagcccggggaggcgtctgtgccaacgggcaggcgggctgggtccctcggcagtcatggtccgggagtgcgcgggccagcggactcgggtgagggctctggctgcgtttggggttgcccaggccactgcccagcgtgcgccactcggctctgcgctctgcgctcggctcacgaatcgcaggcttcgcgccgggcgcgccgagagggaggagcgcggagagccgggggaggctcgggacgcagagccggagcgcctgggccgccgaactcccgggggtcttctctgtggcgccgaggaggcggctgtaacccggctccgccttcgcgctgggcacctggaaacctcggtgccaaaaggggctgcgctgggccgcgcgctctgcgggtacagcggggcggagggcgagggcgcagggaggcggggagagtagctagccggccgcaaggagcccccgcccgtctgggggacccttggcgagagggtgacgcagtctgacaggcggagcccctccggcagggccgttagacaacgagtgtctaactctgtcctcggcctctacttttc

SEQ ID NO: 28124 - DNA, 48 bp, Homo sapiens
  chr3:33318917-33318965
  hyper
ggggcgcctggctggcgtcaccaggacaacgggcgtcgccggcgccgt

SEQ ID NO: 28125 - DNA, 767 bp, Homo sapiens
  chr3:35680814-35681581
  hyper
cgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccag

SEQ ID NO: 28126 - DNA, 30 bp, Homo sapiens
  chr3:36421872-36421902
  hyper
ctgtgaggtcgccggcgaggtggccgcggg

SEQ ID NO: 28127 - DNA, 529 bp, Homo sapiens
  chr3:36805601-36806130
  hyper
gcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcgacggtcgagcaggcgcgggaaggcggggcgagacgagcagccacgagcccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccc

SEQ ID NO: 28128 - DNA, 3 bp, Homo sapiens
  chr3:36806178-36806181
  hyper
cgg

SEQ ID NO: 28129 - DNA, 44 bp, Homo sapiens
  chr3:36986351-36986395
  hyper
tccctgtgggcagggcgcggcgggcagtgcggaagcccgaaagc

SEQ ID NO: 28130 - DNA, 57 bp, Homo sapiens
  chr3:36986663-36986720
  hyper
aaatggtatggctctcggccgcctttgaataaacgagtgcttcgaaccctttaccag

SEQ ID NO: 28131 - DNA, 438 bp, Homo sapiens
  chr3:37493692-37494130
  hyper
gcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttc

SEQ ID NO: 28132 - DNA, 301 bp, Homo sapiens
  chr3:38035773-38036074
  hyper
cgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatgtgagtgcgggggcgaccggggcaggagggagccgtggaggcggtgccttggctggggcagtcttgggatggccatcgtccacatccctgaatggggcaagccgggaggggttgggt

SEQ ID NO: 28133 - DNA, 83 bp, Homo sapiens
  chr3:38070745-38070828
  hyper
cgtaccgcccgcccacccaccccccgggctagatctcggacaagcctggaaacgcccagggtcgtgcccggcagtcccaccca

SEQ ID NO: 28134 - DNA, 474 bp, Homo sapiens
  chr3:38071100-38071574
  hyper
ggtccgagcggagtgcggtgcagggacctgaatggaccgcggtgggaggaggccgggggtggtcccgggacaccgccccgcccccgctgccctgcgcccccgccccctgagcccgccaaccctcgtctctccccgcccccttctggggacgcgagagggagggcagagctgggggcccggaggactggccaaccctggcccgggccagcgggcgcgccccgaccagaaatagccagattcctccagcttcctccgccgccgccacccacgggccgcgggccctgtcattaccgcgggcggccgggccccacgccctgttgtgggcgcctcgctggggtcggggtgatgctggaaagaatccggcgtcatcccggggaagggatcgtgtaaggtccgacgcccagccgggctgctgcgctagggagacgcggcgtccaggcttccagccgcagctcccagcgttcgcattccctt

SEQ ID NO: 28135 - DNA, 383 bp, Homo sapiens
  chr3:38080626-38081009
  hyper
agcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccgg

SEQ ID NO: 28136 - DNA, 133 bp, Homo sapiens; identical to SEQ ID NO: 6836
  chr3:38081153-38081286
  hyper

SEQ ID NO: 28137 - DNA, 211 bp, Homo sapiens
  chr3:38690516-38690727
  hyper
cagagaaagggggtgcgtggcttcctcccccatatccagccctgctcggtcagcccccgcaaaccccgctctctggaaccacattcatggcgcgcctagtcgccgctctgaccttggggtctccggcctccggtatccgggtcccaatcccagaccctccccgagcctgcgccagggatggccgggaagctggggccgcagctccccctcc

SEQ ID NO: 28138 - DNA, 26 bp, Homo sapiens
  chr3:38691468-38691494
  hyper
cgacccggcgacgcttcaccacagat

SEQ ID NO: 28139 - DNA, 120 bp, Homo sapiens
  chr3:39851235-39851355
  hyper
gcagcccagctttagcgcgcagaccgacccgcgccccttcttcgccgccggcagcctctaatccacgcggcgcgttgcggcaggtgccctgggcgtactgaggcgcggtggcctgagccc

SEQ ID NO: 28140 - DNA, 57 bp, Homo sapiens
  chr3:39851638-39851695
  hyper
atcgcctctttctctcgctgctggggtgggagctcgcctctgcgtttccctcgcgtt

SEQ ID NO: 28141 - DNA, 30 bp, Homo sapiens
  chr3:42305003-42305033
  hyper
ggcgcctcctctgcccgctgcagcccggag

SEQ ID NO: 28142 - DNA, 30 bp, Homo sapiens
  chr3:42305329-42305359
  hyper
gaactcctcacccagcgccaaggggcagag

SEQ ID NO: 28143 - DNA, 534 bp, Homo sapiens
  chr3:42543046-42543580
  hyper
tggtccacaagaagacgcgctcccagggcgcagagctggtgaccccgctccccatgccagggacgaataaacgagaaaaggggctgacccggtgtcacccagcggccgagcagccgccccttggaagctcagcaccaaaggcaggcggccagggtcctggcccctctctggaccccagtatccccagctgtaaaatagggaatgcaggaggaggacgacgtctgtggatcgttttaggtcagctgcggagtcggcctgcgggctgggagcagacctcgctccccacgcgagggcgctggcacttcagcccagcctccctggggaggtgccctggacgagacccgcgagggtgcggacacctcatcctccctggagcaggtctcccgaggcttgaagggccagggcacccaacaggtgctgagcgcgccccaccaggtcacccgggagcagggaacaccaaggaacccagagtcgggcctctttcgagccctcgcttcctctcgcctggcttcttcggcgcgaaggatgaattgg

SEQ ID NO: 28144 - DNA, 860 bp, Homo sapiens
  chr3:42814258-42815118
  hyper
gggaactgggagatgcggaagtgcacgccgtcgggtcgcatctttcagtgcggtgcgagagggcccagtggcagaggcccagcaaacagcgcttgtcaggcggacctgagttcgagttctgactgtgccatctacgctatgactttggggcaggcgacccaccctctgcgcctcattaacccatgtactgcatggaaaataagcgtctgcctgggttagaagagggctgtgtgtgaagattcaaaggacgaaggggaagagtcctcgctgggcgcccagcacgcggtgagcgcccggccagtggcagcgcgctcgggctggggttgcgctcgggctcggttccgcgcccccggcagctgcgggctttcccagctccggcccgggcccttccgctctccccggcacttacagcggtctctctccacttctcccttctaggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttgaaaaatgtaaaacagtgtggggaaaggccatgttatgatggtgagtgaaggaagcaggacgcaatatagcaatg

SEQ ID NO: 28145 - DNA, 303 bp, Homo sapiens
  chr3:42947369-42947672
  hyper
gtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggtgtggagcacg

SEQ ID NO: 28146 - DNA, 36 bp, Homo sapiens
  chr3:42947925-42947961
  hyper
cgcgccgggtgagtgcggggccggagcctggaagca

SEQ ID NO: 28147 - DNA, 498 bp, Homo sapiens
  chr3:43020926-43021424
  hyper
tgtgcagcgatctcccgagagttggcgcagggccacttggctgcagagaacgtgtgcaccttcagtccgggaaacccgccccagccgagtagccgcgcatcctgggaagcctggcgagccacggcgccgggggcggccaaggggaggcgggatgagtctgcgagccggctgagcgcgccgaggagccggccggggcaccgccggggacatggtaggactcgcgggaaggaacgcgcgagcggagggtggggcgatcaccaggacaggtggctgcagtcaacgcgcagcggcccagggcgcgcgcagcctgcgcggcctcccgaggccggagttgttccccgaaagttgcatggggcggcggcggctttcatttctgcaccagagctgggggcgatcggctttcctgccgctcttagtggggcggaccgtaataagggggcttttattactaatctgcactccttgacctaaccgtaacccactcgcaactctgcaatc

SEQ ID NO: 28148 - DNA, 330 bp, Homo sapiens
  chr3:43935852-43936182
  hyper
caagcccacaggcaacgccagcgcgctcccaaccgctggagacagaaacaatgtgcgcgcgcacacggcccacgtgcacgcgcgcacgcccacgcggcatacaggcgcgcacgtgcacacgcgcgcctgcacagctctgcggctctgctccggccccacaggcccatcttaaagtgtttcgtgctctaacttaccaaacacgtggcagccggcagaacgaaaaggaaaataaatgaactgcgacgaaataaagcaggcctttccgcagtcggccacgtccaacagccacttggttcctagcgctttctcgttacccggcttgggcaaagc

SEQ ID NO: 28149 - DNA, 895 bp, Homo sapiens
  chr3:44036233-44037128
  hyper
ccggtcctggcctctcggtgttcaggtgtgtgtataggtgggcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgc

SEQ ID NO: 28150 - DNA, 1765 bp, Homo sapiens; identical to SEQ ID NO: 2221
  chr3:44037129-44038894
  hyper

SEQ ID NO: 28151 - DNA, 602 bp, Homo sapiens; identical to SEQ ID NO: 2222
  chr3:44039424-44040026
  hyper

SEQ ID NO: 28152 - DNA, 1094 bp, Homo sapiens
  chr3:44040056-44041150
  hyper
cggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcgagtccgtgcgatgcccaggtcaagtttgcagagagagtctgcggtgtctgtctcct

SEQ ID NO: 28153 - DNA, 551 bp, Homo sapiens
  chr3:44063340-44063891
  hyper
ttgatttttggcccccgctgcagcaagttgggggctggtgaggagtgtagcggtgactgggggcggagtgcggactcgcatccgctgtaccaggagcccactgccacctcgggattttttttttaacttggaatttccatatgacaaaaaagaaagaggtttctcctcaatctaacggagccattaacatctattaataacgccgacagggtaagtaacggagccgcgctcctcggggtggtcaccgggctgcgtggtcctcggccggcctcctgcatccgctgcccctgtgcgctccgggccggatgcgcaagggcggcgcggggaccaagcctggctgccggccgcctactcctccccttccctaaggtaaggggtcgttttcacactcaccagagctcctgcgggctgagctcgccccctcccccgacttctttgcggggcattttctcttgctggtgtattacgtgtcatttctcacggggcattgccggccgcttttctgcaactgtcctttcggatttggtgatctggtccggcacagaggctct

SEQ ID NO: 28154 - DNA, 207 bp, Homo sapiens
  chr3:44481337-44481544
  hyper
gcttcagtgaaaggacgaacaagtggctctggtttttgttgtggttatgagagctcagtgcatttgacagtcagggtttgcacagtttgaacttcccctctgacgcaaagaggaagtggctgggctttcttatcagcttgtccagatccaggcaaactgagggggagagcttgaatgctattagcagacaaacgtcaaacatgggga

SEQ ID NO: 28155 - DNA, 567 bp, Homo sapiens
  chr3:44596464-44597031
  hyper
ggtgtagagctgggacgcgtctggatcccccgactatggcctgagagcgggatgtgagtggcctgggccctcgcgagaccccgaccccgcccgcggcaggtggccgggcacagccgagaagtaagccctgccagctctcccgggtgcggggacgcgcgcgcccaccttcgcaaacgagacttccgggatcccggagggggcggaagtcgaggcctctctcgcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgctgttttcccagc

SEQ ID NO: 28156 - DNA, 101 bp, Homo sapiens
  chr3:44626437-44626538
  hyper
gctgggagttgctgacgcagttccttctgcgctttgttcaagatgtgggtctggcgctttcggtgaggggtgctctacagtctggcgtggggggtcgggcc

SEQ ID NO: 28157 - DNA, 182 bp, Homo sapiens
  chr3:44626539-44626721
  hyper
ggttctgggagcgtgtgggagacgcaagccaggaggccagggctcctctgcggctgcccgctgctgagatgggcgcggcagccaaggggtcgttgtgggcctcccctttctctcgttcagtgctgcccctttgtcttgggtccagtctctgactcctcgtagctgctcgcttggaccaggct

SEQ ID NO: 28158 - DNA, 225 bp, Homo sapiens
  chr3:44726844-44727069
  hyper
tgggtataaatatgaccgcaaaactgcccttcaagcagttgacgagcgactttccccttacatcaagtgcacagtaagcccaagcgccggggccgcggggattcccgccagtcactcccgccactaccgccacccggccccgccgccagcgcagcccgcagccccggcaagcctgcgcccgctcggccccggtctctttcgctcaccagaggctacggggcgccc

SEQ ID NO: 28159 - DNA, 177 bp, Homo sapiens
  chr3:44727070-44727247
  hyper
gccccgcacacccaagaaacactgccaccgcgacgcgcctgcccccaggatcctctcgcgagcttcagtacccaaggaagatgggccgtcccggaagtgcggccggggcgacttgcaggcccctcgccgaccgctctaggaatctcggaggtcttttgacctcgacgcctccttacc

SEQ ID NO: 28160 - DNA, 40 bp, Homo sapiens
  chr3:44754372-44754412
  hyper
gtagggcactcctagcggctcggcccgcccagcctgcagc

SEQ ID NO: 28161 - DNA, 110 bp, Homo sapiens
  chr3:44770966-44771076
  hyper
tggtgccggcttaaccggcgcagcaccgaaacccgtagctgcgtgcgggaaggaaccaccgagcggaagccgctcccaccttcctagagaggagacggtagtggttatta

SEQ ID NO: 28162 - DNA, 632 bp, Homo sapiens
  chr3:45837540-45838172
  hyper
ggttgggggcttggccgcccccgggatggggcgaggggttcccgagggcttgggagggcggcttgggagagagctccggctccggaacgaggtgtcctgggaacactcccgggtctgtaacttcggacaaatcacgctcgctttcccggcctcagtgtgccgttctgtaacttgggtctaaccccggctcgcacacacggcggggacgcgcacagagttgggctggggccggggcgcggtgggcactcacctccgccgtacatctggcacaggtacgggaatcgccacacgttgcccaggcccacggcgtacgagatgcaggcgaacacgaactgtagcgagttggcccacagcggccgcgctttctccatggccccggcctcggcgcgctcggctccggctcgggggtccggcacggcagtctcagtgcgcggtcgccaggcgcgccgtcccaccccggctcggcttgggggtggccccgcgcctccgccgccgacgcagctagctggtttttaaattgctaatctcattaacggcgcgcccgtccgagaggcgaggctggtaaatggatgacggcgagccccaccccgcccgatcgtcgcggccgggaaggcacccgagattgcagagga

SEQ ID NO: 28163 - DNA, 30 bp, Homo sapiens
  chr3:46607744-46607774
  hyper
gaggctgtttacacccgctgagcagcacgg

SEQ ID NO: 28164 - DNA, 229 bp, Homo sapiens
  chr3:46923250-46923479
  hyper
ctcggggctggcagccgagcggcctccccagggaccccgacccggcccgaacgggagcccagtggactgacagcgtcgcggccgggggcgcgcgggggtaccgggcagcctcctcaggggattcgcccatgatgaaagagggctcgcttctcggctcagggtctctattcgccagcgggggccggatgatcaagggaaaaaaaatttaaaagcccgtgctttccagaag

SEQ ID NO: 28165 - DNA, 325 bp, Homo sapiens
  chr3:46923931-46924256
  hyper
ggggccgcggcggcgcgctcggagtaagtcggggctggggacccgcgccgaggggaagtggccggagtcggggaggagcgactccgggcctggccggagcagccaggctgctctgtctcggtgtcagtcggcggcgcctcctcggaacccgggggagtcgccagccccgcgccgctcggctcggtggcttttttggaaacttgcaaatgttttcgtagagagaaaagggggagggagggagcgagggagtgaccgaaacggagcttggggccgctggaagaactgaggccaaggccgggggagctagagacggactgacagacag

SEQ ID NO: 28166 - DNA, 39 bp, Homo sapiens
  chr3:46924989-46925028
  hyper
taccaccaccagggccggcggcggcggctgccccgaggg

SEQ ID NO: 28167 - DNA, 427 bp, Homo sapiens
  chr3:48693274-48693701
  hyper
tgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcag

SEQ ID NO: 28168 - DNA, 31 bp, Homo sapiens; identical to SEQ ID NO: 297
  chr3:48693851-48693882
  hyper

SEQ ID NO: 28169 - DNA, 272 bp, Homo sapiens; identical to SEQ ID NO: 298
  chr3:48693883-48694155
  hyper

SEQ ID NO: 28170 - DNA, 201 bp, Homo sapiens
  chr3:48698810-48699011
  hyper
caccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtc

SEQ ID NO: 28171 - DNA, 597 bp, Homo sapiens
  chr3:48699376-48699973
  hyper
ggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcct

SEQ ID NO: 28172 - DNA, 154 bp, Homo sapiens
  chr3:48700273-48700427
  hyper
ccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgc

SEQ ID NO: 28173 - DNA, 41 bp, Homo sapiens; identical to SEQ ID NO: 6865
  chr3:49851326-49851367
  hyper

SEQ ID NO: 28174 - DNA, 321 bp, Homo sapiens
  chr3:49907032-49907353
  hyper
caaatctgcaaagcccgcgcgctctgaccccgccaggacctcgagccctcgctgcgcccccgcgcactctgcatcccgcacctcgagccagggaaacaatcccccaaggccccacaacctgcgttcgggaagcgcccccagcccggcccgccccgcacctgcagcgccggttggtcacagggaggaagtgatcgcgggctcagcggggcgccgagggctccggggacggcgggcagaatccgctccgagcacgcggggcagacgcggcgccagatgcagccgcttcggctagcgaacctccagcatcgccagccgcttgcc

SEQ ID NO: 28175 - DNA, 108 bp, Homo sapiens
  chr3:49941331-49941439
  hyper
gggcgccgggctgggcgggcggagtcgggccgtgggggcggggccgcgaggaaggcttggcctagcccaggccctccgcccatccgactcttccggcccttggaggcc

SEQ ID NO: 28176 - DNA, 41 bp, Homo sapiens
  chr3:50232113-50232154
  hyper
ggcgcccccgccccacgatcgcggcgcgcaccccccgcacg

SEQ ID NO: 28177 - DNA, 566 bp, Homo sapiens
  chr3:50242954-50243520
  hyper
tggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgccttgttgggggctcgggcggcacaccacaggcttcctgaggcagggcccatggggcaggctggagagggcccgaggggaggacccaagaggggcctggagcagtccctggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggagagaaggaacc

SEQ ID NO: 28178 - DNA, 30 bp, Homo sapiens
  chr3:50375451-50375481
  hyper
ggcctggcggtgaggcggaggagctccagg

SEQ ID NO: 28179 - DNA, 850 bp, Homo sapiens
  chr3:50402170-50403020
  hyper
gcagggagaccaggacgcccagcgacggcgggaaggaggccccgcggccacagtctgaggtatcttcctgcggggagagacaaggagctggtcggcctgggcgggcgcaaggccgcgggatttcgggtccaccgccccctctcctcactgtcgcgttgtagtcgaagcagatgtgcgggcctctccggtatcgcggtctctgcactagctcacactgctccgggccgtccgctgggcatgggtggggagtcaaggaggcggacggcggcggcggcacggagggggcgcgcggggcagagggggagcgggcggcggggagggcgggggcaggatacagtgcgtctccttctgcagcagccggccagcctcgcactggctgcacagcggcttctcggccaccacaaagagaagattggtgttggtcagtctctgcgcgtggaacagcctgcgggcagcccggaaaggcggggcgttgagtttgccccgccctgacccacccccatcctgcggccccgcccccggccgctcggaggccccgccccttccatcctcccgagcgtctcgccccgctcacaggttccgcccttggcctctggtcccgccccactgccagcacctggagcagtttccgcagtcgatgatggcgttgtaggaggcgtttaccgagccgaagtagtactgggtctgtttcatgacgcagctgctctcgcgcgtctcggggctcccctcggcctccgcggggtctgcgagggcccagagcgcctcagctccgcccacagaccctggcaaggtctccggcctccctcagtcgtagaccccaccctccccatggagtcgtcttagctcagat

SEQ ID NO: 28180 - DNA, 147 bp, Homo sapiens
  chr3:50540350-50540497
  hyper
ctgacaagctcggaccgcccccccccaactcctcccggggcttgaagatcttgccttgcctcattcgggggatttgggggaagcaggggcaccgcggggaagtttcgcgacgcagccagagcgccgggaccgcggctgccagccttc

SEQ ID NO: 28181 - DNA, 30 bp, Homo sapiens
  chr3:50567928-50567958
  hyper
ccgcgcatgtgcacccgtccaggtggccct

SEQ ID NO: 28182 - DNA, 124 bp, Homo sapiens
  chr3:50605238-50605362
  hyper
cgcccagaattggaccgttcgcttgtcgctcgggtctggctccacccccagagggagcctagaacctggtcgcagtttttagagactaccctcaccccgtggcctgcgccgaagttgggcggag

SEQ ID NO: 28183 - DNA, 274 bp, Homo sapiens
  chr3:50712086-50712360
  hyper
cactggaagcggaagcgagtggggagtccgggtagagggagtcgcccacctgaccggcttcgccccctccggggtttgctgcagctgagggccccggaccagcgattctagaagccggtccggggccgggcagtccaatagcttctcgcggatttccctccgctggcgcgcagcagcggcgcgtggattcgcgcgcgggctcgggacggcgcgagcccgggcagcgcgagcccctgcgcggcagggagtggcgcatgcgcgggcgtcctgcgag

SEQ ID NO: 28184 - DNA, 105 bp, Homo sapiens
  chr3:51990011-51990116
  hyper
gcctcatcgtgcacccgctgcggccaggctcgcggccgccgcctgtgctcgtgctcaccgccgtgtgggccgcggcgggactgctgggcgcgctctccctgctcg

SEQ ID NO: 28185 - DNA, 52 bp, Homo sapiens
  chr3:51990429-51990481
  hyper
gctgccttatggctgcgcgtgcctggcgcccgcagcgcgggccgcggaagcc

SEQ ID NO: 28186 - DNA, 42 bp, Homo sapiens
  chr3:54154759-54154801
  hyper
tggaaagggctggcacgcttcctcaggcggagggtatgcaca

SEQ ID NO: 28187 - DNA, 269 bp, Homo sapiens; identical to SEQ ID NO: 6870
  chr3:54155224-54155493
  hyper

SEQ ID NO: 28188 - DNA, 554 bp, Homo sapiens
  chr3:54155524-54156078
  hyper
cgagaaggcgcctcctccggcgctcactgcctcctgcccagtgcggtgggcgccggagtggggagcaggcaatcccccaggctcggagaaatcttttatcccgaaatccagggtgtcccccggtcaggatcgactcggcgccgcgttggcttcctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcg

SEQ ID NO: 28189 - DNA, 273 bp, Homo sapiens
  chr3:54156356-54156629
  hyper
gagtttccgagtccccgcccgcgcggcgcctcctgccccgccgccctcccgccgcggcccgccggactccccggggccgccgaggcggggccgggcggctgctgctgctagaggcgcgtctcgctgcctcctcccccgcccgcctccctccccacctctcctccctccctccccacctctcctccctccctctcctctccgccctccccgccccccccacccgctcctttttctgctccccaagtgagccgggcgcgcgagaggcaggcgggg

SEQ ID NO: 28190 - DNA, 420 bp, Homo sapiens
  chr3:54156654-54157074
  hyper
cgcgcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtgtaagtgccggctcctgcgccgcccggggaggggaccttgccgcctgcgacccactgtgcccaagtttgggcgcctgcaggtgcggctgggcaggacccgccgcgggcgtcggcctcgccgctcgcacctgcctttcgggacccgcgtcgggcggcgaggccggggtgggatgctctggcccctgcccgcaggttgccgagtgagatctgga

SEQ ID NO: 28191 - DNA, 488 bp, Homo sapiens
  chr3:54157315-54157803
  hyper
gcattcttaactccgcgacccccctcgggccccctcccgcgctgcgctttgcagttttggtgctggcagtttctaccaagccgctttttctatcttttcttcttttaaaacatgttacatcgcactgctccttcagccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatggaggcagatttagttttccaaacaaacgtgagccccgagcagcatcagttatcggaggactctctgatccccgggtttcttggcattgtactatgcagtgacttcttcctaccaaccggttatttttagat

SEQ ID NO: 28192 - DNA, 209 bp, Homo sapiens
  chr3:55520384-55520593
  hyper
tgcgcgctggccccccgccaggcactcttaaaggcaaaggggcctgaagcgctcgagttactcggccaaggcaagcctacaatctggcctccgtcggtgcgggggggtgtcggggaaggtgtacgccgctctggagtagttggcccctagttcctctgcgggttctctcaaccaaggagtccctttccccatcccgagccccggccaca

SEQ ID NO: 28193 - DNA, 355 bp, Homo sapiens
  chr3:55521035-55521390
  hyper
gaggaagtcgccacccgagcgagcgcagccgaggaatccgagcggagcgaccgggttaagcctggggggacggtcaggagcagggctgcggagtcctccggcgcgcgtccggcgggcgcagtgaaccggagctgaagcgggcactggcgcccgggcctggactcccgagttggggcagagctgggatgcgcccaggaatggagggggcgcggacgcgcgcgagccggcagcaagggcagggcctggtcggggcgcaactagggagccgccggtccggcgagggcgcgcaggcaactgttccacggagaggcgctccgtttccaacgtccatcagcgacggcggtaattagggctt

SEQ ID NO: 28194 - DNA, 204 bp, Homo sapiens
  chr3:55521754-55521958
  hyper
gcatggctttttctccgggagatgccgctgaaaacgcacaagtcgccatctgagctgcaagagtcagccccaaattgtgtcctttcattttagggttcggcaaaaacggggagcaaaataggtgaaagtcgccccggaacttattgctgtgcggtgagctggaggggtgcgactaacccaggggagacgcgggctccccccccc

SEQ ID NO: 28195 - DNA, 695 bp, Homo sapiens
  chr3:55522595-55523290
  hyper
gcaggattttaaagccgtactacgggctggggtgccgggaggcggggtacactctccttgtctccccttctctaagttccccatcccccgcggcatctgctgaaagagagaggtccactccgcagccgctgcctgcctgccgcctggttgtctgcgctccttccagagccaccgaccggcgggaggctgaaccccaacttccccgcctggaccccttggctcgcccgcgtatcccagaccgctcccactggggctccacggagactgctgccttgacatggaacctcatgggggacctcctcattcttacctctgggggaggatacttaagcactggggctgatggatagggttaggcgctcacctcctgcaaagtccccagagtagtagggacttgggtagtgggatgcatgattgctcatctggctccggcccagagcatgaggcgcgatgcgtggtcctgccacggagatcttggcgggtgccctcaggtgaggagattgcgaagtttggcaaaaccgggttccgggcaccggaatttctagacgcttccagatgcccgtggttttggggactccggaggggcagggttggtggatttgtgtccgctacctccagcacgccgagggccccaccccacaaacagtgcctcacactggagcgtaatagttattttccgccgtctgcattctcca

SEQ ID NO: 28196 - DNA, 179 bp, Homo sapiens
  chr3:56502587-56502766
  hyper
gggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccg

SEQ ID NO: 28197 - DNA, 28 bp, Homo sapiens
  chr3:56502800-56502828
  hyper
cgacgccccttcccgggtacccccctcc

SEQ ID NO: 28198 - DNA, 30 bp, Homo sapiens
  chr3:57204154-57204184
  hyper
cccagagacccagggcggcggacaacagaa

SEQ ID NO: 28199 - DNA, 30 bp, Homo sapiens
  chr3:58571373-58571403
  hyper
agagggtagctggcccgtgagcccaagtcc

SEQ ID NO: 28200 - DNA, 91 bp, Homo sapiens
  chr3:61548917-61549008
  hyper
cttttgcaggctgttcgcggctggcagacccagtctcgctcctttctggccaggttaagacaggaacaatactggccgttgataagaataa

SEQ ID NO: 28201 - DNA, 30 bp, Homo sapiens
  chr3:61550498-61550528
  hyper
ctctggggctgcagacgcgccttggcgcga

SEQ ID NO: 28202 - DNA, 74 bp, Homo sapiens
  chr3:62305019-62305093
  hyper
tgcattaattggcctcgttgcaaaaggaaaccgagaggaaggcggcaagacttggcctgcgggtgatgttagcg

SEQ ID NO: 28203 - DNA, 561 bp, Homo sapiens
  chr3:62353488-62354049
  hyper
gtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctccactgaagcgcaggcctcctaaaacccccggagttcgaattcctgctctaccaagcctggtgaccccaggcatgtcacatagttcatctctgcctctatttctccgtctgtagagtggg

SEQ ID NO: 28204 - DNA, 136 bp, Homo sapiens
  chr3:62354249-62354385
  hyper
agggggtgccctttgcgttaagcatctttcccttcaaatagtcgcctcccgccgtggaaatacgcgtggggtcagctcccagccacactcgccccctcaatggggaggttgcgtggaagcgcactcccgggccccg

SEQ ID NO: 28205 - DNA, 348 bp, Homo sapiens
  chr3:62354445-62354793
  hyper
cgcggatattaaaagtgtgtgtggggggaggcccggagcgacgcgccagtaatccgagctcttgattatccagattcggatcaaacggggcggcggcggccggccccctcctgggaatgattagatgattaatgtaatgctgtttgaagggtctctgttttctctcttaatttgggtcattacttagaaagcaagcgtgagatcatttcatcagcgtgctcggcagcagagatagctattcaggaaatgggctaacggagcggtaatcaggacccaggaggcggcggcggcggcggcagcgagctcggggagcccgggcgcgccctccggcggcagggctcagggcac

SEQ ID NO: 28206 - DNA, 157 bp, Homo sapiens
  chr3:62354899-62355056
  hyper
cggtggttgccctccttaggtctcccggagaaggggacgcgcccagaagctctccggtggggtagggcgtagatcgcttaccctcgcggggcgtggcgctttgctcaaggacgctcccaaaagctgctccccaacacccagtcgcttttaacccttt

SEQ ID NO: 28207 - DNA, 920 bp, Homo sapiens
  chr3:62355300-62356220
  hyper
ttgctgagctgacctcgccgcgaggggagagggggaaaaaaacgcgcactaatgattctgtttattgagttatatatgtatatattccgtgttcgcttgtacaggaggatttacatggctgtataaagatggctaggggcgccgcgctcttctggggcgctcacggtgacaggctggggttaaaactggctgccccaggagaagcggaggcctggaattaaatacgtttcggcgcactggatttaaataagtttcctgaatatacaaaggtgggggccacgagtttgctgccagtcatcgaggaaacatttagctttccaaaaatatgctggtttcgataaatagattttagcctctctgctatagtttttttttcttttaattttagaaataagtttatatgtgtgatctgttttcaggtggtacagggagggaaggaagggcaaggcagtagctctcagctctgcactgtcctagtcaggtcctttgcggagggggcagcagggcccacgctgtcgtggagtttgcgcacatgtttctttaagtcaaagtttctgcaaaaccctttgccgcaagtggcgcacgtgaaaggcttcttgtcgttgtgggtgtgcatatggaaggttaggttgtagacctggtggaaggccttgttgcagatggtacatttgtactgcttctcgccgctgtgggtcagcttgtggttcttgtagttccctacaacagatcaagaacaaaaaacgtgggggtatggagtagaatggtggggaggaagaggcgggcgtcccaggggcagcccaggtgcctgctcaaaaaaggcgacgcttggctaggcgggcgcgacctcttcgagtgaagaagttgtcaaacttcgtaagcgtcaagccgggtgctctcccgacaagaccgagactgagtcc

SEQ ID NO: 28208 - DNA, 279 bp, Homo sapiens; identical to SEQ ID NO: 303
  chr3:62356366-62356645
  hyper

SEQ ID NO: 28209 - DNA, 367 bp, Homo sapiens; identical to SEQ ID NO: 304
  chr3:62356792-62357159
  hyper

SEQ ID NO: 28210 - DNA, 176 bp, Homo sapiens; identical to SEQ ID NO: 6889
  chr3:62357495-62357671
  hyper

SEQ ID NO: 28211 - DNA, 382 bp, Homo sapiens
  chr3:62357735-62358117
  hyper
cggagcctcctggcagcttgctgtggcccttgacgcctccgcgctcggcagtcagggccgagttttccttcagtacctgctccagcggcgccggcaagcgctccttatggggatagggagccgggtgggggaacttgtccgcagccaggccggccagcttggcgttctccagcagaaagagcttggggtgagcagccagggcggcgggggcctgcgcattgaggaggccagacgggaagaggtggccgctgaggagctcagacggcgggtacgcggtcgagtccaggtagttgaagtagtagagcgagccgctggccggcagccccacagcctggttgatgacctgcggcttgatgaccctgcccgcgggcagcgcggacgg

SEQ ID NO: 28212 - DNA, 239 bp, Homo sapiens; identical to SEQ ID NO: 6891
  chr3:62358336-62358575
  hyper

SEQ ID NO: 28213 - DNA, 534 bp, Homo sapiens
  chr3:62358858-62359392
  hyper
gcccttccctggacccgggcctctgccacgcgtgctgggagctggacagtgaaggggcaaagttaaagaggaccggagagccacctcgcatttacctctttcccccaccaccaaggagatgcgttccgagccatgcagcgtgtctcttctgtcacattttgatggcaaacatcttcccctccgcgtgagatcactgtcttttacattcagctgacatcacatgaagtcacttgaagtggaatgacatgggcggcggcgcggctcccgtagcggcccctgtgttcccccgcgcctgccggccgccgccaccaccgcccctcaaactttaaaaggaggcaactggcgcccgcgctcctctcgggaaagtgcgagcggtttgcgaatagggaaagagggaagagacgggagggggagggggaggaatcgtgatggttttgccggtggaaggaaagggggggggggacccaaacccaaacctaggcagagttccgtgcgtgattcacaactttggaggcctgcaggtttgggggacgc

SEQ ID NO: 28214 - DNA, 1132 bp, Homo sapiens
  chr3:62359393-62360525
  hyper
gggagggcggagggtcccggacgcggcgcccccaaagggcccctgggtatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtggtcgaggctgagggttcttacggaggggggtggtg

SEQ ID NO: 28215 - DNA, 25 bp, Homo sapiens
  chr3:62362712-62362737
  hyper
ccgggcgcccaggcccgtggccttc

SEQ ID NO: 28216 - DNA, 101 bp, Homo sapiens
  chr3:62362816-62362917
  hyper
cgaggcctcagccccaggcctatttcacttggagcgcctcagcctagagccggacgctttggcttcttcgccatctggccctaggttgggcctcaaactcc

SEQ ID NO: 28217 - DNA, 581 bp, Homo sapiens; identical to SEQ ID NO: 2239
  chr3:62363596-62364177
  hyper

SEQ ID NO: 28218 - DNA, 36 bp, Homo sapiens
  chr3:62364279-62364315
  hyper
cgcccggcccactgcacccggcggctgttttgcagc

SEQ ID NO: 28219 - DNA, 424 bp, Homo sapiens
  chr3:62364702-62365126
  hyper
atacttatatactatcggcaacccatcactagaaatgctatttaattaggaatctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 28220 - DNA, 407 bp, Homo sapiens
  chr3:62860194-62860601
  hyper
tcccattgttcaccccgcccgcctggcgacgtccgggtgctgctccctgggcctcccaggcgcacctaccttctgctgccggcgagccatgtcggtgggctgcttggcattaaaggggtaggcgatgcagcgcatcacgaacacatacagctgcagcctcttcttcctctcctcctcctctttctgcagccgctccaactcttccttctccttctcgctcaccaccgacgggctggggctggagggccggccgccgccagcgcggctgctgggttgcagccccccggccccgccgccgctgctcgcgccgctgcccccgccgccgcctgcacccaccccggctccggcgccggcgccgccgccccccagcccggcgctgccggccgagccctcgctggtacggctgg

SEQ ID NO: 28221 - DNA, 32 bp, Homo sapiens
  chr3:62861293-62861325
  hyper
ccccttttcccctcccgcggacaaaaagttct

SEQ ID NO: 28222 - DNA, 54 bp, Homo sapiens; identical to SEQ ID NO: 6897
  chr3:62861840-62861894
  hyper

SEQ ID NO: 28223 - DNA, 46 bp, Homo sapiens
  chr3:63263792-63263838
  hyper
gacccaaagtttccccggagccagagggcaccgggcgcacggctga

SEQ ID NO: 28224 - DNA, 586 bp, Homo sapiens
  chr3:63264254-63264840
  hyper
gctgggagcagggggcgggggatgccgcggcttgggagaggcgcccccagccccttcctcacgctttgctttctctctctcgcctcattcccccaaagctggcctctgcgggcaccttccgggtgctgaaggagccccttgccttcctgcgagccctggaattggtgagtagcagtgtgtgtgcagggaggggcgccaggcagccagctatcaggtgaggagaggtcggatggggtgctccctgctcagttctgctccaagccggagattcaaccctcaagccggggatttcaatcctgccccctcctaagatgccgttccaaggtggtgaggacaaaatcgaggcaccctgcttggaggcgggagtgtggacgcatttttgcaggggcttagacaagtgtcgtctcacctcaccgcttgcagacgcgcaggggctgtggaaagaaacctcccccttgggagataggggaggggggcgcatggaagggctgccgctgggttctggcccctcacctggaccttcgtggggatgaggggatgggtggagggacccatagttgagcggaggagccgggaagacttggcc

SEQ ID NO: 28225 - DNA, 335 bp, Homo sapiens
  chr3:64430570-64430905
  hyper
cagttccctggagtccgcaagaagcgagcatcgggcgcccgccctagaccgggctggtgctcccggaaagggggcagcagaggacaccccaaaagacggccctaaagtccccgctagagctccaagtggctggacgctggagctttggtgctgggattccgatttgcccggagggagggggctttccagggatcccccagactgtgaccctgagggccacggttcgggtctcactgtcgcccagccggggggtcggaacttaacccctcccgcgccttggagcgctctctcgcgccctggacgcgccccgcccgcggggccggcttacctggggc

SEQ ID NO: 28226 - DNA, 232 bp, Homo sapiens
  chr3:64672181-64672413
  hyper
taagtcttctagaagcgggcgaggaggcggaaggggagaggaggtggcgcgcgcccacttaccattcctgagcagaggctgatgacggccgtgtgctcggagttggtattgacatagcctttgtagaaacagtgcttgagttccgcttcctcttcggaataaaacttggtctgattcaccccgggcgtcccgaggagggtgacagtgaacagtggagcgataaatccggcat

SEQ ID NO: 28227 - DNA, 26 bp, Homo sapiens
  chr3:65535077-65535103
  hyper
gttacctgcgggccccggagcggccc

SEQ ID NO: 28228 - DNA, 254 bp, Homo sapiens
  chr3:68056926-68057180
  hyper
cagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtgg

SEQ ID NO: 28229 - DNA, 167 bp, Homo sapiens
  chr3:68980780-68980947
  hyper
tcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtgggggcggggggacgctgacc

SEQ ID NO: 28230 - DNA, 355 bp, Homo sapiens
  chr3:68980948-68981303
  hyper
gctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggct

SEQ ID NO: 28231 - DNA, 189 bp, Homo sapiens
  chr3:68981626-68981815
  hyper
ctcccgatgtttgcccgcagccgcgcgcgcagtcggtgcgccccgtccagggcggcgcgcagctagcagtgcggagccgagcccagctagcgcgctgaccaggaggggccgggcccgccgcggaacgcgctgattggccgggccgcccggctgctcctgtccctgcctggccccgcggtccacgtgggc

SEQ ID NO: 28232 - DNA, 15 bp, Homo sapiens
  chr3:68981851-68981866
  hyper
cgcgcccccactgcc

SEQ ID NO: 28233 - DNA, 181 bp, Homo sapiens
  chr3:68981867-68982048
  hyper
gcctccaggcgcctctcccgagcgcctcgctgtggccaccactccgcaggtgctgagcaaaaggtattcttcctgaatacctgagagtcgcgttgagctccacataaggaagacggatttagggttcggctctcactcgaaaccattctccacgcaggacccaaagcggtttgcaagcagg

SEQ ID NO: 28234 - DNA, 507 bp, Homo sapiens
  chr3:69435151-69435658
  hyper
cgctctgaacccgggcgtcccggctctcgtacgtgcagccccgaccccagcggcctgcccgcctgggctcccgacgccggcttctgctggcagccggggggtcaagcctgccaccaaactcgtctttcaccgtgcgtcctggccaggctccggcggcatgccctgggattgggtgcccgccagccaacggctgcgactggcacacagaagcccagtgtccacccccgcccgctcgcagcgccgagcaagctgtgctaagctccaccaagctggccctcgatgctcccggggcacgggaagccctggccggcgaggactccccctggcgcttccccagggcgcggggcagggacggaagcggagcaactctttgcaggcagagaggggagctgcatttcagcacacttggcttccacgtcttgcgcgcgcgcgaacacacacacacacagacacacaccccccacaccggacgagtggtctcctaatctgcctcggggaacaccttac

SEQ ID NO: 28235 - DNA, 239 bp, Homo sapiens
  chr3:69590888-69591127
  hyper
aaaagggcagccaaacgaaacccttagtgtcctctgctaactccagggatttcccccccctcttttcgctgccttttagaagtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaag

SEQ ID NO: 28236 - DNA, 105 bp, Homo sapiens
  chr3:69591310-69591415
  hyper
cgccctggcagcacgcttggggagcccggggcggtcgcccacctacctgctccgccacctcctccctgcggcgctccggggctgtagacggctactttattgtct

SEQ ID NO: 28237 - DNA, 199 bp, Homo sapiens
  chr3:69591779-69591978
  hyper
cgccgcctctccgggggctggggcggccgctgccaatgaggctcggctgatgcgctgttccggcccagtcattgtatcgggagggaaggaaggggagggggagagggaggaagggagggggcgccctcggcccccgccgcacggggctgcgggctgggctagccttccccggcagagaaagggcgccggtgccaggagg

SEQ ID NO: 28238 - DNA, 102 bp, Homo sapiens
  chr3:71179297-71179399
  hyper
aaaaagaaggcaacacgaaacaatgtcacagtaagcagagagaggttccaatctacgtttagcctataaaactatcctgacaccacccggctgcttacttag

SEQ ID NO: 28239 - DNA, 187 bp, Homo sapiens
  chr3:71802609-71802796
  hyper
ttacctggggccaaacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggaggggagggggct

SEQ ID NO: 28240 - DNA, 516 bp, Homo sapiens
  chr3:71802856-71803372
  hyper
gcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgc

SEQ ID NO: 28241 - DNA, 130 bp, Homo sapiens; identical to SEQ ID NO: 6910
  chr3:71803654-71803784
  hyper

SEQ ID NO: 28242 - DNA, 183 bp, Homo sapiens
  chr3:71803826-71804009
  hyper
cgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcct

SEQ ID NO: 28243 - DNA, 30 bp, Homo sapiens
  chr3:71833673-71833703
  hyper
ggcacttggggaattcgtcttggtcctttg

SEQ ID NO: 28244 - DNA, 494 bp, Homo sapiens
  chr3:71834231-71834725
  hyper
aggcagttgggggcgcggggcccgggtgcgctgggtggagcgcggagcggcgggcggacgggcgcggcggctcccgcgagcctccgggccgttataaaggctagccccgccgtgactcacgccggcgcccgcccggcagcacacgcggggggcacggcgcgggcacacaccccacgccccacgcgcacacgcgcgcccgcctcggcccggccggctcccagacgagcacgtgctatgcgcggccccccgcgcccccgcctcgggcgccacgcaggcagcgctcccggcggggcgccccgctctgcgccgttccctccgccgtcgcccagccaccgcctttcgcacgcgccggaaccgcttttgtggtctccgagacactcatttgctgtcctggtttccaaagctccacgtgctcagcgccgaaaacttgcaaatcatttgctgtacagatgtttaggggtcgcctactacgtgcggggcgctgtggacacata

SEQ ID NO: 28245 - DNA, 30 bp, Homo sapiens
  chr3:72788104-72788134
  hyper
ggccctgcgcggctccggggagagctgggt

SEQ ID NO: 28246 - DNA, 41 bp, Homo sapiens
  chr3:73674183-73674224
  hyper
gccttggatgcctcccgccagccccccgaaaaagggaggag

SEQ ID NO: 28247 - DNA, 30 bp, Homo sapiens
  chr3:74664104-74664134
  hyper
agggccctcggaacacggggttaaggcagg

SEQ ID NO: 28248 - DNA, 125 bp, Homo sapiens
  chr3:75955872-75955997
  hyper
cgctgcgccaccacccggaggagggagcgcggtagctgcaggcaggggagggagaggaaagaaaaggaaggacggctcccagacagagagtgggagaaaccggggagcagcgggagcagcaggtc

SEQ ID NO: 28249 - DNA, 123 bp, Homo sapiens
  chr3:75956026-75956149
  hyper
cgttattcacacggacgctgcggagcttcccagggctgcttccctgtccccctgggtggaggctgccgtctaaacctgactccaggtgagttcggcaaagaggtgaaccgaggggtctcgaac

SEQ ID NO: 28250 - DNA, 50 bp, Homo sapiens
  chr3:77089150-77089200
  hyper
cctcagaggcggcaccgcgggggtgtctgcagcctcggcctccgcccggc

SEQ ID NO: 28251 - DNA, 60 bp, Homo sapiens
  chr3:77089428-77089488
  hyper
attaaaaaataactccggacgtggagctgctacggagaaggaaaccgggggaaagaaaac

SEQ ID NO: 28252 - DNA, 38 bp, Homo sapiens
  chr3:79068137-79068175
  hyper
tccggaggaagggctcggggtgccgggagtgtgactgg

SEQ ID NO: 28253 - DNA, 391 bp, Homo sapiens
  chr3:79815522-79815913
  hyper
gagtagtgggagctccgactcgaggcaggagtgggatgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaaccgaaggctcatggaagcggggctggcaagat

SEQ ID NO: 28254 - DNA, 185 bp, Homo sapiens
  chr3:79816778-79816963
  hyper
actgcagagtcctctcggcaaccattctgcactccaacaaccactagtgtaaaacccagcgtgtccccttttacaaatcaaaagccagctgtcacttcccttgcaaccatttccgagacttacccttccataagactgttttcagcaatctagaggctccgtagtgcagacgcagccctgcaact

SEQ ID NO: 28255 - DNA, 41 bp, Homo sapiens
  chr3:79817317-79817358
  hyper
ttgtaatgcctgctgcgatgtttaaccgaggggggaggaaa

SEQ ID NO: 28256 - DNA, 570 bp, Homo sapiens
  chr3:85007729-85008299
  hyper
tgcgcagaagaacctcgcacccaggacctggcccaggcaccacgaattccagaacatgctggggacacggctaaccccgccccctcgcggtggcgattggctgaacccttcctgagtgcaaagcgctgattaatgaaggcagttgtctcgcctgcaagttcgggcgagacatctctaaagaggtaagatccgccaggggtgctgaatgggggcttcagttcttcctgcccgaagggtccttgagaagcctgtttgtttttcccggcgcttgtctccacccatccccttctctcattggccagacctggtgggcgggggagtttccattggccggggggcggtgtctgtccctggccggggtgggggcggggcctccgccgctctgagcttgcccttgtgtctggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggc

SEQ ID NO: 28257 - DNA, 173 bp, Homo sapiens
  chr3:85008553-85008726
  hyper
cgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccct

SEQ ID NO: 28258 - DNA, 69 bp, Homo sapiens
  chr3:85009234-85009303
  hyper
tcccccttttcaggtcgccttttcttttccccctcttcccaccatcatcatatccgtgtgtctttaaaa

SEQ ID NO: 28259 - DNA, 96 bp, Homo sapiens
  chr3:85009769-85009865
  hyper
atgtaagaacctctgcgaccgcagcagtggagggaaaccgcacaaaacgctgttattatgcaaatcactgggtttggatgccggatggctaaggaa

SEQ ID NO: 28260 - DNA, 40 bp, Homo sapiens
  chr3:85010590-85010630
  hyper
agcacattctccctgcgtacaccgccgagtcccatttctc

SEQ ID NO: 28261 - DNA, 56 bp, Homo sapiens
  chr3:87040188-87040244
  hyper
accgcgtccggctcccgcgagggctgcggcgcccacggcagcgccagtcacagcca

SEQ ID NO: 28262 - DNA, 57 bp, Homo sapiens
  chr3:87040446-87040503
  hyper
caactcgctttgcagcgggcgggtcaccctgcagggggaccccggggaaggctggct

SEQ ID NO: 28263 - DNA, 161 bp, Homo sapiens
  chr3:87841521-87841682
  hyper
tattttaaaggttttcggaaaagtgattcacgtcatttttcggattccatgaacagataatctcgaaggtatcactcaagtttaagagactggacttttttctcccccgcccttctccacgcatcagtgaaagaggagggaggagacggaggagagaagag

SEQ ID NO: 28264 - DNA, 188 bp, Homo sapiens
  chr3:87842058-87842246
  hyper
gaaggggtgtggggacgtggggagtgggaggctggacagcgcttgctctcggcggaaacgctgggaagccggcgccaagtcctttcccacactactttgatctaacagcgcaggaattcaagaattgccctttcccttttctgcccacaacctctgctccctgggggcgaagttctgtggtgctaggc

SEQ ID NO: 28265 - DNA, 78 bp, Homo sapiens
  chr3:87842247-87842325
  hyper
gagatagtggtcaaggctgggaggaagggaggggtctgacccgggcccaagggcgaggggtggcggtccaagccggcg

SEQ ID NO: 28266 - DNA, 73 bp, Homo sapiens
  chr3:89156550-89156623
  hyper
catttttctcagcaccgcggcctcatcacatcttctgtgtttcctgtcccatgggcgacgcccccactcccac

SEQ ID NO: 28267 - DNA, 186 bp, Homo sapiens
  chr3:96532078-96532264
  hyper
atccctccctcctttcggttcctggcctgatgagccgcctccacctgcgagcggtgcaggcatttttgttgtcgactaaccccctctagcgccgaactggcggcatccgagccgcggctgccaggccgggagaaggctgggcttggccgggctctgcagcgctccgggctccgtccctgccctggg

SEQ ID NO: 28268 - DNA, 33 bp, Homo sapiens
  chr3:96532523-96532556
  hyper
taggagagcgcggcccgacgccaccacgccgtg

SEQ ID NO: 28269 - DNA, 203 bp, Homo sapiens
  chr3:96532784-96532987
  hyper
ctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgt

SEQ ID NO: 28270 - DNA, 540 bp, Homo sapiens
  chr3:96533242-96533782
  hyper
ccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttg

SEQ ID NO: 28271 - DNA, 61 bp, Homo sapiens
  chr3:96534035-96534096
  hyper
ccacaggctaggatccgttgtgtttctaaatgtctttaaacggtagcgtgagcatcagctg

SEQ ID NO: 28272 - DNA, 56 bp, Homo sapiens
  chr3:98451370-98451426
  hyper
cgaaaggtaggggttcggctgtgctcccgcctggtccccaacgcctcaccctccgg

SEQ ID NO: 28273 - DNA, 410 bp, Homo sapiens
  chr3:98451961-98452371
  hyper
ttgggggtggggacacggagcgctgtttgcccctccacatatcctgccagcaccaaggaggtggcgtgcggaggcgtaaagggaccatgggcgctgggacccgcgagccagccggcgtgcgccgcagccaccgccgagagggcacccggggatcctggagccccagtgaagggcgggagggacgcgcagcctcgcgggtaagcccaggagccgtgggggccgagagaatctgctctgggaccctcttttgtcgaatcgccggcgaggttgtgcaattgggaagccaagaggagtgtccagctcctcgttcactattgttttcttgtaaaagggtctgtacgcgaggagggttgaggggtctggaaggttctggtctcttaccgtataaagtttttcgagaaacccttttt

SEQ ID NO: 28274 - DNA, 154 bp, Homo sapiens
  chr3:98452640-98452794
  hyper
agtagcgagggttggcggggacagtggggaggagcaggagggggagaagaggttgctgttgaaaggtaatgtttaaaaacagtgtgtgggggtagggatgaaaataacgtggtgactgctagtgtatcagaaatcacaccgagtctaaagtcgt

SEQ ID NO: 28275 - DNA, 527 bp, Homo sapiens
  chr3:98620068-98620595
  hyper
gcgggagagggggagcgcggcccaggcgggggcggcggccgcggcccggacttggggacactgcgggcagcgcctggctctcaccaccgcccggctcgccatcgcggcggccggcagtctgcctgcatagtgcgggtgcctcggcagccccgcgcgcctctggccgcggcacccgaccaggagacggcggcagcggcgggagaacaagaggcagccctcgcctcaccccgcgccgggacccttccgcccctcaccccgctttcacctactcctccttcgtcccttccctccgctccccgcgccgagaccccaggccggagcgcaggggaggggagggaaggaagcggagtcctcgagccgcggaggacggccgcggcggagctaaggaacgtgcctcccgcgccgcgctcctcaccagggtcgccgctcgccgcgctcacccgcggctccggctagctggcaggcaggcccgcagccagctccctcgcgctccctctcgcgcgcgccggccacgccccctaggcacc

SEQ ID NO: 28276 - DNA, 30 bp, Homo sapiens
  chr3:98621075-98621105
  hyper
ttttgttaaaactgccgccagttgttgcaa

SEQ ID NO: 28277 - DNA, 116 bp, Homo sapiens
  chr3:99356783-99356899
  hyper
gggagagggatggggcgattttcacccgcgggcggtgggacggggctgagggctgggggctgcctggctccaggccatgtcagtgcctccagctccaggtccgggtccaccctgaa

SEQ ID NO: 28278 - DNA, 402 bp, Homo sapiens
  chr3:99594912-99595314
  hyper
tacctgaactgcctgcgccggggccgggcgggggccgggccggggccgctgtagtgccgcgctgcgagccgactgtgcgcgctccgagagtcgcccgaacaatgcgagcggggcgctgagcgcgcccggcctatgggcgttacgtcactgttctgccttataaggcgctccgcgtgtgcggcgctgtcggcgggggcgccggtgaccgcgggaccctcggccgcggcggcggcgcagccacacaccccagctcccgcggatgttccggccgtgtgaacggaccgtggttcccggctcccagcggagggaatgagtggtgggccggtgggccggggcgccggcgccctcctgtcgggctaacaaagtcattgggaggcagggtcgatccgcttgtaacttttt

SEQ ID NO: 28279 - DNA, 30 bp, Homo sapiens
  chr3:107149033-107149063
  hyper
aagaacatgggtttccgcagtcagctccga

SEQ ID NO: 28280 - DNA, 42 bp, Homo sapiens
  chr3:107149805-107149847
  hyper
gtaagaatagatagacgaacgaaggtgcgtgcaagaaaggag

SEQ ID NO: 28281 - DNA, 30 bp, Homo sapiens; identical to SEQ ID NO: 6932
  chr3:110789665-110789695
  hyper

SEQ ID NO: 28282 - DNA, 49 bp, Homo sapiens
  chr3:110791365-110791414
  hyper
aggtgccgggatgcacgtttgccgctttttttcccggtgaaacttgagc

SEQ ID NO: 28283 - DNA, 64 bp, Homo sapiens
  chr3:112052498-112052562
  hyper
tggcaccaaaagctgcggcggagatacagatttccaggctcgctttctccgggagagctcctgc

SEQ ID NO: 28284 - DNA, 56 bp, Homo sapiens
  chr3:112930381-112930437
  hyper
agaaggaattgtttgcgagttcagtcatccaaaaagcttcttccatatggagggac

SEQ ID NO: 28285 - DNA, 15 bp, Homo sapiens
  chr3:112930455-112930470
  hyper
cgtcccctgcgttgt

SEQ ID NO: 28286 - DNA, 228 bp, Homo sapiens
  chr3:112931046-112931274
  hyper
gcggccgaggctgggcgcgccgggcgccgggcgaagaagttggggcgaggcgggcagcgggggtcccgggggctgcagccgctacggggcccaggggcgccgcatctcgttccctgccgcagcggtctggccgggcgatggtggtttcgcctcagcggttcccagaagcttctcgggtggaagaaggatccagccagcctcccaaacttccaccgaaggttgacacca

SEQ ID NO: 28287 - DNA, 44 bp, Homo sapiens
  chr3:112931566-112931610
  hyper
tcgtgtgtgcgtgtacgtgtgtgcgcgcgcgtgtgtgcgtgttc

SEQ ID NO: 28288 - DNA, 16 bp, Homo sapiens
  chr3:115231485-115231501
  hyper
ggggctgcagaagccc

SEQ ID NO: 28289 - DNA, 282 bp, Homo sapiens
  chr3:115231502-115231784
  hyper
ctgcgcgcctcctggtttctatggagaccctgcttgatgtcaatggcggctccggagcgcagggaaacctaagcgtttgtatttaaatgagggaaagtgggggaaggggaagtaaaagaggaagggaacagaagagaggatggtagaggtgagcgggcgggtgttgaactctggggactagaaaaatccagctgcgttactcagtcatctcatgctcgcggagaaatcagaggaagcagcagcgggcagaggggtgtttatttcttgcgtgagaaatatccg

SEQ ID NO: 28290 - DNA, 111 bp, Homo sapiens
  chr3:115377728-115377839
  hyper
ccttcttggcccgctcgccttcagctcccacccgcagcagcaaccgcagcctgcttccggggactgagcagccctgggtcagccaaggttaagcagcgggtggggaagagg

SEQ ID NO: 28291 - DNA, 243 bp, Homo sapiens
  chr3:116163696-116163939
  hyper
agcagaaaagttgcccgaaagccctacctgaggatggctgtgtccccctgcctcacggtgatgttgtccgtgcctcggttaaaatccacgctgcgaacaggcagtcctgtgggaagaaggcagagcaatctcagtaggaccagtggcaactgtttccgatccggctgaactctcctgaccatggtggccacgccgaggtgcgggtccgcggggtgctctggaggggtgcgcgctgctcgcgag

SEQ ID NO: 28292 - DNA, 30 bp, Homo sapiens
  chr3:116583135-116583165
  hyper
tgcatggtcagcagacgcacaaacacgctg

SEQ ID NO: 28293 - DNA, 95 bp, Homo sapiens
  chr3:117715557-117715652
  hyper
tcagcaccggggacacggggatagcgaacaccaccgcggctcttggagtttacagaggagcaaccccagctccgtcgccaccacctcgcgcaaaa

SEQ ID NO: 28294 - DNA, 352 bp, Homo sapiens
  chr3:117715772-117716124
  hyper
acacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcg

SEQ ID NO: 28295 - DNA, 99 bp, Homo sapiens; identical to SEQ ID NO: 2246
  chr3:117716213-117716312
  hyper

SEQ ID NO: 28296 - DNA, 394 bp, Homo sapiens
  chr3:117716313-117716707
  hyper
ctcgtagcccgtgcctggtgtaaacacaccgagcccccttgtccctcgagctctcccgctttcctgcttcctatcctcctctccctcactcccctgcagcttcaactaaatgcgatgtacttaaacaagcagcgccttataggaccgcgaaccgagccgaaagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttggaacatgctagccgcacatcttcatca

SEQ ID NO: 28297 - DNA, 30 bp, Homo sapiens
  chr3:119298886-119298916
  hyper
tacgagaatgtgacccgtgaaagttcagag

SEQ ID NO: 28298 - DNA, 59 bp, Homo sapiens
  chr3:119421863-119421922
  hyper
cggccgttaccatagcgacgtgcacgcagtagccaggcctgacccgctggtcccttgct

SEQ ID NO: 28299 - DNA, 206 bp, Homo sapiens
  chr3:120003742-120003948
  hyper
tgagagtttctttaccggttccaaacaaactgcccagattctggaaagggagagaaagcccctccccctttccactttcacttaataattaagtgtttgaagttttgtggatccttaaggtcgctgtgctcacctcatcagcgtcggaccgccgagaagcgccaagcccgctgctatgtgcaggacgcccacggtcccccggcgtc

SEQ ID NO: 28300 - DNA, 50 bp, Homo sapiens
  chr3:120004161-120004211
  hyper
tcgaccctgctctcccgcgagggccgggagggctccgggaccttgcagac

SEQ ID NO: 28301 - DNA, 319 bp, Homo sapiens
  chr3:120169658-120169977
  hyper
cgggtcccgcaggctcgctccggccgcccaagcacccccggccgcccgaagagtccggcctccgcgccgtgcgccctgcgctcaccgtggtctggtccaggtctcctgggggcgcggggcaggacggcggcagcgagctgtaagcggaggtgggagctccgccgatcgccagcctcggaggaaatgcgacctcccctcgccgccccttaagacctctccttccccgcctgcctgcccccccagctcctccccattctcctcccccttctgctgcagcggcccccgcggctcccgctccccctccttccgacccctgctc

SEQ ID NO: 28302 - DNA, 144 bp, Homo sapiens
  chr3:120170066-120170210
  hyper
cggaggcagagggggtgtcccgtgggtccctgccacaaaggggtagggggaagggaaaccccaccccgggaggggctgctggctggcggcggcccgggcgggctgcggcggtggccaggtgggcggtgccgtggggggcccggg

SEQ ID NO: 28303 - DNA, 30 bp, Homo sapiens
  chr3:120627043-120627073
  hyper
tggagcctgactgctcggttaggacctcgg

SEQ ID NO: 28304 - DNA, 682 bp, Homo sapiens
  chr3:120627329-120628011
  hyper
gagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtc

SEQ ID NO: 28305 - DNA, 30 bp, Homo sapiens
  chr3:120628354-120628384
  hyper
caaggtctaattgcacgtgttaagtcacct

SEQ ID NO: 28306 - DNA, 223 bp, Homo sapiens
  chr3:121902727-121902950
  hyper
aaattgtgccaccctcggcacagagaacgttggtggcgtcgtaagcgccctaagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaaga

SEQ ID NO: 28307 - DNA, 229 bp, Homo sapiens; identical to SEQ ID NO: 309
  chr3:121902990-121903219
  hyper

SEQ ID NO: 28308 - DNA, 335 bp, Homo sapiens
  chr3:121903323-121903658
  hyper
cggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcctgctgttggta

SEQ ID NO: 28309 - DNA, 45 bp, Homo sapiens; identical to SEQ ID NO: 6949
  chr3:122296693-122296738
  hyper

SEQ ID NO: 28310 - DNA, 33 bp, Homo sapiens
  chr3:122745310-122745343
  hyper
aggagggggccagaacggcgctgcaggtgatcc

SEQ ID NO: 28311 - DNA, 47 bp, Homo sapiens
  chr3:122745601-122745648
  hyper
atgagaaacataaatcgggaaatcgccgctcgcgtccctgcttccag

SEQ ID NO: 28312 - DNA, 224 bp, Homo sapiens
  chr3:122745957-122746181
  hyper
tccctcagcctcactcgtccgtctccttctccaggcctgggtcccgggtccccatcgccgctgcagcccagatgcgccgaccacagccctggcagggcccagtgcaacccggacccaagctggctggcggcgggaacgcagcagcgatgagggctctcaagccgaggtggcagcgggaggcgcggaagccaggggaccccctgtcctcccgcccgcagcctcac

SEQ ID NO: 28313 - DNA, 32 bp, Homo sapiens
  chr3:123166974-123167006
  hyper
ccgagccgccgccgccgcccgcagggggcgcc

SEQ ID NO: 28314 - DNA, 687 bp, Homo sapiens
  chr3:123167300-123167987
  hyper
gcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttgcgggcggtgcctcctcgggccggcagtgcccgggcgcggcgctcgctgattccgcctaagcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggagg

SEQ ID NO: 28315 - DNA, 27 bp, Homo sapiens
  chr3:123168541-123168568
  hyper
gcgccatgcacgcttcgggccctgcgc

SEQ ID NO: 28316 - DNA, 241 bp, Homo sapiens
  chr3:123168581-123168822
  hyper
cgcgccgctcctcccttctcgcccgctcgccgccgccggagagccctccgcatcccctcctcccgctgcctccccgccccccgcgccgcccgggcctcggctcacagccgcgcgaggccgcctccgcccccggcctggccatggccccagcctcggcgccccgcgggcatcctcaggcctggccgcgggcaccccagttccccttcctcacctaaaattctcgctgcgcccctccctccct

SEQ ID NO: 28317 - DNA, 330 bp, Homo sapiens
  chr3:123602641-123602971
  hyper
cccgccctaccttcccggaatcacatttgggctggaaggaccttcacgtggcacccccttcccagaggccgtcaccgagtcctctagcgagggtctgggagctgggagaagggtccgcttctcctccgcccctcaaatcaaaggcacccccttcggatgattcctagaaaggcaatcgcatcagtgtccccaagcacttcatctccccaaaagaaaactcgtgcagcctggcgtcactggggtcgtctccttacgcccctgactcctcgccgcaccccggggcccctctccattaggggagtcgggaggcacagacggtgggggtcccag

SEQ ID NO: 28318 - DNA, 327 bp, Homo sapiens
  chr3:123603226-123603553
  hyper
cgggggtgagcgaaccggcgagagagagagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgcacttatcctgcaccgccccagttaactcctcgcaggcggcggtcagcgggctggtactgtc

SEQ ID NO: 28319 - DNA, 69 bp, Homo sapiens
  chr3:123752431-123752500
  hyper
agccccgccgcccaacgcccgccctcgaagctccgcggccgccagctctgcggccgcagcagctgcgcc

SEQ ID NO: 28320 - DNA, 50 bp, Homo sapiens
  chr3:123752973-123753023
  hyper
cactttgcagcgcgccgctccggctaccggcgtcccggcccctcccttgg

SEQ ID NO: 28321 - DNA, 139 bp, Homo sapiens
  chr3:124606603-124606742
  hyper
gggtcgtgccggtaccgcctcatcctcccaaagcctcactgccggcggcctgagatgggacgtagacgcccgcgcgtggaaccgcaaagcgacttctggatgagcaagggagggcgtggtggggcgtggaggcacaagt

SEQ ID NO: 28322 - DNA, 51 bp, Homo sapiens
  chr3:124773881-124773932
  hyper
ccatgcaaccccaaccgcgttcctttgcttttaagtcgaaccagtagagcg

SEQ ID NO: 28323 - DNA, 607 bp, Homo sapiens
  chr3:125898649-125899256
  hyper
ctaggcaagtgcccgcggggcctgagctctcgatagcggggccccaggagccacgttgtggggtctgctatccggcctccctctgcacgcgcgaccgtccacttgagcgcagtggctggagctgggactccagcgcagcccctgagcgctcacgtcgacccctccaatcacaagaggccctcgtgccaggcccccagatttggccaatcagggaagacctttccctgtcacagaatggggtcgaggggcccaggaaacaggtagtccccagtcacaaatcatcgcgtcgccttcgctggtccctttctcttatcgagcctcagttttctcttccataagccgggccagcagtgcccaccccacaggttggcgccagctccgtaagggccctaccaccgcggccggccagatcctcggcgggccagtcctggcgctgcggtcatttagcctgatgacccctggccaggttcagcctcaattgctccaaagaactccggacccgtaccccgagcccggcgtcccagcggcgaagttgatgggccccgcaggagcccttgcggtgagaaccgagtcctggagcccctggagcccccggagcccccggagc

SEQ ID NO: 28324 - DNA, 68 bp, Homo sapiens
  chr3:125899498-125899566
  hyper
tcagccgagtgggggcggcgctcaccggtggtgggactatggcgggagcgcagcgcaccctctccggg

SEQ ID NO: 28325 - DNA, 32 bp, Homo sapiens
  chr3:125931984-125932016
  hyper
gccttctcgggcctccgcgtccgccctgcgcc

SEQ ID NO: 28326 - DNA, 296 bp, Homo sapiens
  chr3:125932252-125932548
  hyper
cttttaactttttggcgtggagtgcgcgtcctgacgtgccccctgagctacagcttactgagctttactggcttcgccggacagccgtccccaggtggagagacagcgcgtcgcgcgctgcccgggccccgcagggcctggcgcctggggcccttgcgccgctttggggcgaggggatcacaccgcgggctcccggagcttagcgtcttccacgcggcgctgtgtgtcatccacgcagtgtgctctcgctgccgtgttcaggtcactgcgagggtgagccccgctttatctacccc

SEQ ID NO: 28327 - DNA, 178 bp, Homo sapiens
  chr3:125986552-125986730
  hyper
gctccatttaccctccgcggagggcgctgtgcggcggcacttaagcggcagcttcctctctcccaggcggcctttgtggctgtggccgggacagggaaaagctgcccaggccaagagggcgggggcgtcaggggcagccagcgccgcctttgcgcaactgaagcggatgaagccgcct

SEQ ID NO: 28328 - DNA, 60 bp, Homo sapiens
  chr3:126075183-126075243
  hyper
gtcacctccgagggccgtgggagaaaacagcccctctgtgccctccgtgagaggggggtt

SEQ ID NO: 28329 - DNA, 125 bp, Homo sapiens
  chr3:126113532-126113657
  hyper
tcagaggaagaaacccgcgttcaccaggcccaggcctgggccaggcgctgtcctggcggcgtcagggaggacatcgtgcccagagctcggacccagcagcccggccccgcgccctccctgtcccg

SEQ ID NO: 28330 - DNA, 116 bp, Homo sapiens
  chr3:126113794-126113910
  hyper
cggagcgagccggggcagtcggggtcggtgggtgcgctcgcggtccggggagagggggcgcgcggggtccgtgagggcgcgtgggggcggcggcaggggtgcgaaaccagggcccg

SEQ ID NO: 28331 - DNA, 66 bp, Homo sapiens
  chr3:126242937-126243003
  hyper
gtgagggtgggggcacgaaaagaggagcgggcttgcggccccaccgtgtcccgcctcctcagtccc

SEQ ID NO: 28332 - DNA, 38 bp, Homo sapiens
  chr3:126243423-126243461
  hyper
cagaaaggctctagacgcccccgcgagcaaaggctctt

SEQ ID NO: 28333 - DNA, 46 bp, Homo sapiens
  chr3:126373487-126373533
  hyper
cccgggacccgcgggcgccccggcccggacccgccctgccccgggt

SEQ ID NO: 28334 - DNA, 72 bp, Homo sapiens
  chr3:126373752-126373824
  hyper
ccctcggacatggcccgagcggcggttgggggcatcgcccgcctttcccggcccgggcgactgcggcggcga

SEQ ID NO: 28335 - DNA, 80 bp, Homo sapiens
  chr3:126854425-126854505
  hyper
tatcgcgcggacggtcgctcttcttcacgtaattggagaaacttttcccattacccgctgtctctgcgaggcggctctcc

SEQ ID NO: 28336 - DNA, 291 bp, Homo sapiens
  chr3:126854536-126854827
  hyper
cgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctccaggccatcgcagcccccggccctgccacgcaccggcgcagcccctgcactcgggcggccctgcctcggcgggatgagttcgtccgaggtgcatacaagatgagaaacagagcgccgggttgcagtgcca

SEQ ID NO: 28337 - DNA, 38 bp, Homo sapiens
  chr3:127176205-127176243
  hyper
ccgggctctggaagccgagctgccgaggcgtaagctgg

SEQ ID NO: 28338 - DNA, 251 bp, Homo sapiens
  chr3:127347860-127348111
  hyper
ggacgggcggagggacggccgcccgcgcgtccgcttcgtctccgcgggggcgcgcccgcggcacgcggccgggcggggccgggcgtgagtgacggccatgcggaccaatggggcgggcgcgcgccgccgccgccgcccgcgcggcccctgacgcgggcccgggcgccgcgccgctgcggctgcaggcggcgacggctacaccatgggccggctgctgcgggccgcccggctgccgccgctgctttcgccgc

SEQ ID NO: 28339 - DNA, 39 bp, Homo sapiens
  chr3:127633909-127633948
  hyper
agtgtaaaagactaacgggaacaccggcatttttcaaag

SEQ ID NO: 28340 - DNA, 30 bp, Homo sapiens
  chr3:127634282-127634312
  hyper
gacctctatttatatcgcccagccagcaca

SEQ ID NO: 28341 - DNA, 428 bp, Homo sapiens
  chr3:127794432-127794860
  hyper
gaagtcgcgcactttcgtcgcgacttcccaagtcgtgctgggtgtgacttggaatctcggatccctgggctaggcctggccacgcccccatggggggaggggcagcgcggcgggggcggagcctgggcccgaaacgccacgggcgcgactctgtgcgcgtccgcccacacgggggcgctgtgtcctcgcaagctcccgcggggtgcctcgcggccctggaacgctgtggttttcgaggggaaaagtgagagtggctggtcctgcctccgctgccgcttggccctgagatccccactgcccacgggataggccccagtccacccagccggggccccccccttcccctcgtctcgctctccttggcagttcggacttcgggtcagtcccacactcgcgcccggctgtccctgctgcgctcctgtcactgg

SEQ ID NO: 28342 - DNA, 15 bp, Homo sapiens
  chr3:127795148-127795163
  hyper
cccaacagcatgacc

SEQ ID NO: 28343 - DNA, 128 bp, Homo sapiens
  chr3:128202349-128202477
  hyper
cggggagggctgagccacaaggaaaagtacttcatggccctatttttaaaaaagagctaagcagaggccagaggacaggagtccggcccgtggacactcaacttcggggatcccggagcagagtgggg

SEQ ID NO: 28344 - DNA, 283 bp, Homo sapiens
  chr3:128205402-128205685
  hyper
tagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagc

SEQ ID NO: 28345 - DNA, 98 bp, Homo sapiens
  chr3:128206332-128206430
  hyper
cacacccacacttggcgccagatacacatactgatctcaaccccgaaaacatgcacacgcagccccctgagcgcagtactaagcggcacaatcaggac

SEQ ID NO: 28346 - DNA, 200 bp, Homo sapiens
  chr3:128207015-128207215
  hyper
ctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctag

SEQ ID NO: 28347 - DNA, 120 bp, Homo sapiens
  chr3:128207713-128207833
  hyper
ggggagacggaggctcgaagggagccccgggccgaggagggaggtccaggacaaaggcattttgggggacctagacaggtgccgagtactggggggactcaacagcgtcctccagccctc

SEQ ID NO: 28348 - DNA, 552 bp, Homo sapiens
  chr3:128208053-128208605
  hyper
aactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaac

SEQ ID NO: 28349 - DNA, 397 bp, Homo sapiens
  chr3:128208949-128209346
  hyper
taccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgac

SEQ ID NO: 28350 - DNA, 220 bp, Homo sapiens; identical to SEQ ID NO: 2255
  chr3:128273832-128274052
  hyper

SEQ ID NO: 28351 - DNA, 347 bp, Homo sapiens; identical to SEQ ID NO: 2256
  chr3:128274308-128274655
  hyper

SEQ ID NO: 28352 - DNA, 41 bp, Homo sapiens
  chr3:128326970-128327011
  hyper
cgcggggtaacagcccgttccggagccggtcatcaggcgcc

SEQ ID NO: 28353 - DNA, 37 bp, Homo sapiens
  chr3:128327483-128327520
  hyper
gactttgttcagggccgagaaccggaggaggaggcca

SEQ ID NO: 28354 - DNA, 466 bp, Homo sapiens
  chr3:128417155-128417621
  hyper
gcactcctgcgtgagcgacttccattcgggacggctcagccgcccgctaccgcagccttcccgcctgggtctcccacaggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacccggggttctggccccctcctcccccaggacctcagcgcggcaccccacccaccaccccccgcccccaacccaggccagctgtctctttttcctcaggggtcgggctcccagcctctgccctccacaaccacccgcctgcctcaccagggcccagcctggcccctgggagcggccacagcgccga

SEQ ID NO: 28355 - DNA, 82 bp, Homo sapiens
  chr3:128720061-128720143
  hyper
tcggagcgaactctccgcgccaggcgggcggggcggagggaggagggagttgagagtggacggccgggagtgggaggaaaag

SEQ ID NO: 28356 - DNA, 184 bp, Homo sapiens; identical to SEQ ID NO: 2257
  chr3:128720163-128720347
  hyper

SEQ ID NO: 28357 - DNA, 116 bp, Homo sapiens; identical to SEQ ID NO: 2258
  chr3:128720418-128720534
  hyper

SEQ ID NO: 28358 - DNA, 318 bp, Homo sapiens
  chr3:128720566-128720884
  hyper
cgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgcc

SEQ ID NO: 28359 - DNA, 430 bp, Homo sapiens; identical to SEQ ID NO: 2261
  chr3:128720885-128721315
  hyper

SEQ ID NO: 28360 - DNA, 118 bp, Homo sapiens
  chr3:128764489-128764607
  hyper
aactacaatttgctccggcggaagtgaggagcaggcctgggccctaagggccgggcctcgaccccccgcaggtccccgcggtcccggtcccccgcccgggacatctgatggaccgagc

SEQ ID NO: 28361 - DNA, 8 bp, Homo sapiens
  chr3:128764836-128764844
  hyper
cggggtcc

SEQ ID NO: 28362 - DNA, 92 bp, Homo sapiens
  chr3:129324567-129324659
  hyper
cgcctcgctgttgagcgccaggtacgcgtaggactgtgcacccggcggcgggtcggacgggtgcaggaaggcgctcacgaagcccagcttgt

SEQ ID NO: 28363 - DNA, 30 bp, Homo sapiens
  chr3:129324893-129324923
  hyper
gcagaactagccccacggtggacgcgttcg

SEQ ID NO: 28364 - DNA, 30 bp, Homo sapiens
  chr3:129346534-129346564
  hyper
cagtggctggaggggcgtgagagtgggaga

SEQ ID NO: 28365 - DNA, 129 bp, Homo sapiens
  chr3:129693071-129693200
  hyper
ccccattctctctctctctctctttctctctctctctctcttgctctactctcgcccgtctgcgttctacattggttctgcggccgtgtccctttcgtgtgtgtctgccctgtgtttctccgtcgtctc

SEQ ID NO: 28366 - DNA, 195 bp, Homo sapiens; identical to SEQ ID NO: 312
  chr3:129693304-129693499
  hyper

SEQ ID NO: 28367 - DNA, 345 bp, Homo sapiens
  chr3:129693954-129694299
  hyper
ggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagttagaacgtggcgatggggacctttgggggagtcttggcggggacgcaaccgttagcgtcgcggctgtgcctggcgctgcaatctcaat

SEQ ID NO: 28368 - DNA, 159 bp, Homo sapiens; identical to SEQ ID NO: 6976
  chr3:130064451-130064610
  hyper

SEQ ID NO: 28369 - DNA, 47 bp, Homo sapiens
  chr3:130064780-130064827
  hyper
cggtttccagggtccggagtgtcccctgaccccgggaaagctgggta

SEQ ID NO: 28370 - DNA, 45 bp, Homo sapiens
  chr3:130235542-130235587
  hyper
tggaccttaatctcacggtcttcgttcccacggaaaagggaggag

SEQ ID NO: 28371 - DNA, 271 bp, Homo sapiens
  chr3:130235793-130236064
  hyper
ctttcttttctcccacggtcgggaccttagggtaggagtttcaagaggggagaagccggtggagcagtaacagccttcataatgtctccagtcccgcttccgtcacctccctaaggctgcgcccccctcctgggggacgtgcgctgggcccggggccgccggggcggggaagggtcgggcccggggcggggagaagcgtttatatgtcggcgaggggcgtgggagctgccacccgcttgcctgcgggacaccggagtcaagaggctgccca

SEQ ID NO: 28372 - DNA, 15 bp, Homo sapiens
  chr3:130236173-130236188
  hyper
cgtccagaggaaatc

SEQ ID NO: 28373 - DNA, 180 bp, Homo sapiens
  chr3:131752606-131752786
  hyper
atggtaatcagcactcgcttgacttggcgtggaccacctcctaattatctccattggattcagccctaacagttctcgtgtgtctgtgataccacgcggggtcgtgatctccttactcagctgtggcttggtttcagtggtccctccagtcccgtcccctgtccccgtccccctttcctt

SEQ ID NO: 28374 - DNA, 86 bp, Homo sapiens
  chr3:131753975-131754061
  hyper
cccaggccttggcggcggcgctctccgtggtcctgccgcgcccgcagtctgggctttctgctcagctttgtcgctcaactgagctc

SEQ ID NO: 28375 - DNA, 463 bp, Homo sapiens
  chr3:132757017-132757480
  hyper
aacccccagagacatcggagcgggcgctgccgagggcaatttggtgattggctggtctcaccacgtgaccggcgctgagccttccgtgcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtga

SEQ ID NO: 28376 - DNA, 372 bp, Homo sapiens
  chr3:132757536-132757908
  hyper
cgcctggagggttgctggcatgaaccccctccccaggtggagggtgcgggtgatggggcgcgggcgtcaggagcgctggacctgggctggggccgaggaggaggtggctttaatgcagggggacctgtcacatggggaaacgaagaagaagaaatgtagtgtcactttggccagcccgagggactcgaactaatcctgcggccgcgagcggagccgaattcctagcgcagctgtgcgaagagccctcctgcctaggtgccggcggcctcgccggggacggagcctccgtgctgcccgggaggttgctctgccggctggacctggcggttttcaccccagagttgcagcgaaattgaacgctttgagcctgct

SEQ ID NO: 28377 - DNA, 51 bp, Homo sapiens
  chr3:133613719-133613770
  hyper
ctggacgtgccctttcgcatggttcccagcagggtccgcagggaacacccc

SEQ ID NO: 28378 - DNA, 62 bp, Homo sapiens
  chr3:133615071-133615133
  hyper
cgaggcccgtcagggcggtcagacctagggaaacctggcgtacttggcgcagatggggctcg

SEQ ID NO: 28379 - DNA, 130 bp, Homo sapiens
  chr3:133646291-133646421
  hyper
gagaggaagttttctcgaggctgtgtcccgtgagcaggcgccggtgggctcagccgccgggccctccgagtaggggaaggcgtgcgtgcgtgcgtgcggtgggcgcggggagccccgcaggcccgagggc

SEQ ID NO: 28380 - DNA, 34 bp, Homo sapiens
  chr3:133748071-133748105
  hyper
caggacgagggggctcggacgagacacagtctgt

SEQ ID NO: 28381 - DNA, 127 bp, Homo sapiens
  chr3:134032405-134032532
  hyper
cctctccttggagaacgccggcccgctctgtgccaccctctccccaagcccccggtacgtccgtctgtccgggtggaggacagggccccgagggccgcgaccaggagggactcgcaggaggcaccgg

SEQ ID NO: 28382 - DNA, 554 bp, Homo sapiens
  chr3:134125220-134125774
  hyper
catctgcatttgaaacgggctcccggggctcttcaaggaggcgagcggccgctgcagggctcctctaggccagattacatcccagaacgcccaggcaggacgctccggctcagattgtgaaccctgggactctgcgtccaggaggggcccctaaaccctgcgctaaaagccagaggtccggggagcaggcggatgccctcagacttggctattttgcttaaggtcacctccaaacgggactggaataaaccctccttgtttgcctctcgccaggcctaagccccgggtccccttgggtgtcgtccaggacgccaggcgcggctgcttacaatggctctcagacgacagatggcgggcaggaagggagggggcgccgggcaggtgcgcgggggagacgcgccgcggcagcgccggacgccaggctgcagggtgaatagatttgcagcccgccggctgcaggcggcggccgccgagccctgcaaacaataagtgaattctccgaagcgactgaaaccccccgggctgggccacgcgccagccggggagggcggacc

SEQ ID NO: 28383 - DNA, 44 bp, Homo sapiens
  chr3:134369475-134369519
  hyper
gttgccacgggactgcgcgttgccacgggacgccggtgccactg

SEQ ID NO: 28384 - DNA, 59 bp, Homo sapiens
  chr3:134369552-134369611
  hyper
cgggttcgctgacctcgttcgggggagcaatgggcgccccccggcgggcaggcccttgt

SEQ ID NO: 28385 - DNA, 100 bp, Homo sapiens
  chr3:134369983-134370083
  hyper
gcccgcctgggagggcgctaccctaatgaagcggctctaagtcacctttgaaaggaaatccccgggcccaagccttgacctgcaccggggccatagtcag

SEQ ID NO: 28386 - DNA, 524 bp, Homo sapiens
  chr3:134514264-134514788
  hyper
gcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaaggtaacgtaccctccacggagcaagttggctgctggtgccggccgccttgggactgctgtgctccgcggttcgcggggttcctctggctgctttgcggtgcaggcatcccgggacccgagggcaaggaggtttgggagcctcggccgctgccgagcgcggggcttgggcggcacccaccagagcgcccccggctggctcttagcgcccgaaactggctcgcgagtcccccggcttcctcgccccggcactccctggta

SEQ ID NO: 28387 - DNA, 1194 bp, Homo sapiens
  chr3:134515127-134516321
  hyper
accagtctggtggtccgggcgcctgcgggactgcaggtttccagggtcagtcggggagaggtggaaacccttttcgcctcttgagccttggaacaggagtgggctggggtgagtggtcggtcctacctaaagtctcccagcctctccaccaccccggagaggatactcggcggccgggagtcgtcgggcagcgtcactctctgccagctcagacttggcggtgcctccggcttggtggctgggaaagcgcgctccaaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctgggaacacagctccgcgggagagcggagttggagttgtcgggagaaaaccaactctaggggtgatgcgctgccgcagtccggctagcagccccactttccggtgtcctgctccggatggaactcctctgggggactccaagccggggaggagcagctcttggcgaccgcgcagcgttcccatctgggagctcgctccgcttgttactcgttcctcgcgaaactgtgaccggttgcccagtggaaactcccccaaacacgatggtttggtgccccccgccattccggaaagctctgcccttctggaagtgaagctggaggggcattccgggccctgaggcgcggctaagattcccttcccttttggcgaagaccaccgcatcccacgtttgttctggtggcggcgtgggggtgcggcgattaatgcctagaaagctctcgcttgcttttccgaaggtggctttttgtctgccctcagtctcctgcttccctcagggactgctgggctttgtagggaggggagcaaggaggggtttgctttttggaacgtgcaggagaagactggagccgtgtggagtgccgtcaacaccctggcgcagggatgcctgggtttgacttattgagagacacgtgtgggagcagttgaaattggaaattcaaggggatatatacccccaaaccgggcaggaaagccagggtgagcgcatttgcaagggcaattccagactggacttgcagcattggggtggcgtcatgcaggtccgaggctcggtccggcccgcggctctttgcgc

SEQ ID NO: 28388 - DNA, 548 bp, Homo sapiens
  chr3:136537631-136538179
  hyper
gaaggaatagacttgcgacttttaagcgcaaacaatgggtggaaatggacagaaactgcctccgtgcccacttgcagcggactacgtagccctggcagacaggcaattgcttcaaacaagcgccctccaagggcgtaagctagaggggcccgggcgggcgctttcccgtggaccctcccacctcgcgggtagaggaagtccttcagttcaggcacaaccctgagcgtcccccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccaca

SEQ ID NO: 28389 - DNA, 103 bp, Homo sapiens
  chr3:136538621-136538724
  hyper
attttcgtggtacatcgacggtttgtagacatcttttcccaagggaagacgagggcaagggttagtggaggaagggcctcgtcacggccgagagtggcggaga

SEQ ID NO: 28390 - DNA, 188 bp, Homo sapiens
  chr3:136751561-136751749
  hyper
gcagggcactttcttcgggaaggactcctgggagctcaggagtttgcatacgaagccgagggagcgaggggcttctgataatgatattcagcgtcgaacagagtcgctcatatgcagagccggagtctctcccagctttgatatatgagattattatggagagtaatgcaggccgagtgatgcttgct

SEQ ID NO: 28391 - DNA, 172 bp, Homo sapiens
  chr3:137479130-137479302
  hyper
cttgggggggtgggccggattaactgtcttgtctctaaacacctgggtgcgctggcgctcactctcagctgcgagctgaagcccacgctgctctcaggcttcccgcaacaggcacctgcgacttcgctcaccaaaatcttccagtggccacagtgagcgggcaggactggtg

SEQ ID NO: 28392 - DNA, 231 bp, Homo sapiens
  chr3:137479510-137479741
  hyper
cagagaggagggggccggagggtggggcggagccttgtggcaaggcaggtgggtgcaggcctctggggccccagactgccgcgtctggctctaccaggctgtgtctcgggccccgtgcctgcagctgcaaggcggggaaagacctatcgggaagatccacctcggcctgggcagaaggaaactttactgagagtcttctctgagtttggaattatgcggaaattgaaccca

SEQ ID NO: 28393 - DNA, 742 bp, Homo sapiens
  chr3:137479943-137480685
  hyper
tacgcgcaggagctgcgtgaaaggagaggcccagagccagaaaagaggaaggcgcatcctggacgctctgcgccctggagggagacgaaaggcccggagagaagcagattaggtcggtgcccttagaggcctcttccttcacttccgggaaacagcggcggttccctgacaaaatccctgttgctcgggggttcggacgccttgctaaggctggcacgcagcggaccttgagtagctgcgctgtgtactgaacgtgtgcacagcttctccaggcaaatgtgcaagcggaaagacctcatccaagcgttatctccagccctggaggagaatgaactggtagcctggggccaaacttcaggccgtggacaaagcaggaggagtatttaggcaacctctgtcctaatgcttgttctggttgtgaccgaagttgctgactctcctcaggggtcacgtctccaggacgtgctacccggtggtttagacccgtcagggaggcacagcgtgaagggacagcgcagcgcagtagaggcacctgctggagacagcaccaggccagaccccaggatcacgggaactcctgctcccgccacagctctaaagagtgttgaataaaccggtggtcaccggtactgcgtaaggggtgtgcgtggctttgcagttcgcctaggagacaagctgatgcacggcctggaaggtgcagccctcatccctgcgttccctccccgcgcggagttcctgtctc

SEQ ID NO: 28394 - DNA, 177 bp, Homo sapiens
  chr3:137481170-137481347
  hyper
attccttcccaaagccgtcgggatcgcccagtagaattagaattgggtgattcctgaatctcctatccctggctggctctgaatatagcgcaccgctggtcagacctgagtaggggttgccagcgacgctcggaaaccctttccagactgggctgaaaagtgcgtttgcttcctgag

SEQ ID NO: 28395 - DNA, 99 bp, Homo sapiens
  chr3:137481774-137481873
  hyper
gggtgagaagttccacgcgtctttctaattttaggaaggggaagcaaagtcttctcctcaaacttgatacactacatgctagagaaagatcctcccttc

SEQ ID NO: 28396 - DNA, 214 bp, Homo sapiens
  chr3:137481935-137482149
  hyper
cgcgtttctggccggtcctcccaagagagaatggtgcaaaagccaataagcctggaacacacgcaggtcccgccgggcctgggacaatggtttccatttaataaatatttcccccaagggcatttcacatcgggcaggcaattattcaaaggaaacaggcgcgcaggttggctctgcgggttatttcgtcctctttacccgaagaatgctcatt

SEQ ID NO: 28397 - DNA, 30 bp, Homo sapiens
  chr3:137483214-137483244
  hyper
agccacgactggaaacgcaagaggagagaa

SEQ ID NO: 28398 - DNA, 30 bp, Homo sapiens
  chr3:137483668-137483698
  hyper
ttcatggtatggtcccggggccagcggcgc

SEQ ID NO: 28399 - DNA, 106 bp, Homo sapiens
  chr3:137483910-137484016
  hyper
cttgccctacctgggcgacacggacccgctcaaggcggctggcctgcccgtgggggcctccgacggcctcctgagcgcgcccgagaaagcccgggccttcttgccg

SEQ ID NO: 28400 - DNA, 463 bp, Homo sapiens
  chr3:137484225-137484688
  hyper
gccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtcctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 28401 - DNA, 548 bp, Homo sapiens
  chr3:137485061-137485609
  hyper
tcataaatgttttgacgatgtcttggaaatgtacctagaaggattttacctcgttgctctgttcatttgttgaacaaagacgttttgaataaagacaatctgtcattgtaaaaaagtaacctttgatgtgcctaaaatctgaagtcaggagccaggttggagggactggaaagtcgggtgcggggaggctgaaagtgcatagagcgactttaagcagtgatggctggtggctgccccccgttggcccagcttggtggtctgcgggttgggtgtagaagggcctagagcttcggatccgtccggaatgcgccctggagattgctttttgcctttagaggctagacaaaggtatcgttccctgggacttcactctctcctcccattcttcccaaaagggtcaggccacttcaaggaatgaatgaactaagtcaaaggccgacccagaccgctgagatctgggtgagtttactttttaaaaaaccaaacgctgaaggagcagggagaagcaccgagtctcctgggaaccagttgcgcgctgaacaccccgt

SEQ ID NO: 28402 - DNA, 373 bp, Homo sapiens; identical to SEQ ID NO: 6998
  chr3:137485937-137486310
  hyper

SEQ ID NO: 28403 - DNA, 304 bp, Homo sapiens
  chr3:137486516-137486820
  hyper
cacaattaacatacacgggcgctgaataggagaggacgcctataaataatagatagataaataaatgagcgatcaggcgaaggtaaacaaaggcgggctgagggaggtgtagggggagtccgggctggctgcgccacgcttacttagcattacaaaacccttttacaaatcgagacaattaggaagtgacttgcctctggtggccgtccggtctgggggcctgggcgcttagggaaggcccctcctcccgccccctaggaagcccaggaggcctgggacggagacgccacggttttcctgtctg

SEQ ID NO: 28404 - DNA, 56 bp, Homo sapiens
  chr3:137487025-137487081
  hyper
ggctggaaaggggcacgtggcgagtgcgagggcaaagtgcgaggggcaaaggcctc

SEQ ID NO: 28405 - DNA, 17 bp, Homo sapiens
  chr3:137487082-137487099
  hyper
gacggtggctgaagctg

SEQ ID NO: 28406 - DNA, 132 bp, Homo sapiens
  chr3:137487656-137487788
  hyper
ctgtagggagaggagcgccccgcccgcccggagtggagaagagccgcttctcccgagcgcgcgtcgcgcagcaaagagcagccaagagttgccctggacagactcctggcatccggagaacctgaactccgg

SEQ ID NO: 28407 - DNA, 154 bp, Homo sapiens
  chr3:137487850-137488004
  hyper
cgcgtccggtagccagggagccccagacttctctcgcttagcaacctgggcctccttcgagcggggttggcagggagggcccggacctctcgcctgaggctcccattgcttccccgggacccttctccccgccaaaagtgacccaaatacatgc

SEQ ID NO: 28408 - DNA, 245 bp, Homo sapiens
  chr3:137488337-137488582
  hyper
taatttccttaggcccgatgactttaaagacggaaaagaccagctactttgagtaaattacgctgaggtgtgagtgactgacatctgagaccccctgaacgtttgcattttggaactggagcgagctaacctgtaggaatctccggtgaaccaaagcgggatgatgtttccgtctgagtagggccaaggtactttcaatacagctcaccatttagggaagtgtgtcccgccggtcagcttctctt

SEQ ID NO: 28409 - DNA, 542 bp, Homo sapiens
  chr3:137488807-137489349
  hyper
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttg

SEQ ID NO: 28410 - DNA, 142 bp, Homo sapiens
  chr3:137489557-137489699
  hyper
ttttccacttaggtccgtaagaaaagcaattcatacacgatcagcgctttcggtgcgaggatggaaagaaacttcagaaaaactctcgccagacaacccggcagcacttggccccggaacagagaggagagaaagacctgac

SEQ ID NO: 28411 - DNA, 1165 bp, Homo sapiens
  chr3:137489875-137491040
  hyper
cggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatcccatctttcttatctctcgaagactcctttca

SEQ ID NO: 28412 - DNA, 64 bp, Homo sapiens
  chr3:138066780-138066844
  hyper
tctttatttttttaacggggggaaaatgacgccgctggagaggagttagcggaactgaaacaat

SEQ ID NO: 28413 - DNA, 373 bp, Homo sapiens
  chr3:138153904-138154277
  hyper
ttccttgacaatgaacgcgagttcatcagccgcgagctgcggggccagcacctgccagcctgggtgagccaagccgggtgggagtgggaggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaaggg

SEQ ID NO: 28414 - DNA, 148 bp, Homo sapiens
  chr3:138655990-138656138
  hyper
ccatggccttggaaccgccgggatcgcctcagcggcactccggccagctcccgacttcccgccctgggcactagggtcacccagctccagaagatagtgcttatcagcacaggaattgagaccccacacccggcgcagtgggtctccc

SEQ ID NO: 28415 - DNA, 55 bp, Homo sapiens
  chr3:138656834-138656889
  hyper
cagtttcaagacccccgatcctgccggtgaggggagggagcgagaaggagtgcgc

SEQ ID NO: 28416 - DNA, 680 bp, Homo sapiens
  chr3:138657617-138658297
  hyper
cgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggggtggggacagcccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaac

SEQ ID NO: 28417 - DNA, 161 bp, Homo sapiens; identical to SEQ ID NO: 319
  chr3:138658703-138658864
  hyper

SEQ ID NO: 28418 - DNA, 29 bp, Homo sapiens
  chr3:138659080-138659109
  hyper
cgtgcgcctggccccggaaggtgctcgca

SEQ ID NO: 28419 - DNA, 93 bp, Homo sapiens; identical to SEQ ID NO: 2277
  chr3:138662087-138662180
  hyper

SEQ ID NO: 28420 - DNA, 167 bp, Homo sapiens; identical to SEQ ID NO: 2278
  chr3:138662281-138662448
  hyper

SEQ ID NO: 28421 - DNA, 41 bp, Homo sapiens
  chr3:138662801-138662842
  hyper
tcctacctacagtcgcgccttgtgaacgaaccacggcagaa

SEQ ID NO: 28422 - DNA, 30 bp, Homo sapiens
  chr3:138663076-138663106
  hyper
aacacaaaatttattcgggaatcgacaagg

SEQ ID NO: 28423 - DNA, 25 bp, Homo sapiens
  chr3:138663703-138663728
  hyper
aaaacattagccagccgccggggcc

SEQ ID NO: 28424 - DNA, 242 bp, Homo sapiens
  chr3:138664141-138664383
  hyper
ggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgt

SEQ ID NO: 28425 - DNA, 68 bp, Homo sapiens
  chr3:138664701-138664769
  hyper
ggcggaggcgggggtgcggccggcgggcctcccaggccattgtacgagttcactacgccggggggcag

SEQ ID NO: 28426 - DNA, 534 bp, Homo sapiens
  chr3:138664802-138665336
  hyper
cgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacag

SEQ ID NO: 28427 - DNA, 132 bp, Homo sapiens
  chr3:138665396-138665528
  hyper
cgggggcttctgcgccgggtccggcttctccggggctgtcccgccgccacccccaccgcccttgcctgggctcggcggcggcccttctggctccttgactgtgcgaccggtctctggggccagcagggcccc

SEQ ID NO: 28428 - DNA, 881 bp, Homo sapiens
  chr3:138665539-138666420
  hyper
cgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccgtcttgaggctgaacttctagctcggggctggggaggggcgagacggcgagggggctggacggggtagggtgggg

SEQ ID NO: 28429 - DNA, 15 bp, Homo sapiens
  chr3:138668670-138668685
  hyper
ttacttctcaacctt

SEQ ID NO: 28430 - DNA, 352 bp, Homo sapiens; identical to SEQ ID NO: 2282
  chr3:138668757-138669109
  hyper

SEQ ID NO: 28431 - DNA, 196 bp, Homo sapiens; identical to SEQ ID NO: 2283
  chr3:138669140-138669336
  hyper

SEQ ID NO: 28432 - DNA, 105 bp, Homo sapiens; identical to SEQ ID NO: 321
  chr3:138679188-138679293
  hyper

SEQ ID NO: 28433 - DNA, 367 bp, Homo sapiens
  chr3:139258180-139258547
  hyper
ccgggggcaccggaccgcggctcgccgggatggaggcaggcaggcagcgtctcgggagggctctagggagcggcccggagctgctcggcggggcgcccagggcgcagcgggcagcgcttaccgagggcgcgcaggtactcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctg

SEQ ID NO: 28434 - DNA, 350 bp, Homo sapiens
  chr3:139396463-139396813
  hyper
aggggccaggagtcacgtgggcccgggcattcagccgcgatccaggtcctagtgggctgacgaggggcccacgctgcgcttacctgctatttgcagggctcagcaacggcgctcggcgagtctcgggggactgcgggggactaggggacctgctgggcctagcaggggctgtcggtcagcgcgcggcccggcgcccgaggtccgagagggaaacgacgtttggtctcgggactcaaggctgcctccggcccgggcagcctcaggtctagatcccctagtacctgagctggaggcggggccaaggcgaacttgaccttgcgctcccttagcggccccgggcagatggagtc

SEQ ID NO: 28435 - DNA, 128 bp, Homo sapiens
  chr3:139653445-139653573
  hyper
ttctcggagatgacgcggagccctgccattgccatccaggtccaaggctatctactctgcccgacaacccctagcaccactaggcgctgctctagtgtgcgcctggcgccctccccagaccagtcgac

SEQ ID NO: 28436 - DNA, 298 bp, Homo sapiens; identical to SEQ ID NO: 323
  chr3:139653574-139653872
  hyper

SEQ ID NO: 28437 - DNA, 1228 bp, Homo sapiens
  chr3:139653873-139655101
  hyper
gctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggatcagcggcggtgctttcaaggagggagccgagctgtgacttgtctcccagctcggggatggagtggaaacttgtaggctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtcaggcgagcctggaagccggcgaaccccggactttgacagct

SEQ ID NO: 28438 - DNA, 866 bp, Homo sapiens
  chr3:140769436-140770302
  hyper
gttagcaaatgactgcgtaatggacctaaagtcaattctgggagcacagacgagggccaccaaaccaagaactttcaatttccccaaggaagcgcagataccagaagcaccctcgaggcttctgttttggccacgccctttaccccatcgctcagttcaggctcccaatgaggcggcccaccatcagcgctggtagagcaaagagaccgacttcctgcgcctcgggtgggcggggaacgctccttgagcaggtgcggtatgaaattggactttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatgaatccgggaggacccgcgcgcaggaatgaatgcgagagctagggagtgagcgggcgagtgggcgggtgagtgaatggcgaccgcgccgccgccttggcacaggggcgcgggcgcgggctccacttccctctcccgccagctggtggcctcgagaaggtggcggcgccggcagcggcccgagctgggacggccggggcgcgggatggtgggggaaggggcgttcccggcgaccgcgccttccgcggctattggattagtggccttcagggatgagctcagccagatcggctttcagctgcagcctccgggccggccgggaaggcggggagcgggcggcggcggcggaggagggggaggcggcggcggctgcagcatccagagctggccgtggcggc

SEQ ID NO: 28439 - DNA, 183 bp, Homo sapiens; identical to SEQ ID NO: 326
  chr3:140770407-140770590
  hyper

SEQ ID NO: 28440 - DNA, 40 bp, Homo sapiens; identical to SEQ ID NO: 327
  chr3:140770643-140770683
  hyper

SEQ ID NO: 28441 - DNA, 651 bp, Homo sapiens
  chr3:140770684-140771335
  hyper
cgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagtattattattagctttgcgagcccaagcttgt

SEQ ID NO: 28442 - DNA, 175 bp, Homo sapiens
  chr3:140771638-140771813
  hyper
ggtcagagacttgagcgcggcaaatgtgtccgccctggtcgctctgtacgcgccaggggctccaagccagaaggggacgccgagcccccgacctctgactggcgggagaaccgggggagtggctgctcccgccggcccatggccaagcgcagacggctgccggcaggaaggagag

SEQ ID NO: 28443 - DNA, 665 bp, Homo sapiens
  chr3:141516079-141516744
  hyper
ccgcccaggaagtggcggcagaaagcgagccctgagaagccaggggcaggagcggcctccgcgcgacactgcggcgctcctgattctgcggcctggggccgagcatgcggggcgggcggagcctcgagctaagtcccctggggtcccagggccgcattcctccgaggtctgcaaaggccactgcttaaaggcgcagaggagcagctgggaacgagaacaaagcggccaggcccccctcggaggaaggaaggagagagccccaggaaacagctgatagcgctaagctcagcttgtttttttcctctgctcaacagttctcctgccacggcaaacaaaacatgtacattctgattccctcttctgtttggattgtgctgtcgactggatctggtttgtgatgagctgggggaagaggcatccgcgggcgatttctggctcggcgtgccagtgtgcttttgctgggccgcgccgggatcgcggagcttcctctccggctcctttctccccgtctgcgtcgctaatccagcctggcccggccaccccaagggaagacacggccgtttcttttgatagtggaattggaggttgccaagttttcagatttaatgggaggtggagggttgctcgtgtccttgaccttgaaggacctgcgcacactcatactt

SEQ ID NO: 28444 - DNA, 264 bp, Homo sapiens
  chr3:142443587-142443851
  hyper
cctttctcctctggacgcccctgtcctccagacctttagtcctctcccccgcctcaacttatatcggggcattccctctgtctcaggcgccgagtgtcttcccgcctcgcctgctgcctcaggcggtcttctcctcaccgcctctgccctgtgagtgtggagctggcgggagagtggagctggggctgcgccctcggagcgctgcaccgtcgggggtggctctggccttggggtccggggtttaggtagcgccttgggagcccc

SEQ ID NO: 28445 - DNA, 30 bp, Homo sapiens
  chr3:142607418-142607448
  hyper
ggccatccggcaggccgggctggggaccca

SEQ ID NO: 28446 - DNA, 41 bp, Homo sapiens; identical to SEQ ID NO: 7032
  chr3:142607792-142607833
  hyper

SEQ ID NO: 28447 - DNA, 140 bp, Homo sapiens
  chr3:142681855-142681995
  hyper
ctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcc

SEQ ID NO: 28448 - DNA, 1188 bp, Homo sapiens
  chr3:142682049-142683237
  hyper
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgcc

SEQ ID NO: 28449 - DNA, 449 bp, Homo sapiens
  chr3:142837870-142838319
  hyper
cccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgca

SEQ ID NO: 28450 - DNA, 168 bp, Homo sapiens; identical to SEQ ID NO: 2294
  chr3:142838479-142838647
  hyper

SEQ ID NO: 28451 - DNA, 197 bp, Homo sapiens
  chr3:142838876-142839073
  hyper
cgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggctt

SEQ ID NO: 28452 - DNA, 322 bp, Homo sapiens
  chr3:142839204-142839526
  hyper
cgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttggg

SEQ ID NO: 28453 - DNA, 16 bp, Homo sapiens
  chr3:142839562-142839578
  hyper
cggcccgagtcccggc

SEQ ID NO: 28454 - DNA, 110 bp, Homo sapiens; identical to SEQ ID NO: 2298
  chr3:142839579-142839689
  hyper

SEQ ID NO: 28455 - DNA, 119 bp, Homo sapiens; identical to SEQ ID NO: 2299
  chr3:142839783-142839902
  hyper

SEQ ID NO: 28456 - DNA, 47 bp, Homo sapiens; identical to SEQ ID NO: 2300
  chr3:142839944-142839991
  hyper

SEQ ID NO: 28457 - DNA, 136 bp, Homo sapiens; identical to SEQ ID NO: 2301
  chr3:142839992-142840128
  hyper

SEQ ID NO: 28458 - DNA, 33 bp, Homo sapiens; identical to SEQ ID NO: 2302
  chr3:142840221-142840254
  hyper

SEQ ID NO: 28459 - DNA, 46 bp, Homo sapiens
  chr3:143566766-143566812
  hyper
cgtgtgagaacatgactgtgacatttgctctcgtgacatggcaaat

SEQ ID NO: 28460 - DNA, 33 bp, Homo sapiens; identical to SEQ ID NO: 7046
  chr3:145878520-145878553
  hyper

SEQ ID NO: 28461 - DNA, 39 bp, Homo sapiens
  chr3:147072631-147072670
  hyper
ggaggccgcgccgggcgggccggccgctcacaatggagc

SEQ ID NO: 28462 - DNA, 30 bp, Homo sapiens
  chr3:147073006-147073036
  hyper
ccgggactgtgctcacgtgcctaacagtcc

SEQ ID NO: 28463 - DNA, 30 bp, Homo sapiens
  chr3:147073973-147074003
  hyper
gacagcttaggccaccggaaaatgacccag

SEQ ID NO: 28464 - DNA, 64 bp, Homo sapiens
  chr3:147074974-147075038
  hyper
gattgggctgtctggcgcggcttccaattccagtcttttccgccaggcgcggctccagtttaga

SEQ ID NO: 28465 - DNA, 368 bp, Homo sapiens
  chr3:147076998-147077366
  hyper
cctttctcctcctcccgccaggtgctggagtttttacaccggtgctttgttacttaaggagaaaaactgcctgcatggtgcaggatgctgaaggggagacagaaagagaaggtctggcggcctgggggcggccatgcgtgtagccctccccggtatgtttttgtgcacagagttggcgccagggcagcgccccagaccccagtcctggctggacaataaatgaccggacagctgcggccgctacaaaggagcccctcgaccgcgtcgctgtttacttagtgtcgggtctgaccccagggctgcttgcggccagtacagatgctgattccaccctgggaacaggctttctgtcctccgttcgccgcgct

SEQ ID NO: 28466 - DNA, 287 bp, Homo sapiens
  chr3:147078959-147079246
  hyper
gcctcattttctctccgttgttctcgggggaaccaaaataggggttgagattctggtctctacaagcctttcaagcgccttcaactttggcggcggcagcagcaggttgcgttgccatggatactgtactgtatggctgtggcggcggccacggcggccgcagctcgaatcccctaaacaatgccgagccaagtgcaggtttctcgcccttttccgtgcacttttctcttctaatggggctagtggcctcaaatgggagatgcatcttgacacgaaaacaatcccta

SEQ ID NO: 28467 - DNA, 339 bp, Homo sapiens
  chr3:147087253-147087592
  hyper
cttccctacgttcagcgaatacagggcatcactttccagtgaaatatgcctcccccaccaatatatctacaccgtctcccacagataatgccagttatttttccagcccctaaaaaaaaatacaaatgatttcaagtggatgtcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaaccccagagtcgcagctgtgcgcatccacaggcaa

SEQ ID NO: 28468 - DNA, 30 bp, Homo sapiens
  chr3:147087807-147087837
  hyper
aaaacagagcaaagtcgcaggaggaagtca

SEQ ID NO: 28469 - DNA, 92 bp, Homo sapiens
  chr3:147088421-147088513
  hyper
tcgggagactttgctcgttattcatctgtttagtcgcctcagaggcacaaaagcggatctgcggcgttatgaaaaatggcctgggcgcggag

SEQ ID NO: 28470 - DNA, 94 bp, Homo sapiens
  chr3:147088939-147089033
  hyper
agttaaactttccagcgccagcagcctggagtgaagcgaacgcctgaggcggtaggcgggttcattgcaggccaccattcggttccaggttcaa

SEQ ID NO: 28471 - DNA, 256 bp, Homo sapiens
  chr3:147090427-147090683
  hyper
gagacgcgacccagtcgggtctgggcaactccctccttcccttgcgctgggctgcagagccccctggaatacctgaggatatccccaacctggtctctcaaagatgccccgacactggaagaaacctttaaagatggactggagaagctcttttggaagacaaggcgctcacttttccacttttgggaagtaaaataagagaaccagaggaagacgtcgcggcgactgaggatcccgccagcgcacccagcctact

SEQ ID NO: 28472 - DNA, 98 bp, Homo sapiens
  chr3:147096028-147096126
  hyper
aggagtccctgaccccgtgccttggctggagcgccgtttccctggacgactgtggctgggatggcctcccggcagtaatcttgcgcaaacaccctgcc

SEQ ID NO: 28473 - DNA, 308 bp, Homo sapiens
  chr3:147098379-147098687
  hyper
agccagggcaacaagcgtgtcccccattgacaaggagccctattcagactgcaggtgcgaagtgggccggcgcgcccgaccacattatgtcaaggttgttggagattagtgttcagccctaataactaaagcgcttgatttacattggaaaaaagccccctcagccgtgaaaacaaaatctttgaacgcgtgatcattgcgagggcggctgatatcctaatacgtgcattgttctcggcctggcccaggcgcgccccggcctccttaggaagggcaaggcctgggctgctggccgtggaccaggtccc

SEQ ID NO: 28474 - DNA, 35 bp, Homo sapiens
  chr3:147102662-147102697
  hyper
gtttctcaaagaggccgggtcgaggagaggcccct

SEQ ID NO: 28475 - DNA, 30 bp, Homo sapiens
  chr3:147103192-147103222
  hyper
ccagataagagtgtgcgtgcatcggatgct

SEQ ID NO: 28476 - DNA, 62 bp, Homo sapiens
  chr3:147105883-147105945
  hyper
taaacgtgggcaagtcgggttctagaaaggaagtatatactggagagcgcagtgacagtatt

SEQ ID NO: 28477 - DNA, 979 bp, Homo sapiens
  chr3:147108787-147109766
  hyper
ccgacgagggcgacacgagggcagacggtgtagccgaatcgtagccagagctgggcggcggcgagcgcccgtgcaccttcatgtgcttacgcagcgagctggggtgcgtgtagcacttgtcgcagccccgcaccttgcacgtgtatggcttgtcgctagtgtgcacgtgcgaatgcttcttacggtcgctgctgttggcgaagcgccgctcgcagccctcgaactcgcatctgaagggcttctcgcctggcggaggcaacgcagagacattagtgcttgtgggtcgtgttcccgtcaggtgcttgccaccctcccccattcgtctctcattttctggaaaagaactacaaaatattttcagaaatccctttccacggcgcctcaggtcgagcacccctttccctcgtgcagagagcgcccccggtgccctctcttgaacgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgtgtgcataaagtggattcgtgctgcagggagaggtattctgagcaatgattcacttcagaagagatttttacaggaatggagccccctccctctttccttctaccccctgagggcaaacatttagcagcattcttcaaatcttgcctaaaccttc

SEQ ID NO: 28478 - DNA, 105 bp, Homo sapiens
  chr3:147110010-147110115
  hyper
cgctgcggcttcgggaagaaaacagctgctgctgtcaggccaggcctggctccgcagcccggagggccaccaggcggctggcataggccggggaggggctgggat

SEQ ID NO: 28479 - DNA, 497 bp, Homo sapiens; identical to SEQ ID NO: 331
  chr3:147110228-147110725
  hyper

SEQ ID NO: 28480 - DNA, 215 bp, Homo sapiens
  chr3:147110934-147111149
  hyper
aaaaatcccgccaaacgcttatccgatctcgtgagcgcctcactggacattcacgtaaaacaaaaacaattatttcgctccagacgaggagcagaggagaaaacagcagtgcactgagtgataccggcagccgggaagttcgcaggcccctaggaggccaggtgaggccgcgccccagcttgctccggagctgcaggaggcgccctggtctctgc

SEQ ID NO: 28481 - DNA, 365 bp, Homo sapiens
  chr3:147111965-147112330
  hyper
tttgagggaaatgcccgagcaggccagactctgtagttcgttgttggtcgtgtttgtttgtttgtttgtttttgtttgttgtttcccccaccccccaccgctaatgaatcaggaccgcgaaccgaaagaacgcacaaaattctgtcctgaaaacacgaaaacctgagccagccgtggcgcactgaacttgcttctctgctgtaggtcgactgtgctaagaatttaaccattttctgcttcacagaattcaaacagtgggccggcaaagagctgtaaaagtttgtttgtttaaaaaaaaaaaaaaaaaaaccctgtcattaaagatgagttccttctccagctcaggactgcgagtctaccttccg

SEQ ID NO: 28482 - DNA, 39 bp, Homo sapiens; identical to SEQ ID NO: 7062
  chr3:147114179-147114218
  hyper

SEQ ID NO: 28483 - DNA, 213 bp, Homo sapiens
  chr3:147126992-147127205
  hyper
cgggccaatgagctgcgcgcggcgcctcggcgcgccctccgttggcgcggcggctgagggcggggggaatgcgggcgcaccaatgggcgccagcgtcggcagcacgtgacacctcccccctgctcccattcatcaagggggggacggtgtcgtcctttcaattcatttatctgcaggaatgattgctgctatcagtctcgcgctcaccgcccg

SEQ ID NO: 28484 - DNA, 237 bp, Homo sapiens
  chr3:147127676-147127913
  hyper
gcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgc

SEQ ID NO: 28485 - DNA, 138 bp, Homo sapiens
  chr3:147136863-147137001
  hyper
tagggggtgcaacagcgagacttccccacaacacctccaccgaaggctgggtcgtcagcgtttgagggaccctcccgccaccccgcagcctggcggggcgctttccaaatcgtcgcggcaggctctggccgggcaggg

SEQ ID NO: 28486 - DNA, 296 bp, Homo sapiens
  chr3:147137075-147137371
  hyper
cgcgggctagagagagaaccaagcagaggctccggcctgtgaaagtcgctggctaggctcccaaaatagtgcggcggggtagctgcacgtgtttgttttcaaaccgcgctggtttaagtgagttcacactgcggagccgacagcagagggtagagcaacctggggctgctgccattggaacggcgagttgagcgggcctgtcagggcctctccgccgagggccgggggctgcatggtgctcgagccccagccggccacaccccagtgcatcgggtggctgggcttccagtttacac

SEQ ID NO: 28487 - DNA, 89 bp, Homo sapiens
  chr3:147137428-147137517
  hyper
cggctgttctcatatccctagcccctcggagaagacttagcctacccctagtcagagctcaggccccaggtgaccgggcagcggcttgg

SEQ ID NO: 28488 - DNA, 231 bp, Homo sapiens; identical to SEQ ID NO: 2307
  chr3:147138768-147138999
  hyper

SEQ ID NO: 28489 - DNA, 321 bp, Homo sapiens
  chr3:147139250-147139571
  hyper
cgtagacctccccaaattgcccgtctccggtatgactgaatctgtctgctggcctctcagctaccaactctgcccgaaatctagatcccagacctggtaagtcgcgttcctcccctaccccgccccgccaccttactagcggactctgcccgcgacagcgtgcgcgcgcgtggcctgaggcgcgcgctgagaagttgggctgatttggaactgctgcgctagttcggcctctgccgctggggtgtatacgtttatacgccgtacgctccagggtagtcaggaatgtcgcggggctccccagtgaggcgggagcgaaaagag

SEQ ID NO: 28490 - DNA, 127 bp, Homo sapiens
  chr3:147141097-147141224
  hyper
agttcccagctactctctggtgaaagcgggagggcgaagcgaaattgtgttctagctctgagctccgcagccctccaatggctgacttccttcagctgctgtcctggggtgccgatcgctgcggcag

SEQ ID NO: 28491 - DNA, 500 bp, Homo sapiens
  chr3:148415340-148415840
  hyper
agaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgc

SEQ ID NO: 28492 - DNA, 194 bp, Homo sapiens
  chr3:148415861-148416055
  hyper
cgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcag

SEQ ID NO: 28493 - DNA, 30 bp, Homo sapiens
  chr3:148943086-148943116
  hyper
ctgactatgaccaatcggacagataaccac

SEQ ID NO: 28494 - DNA, 442 bp, Homo sapiens
  chr3:149374964-149375406
  hyper
ccacgagctaggcttcggattcatgacagagttgaagagggcttcgaggtctgtgtctaggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaag

SEQ ID NO: 28495 - DNA, 113 bp, Homo sapiens
  chr3:150802887-150803000
  hyper
agggtacagtaagaccgtggaaggttgtaaggaccagagattctgactatcaagatcctggcacgtagcgaaggctccataaatggcagccatcattcttggccaagtgcggg

SEQ ID NO: 28496 - DNA, 639 bp, Homo sapiens
  chr3:150803025-150803664
  hyper
cggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggct

SEQ ID NO: 28497 - DNA, 189 bp, Homo sapiens
  chr3:150803890-150804079
  hyper
tcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccaccggccgcatccctgcgtctcgcgccccctccagacc

SEQ ID NO: 28498 - DNA, 433 bp, Homo sapiens
  chr3:150804463-150804896
  hyper
cggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgc

SEQ ID NO: 28499 - DNA, 116 bp, Homo sapiens
  chr3:150804936-150805052
  hyper
cgggggccaggctgggggtgctgggcgaccccccggcggcggagaccgagcggctgtcagtccccgcgctccactggggcgctcgctttccatgtgccggtcgctttcccgttgcc

SEQ ID NO: 28500 - DNA, 489 bp, Homo sapiens
  chr3:152552388-152552877
  hyper
catgtgccagaaatccggtcccggcaaagctagacgctctgcaatgacaggcgttcccagctagggactcctggctgcttggagcttgaaaacacctggcgtggttctcgagggccctagaggctcctgctacggactggtcggctctggggttgtaggcagaaggctctaagcggtcggaagggtttcctgtgtgtcagcaacttcactttgccgagatagctggcggaagagggaaggagcgctcgcgggccaatcgcctgccagcagccaccttggagcgcacccctctccctcgccgccgactccggtagcagcgtgccggcagaggctgaacacactcggcctcggcggagacctgctccccagaagacgcctcctgcttcccactgcgccctggaggacgcgggctggctgctgggcgagctcggcggaggcacgcccctcgcctccccgcggagtgcggactcgccccggtgcccaaactcc

SEQ ID NO: 28501 - DNA, 450 bp, Homo sapiens
  chr3:152553275-152553725
  hyper
cggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagtttt

SEQ ID NO: 28502 - DNA, 176 bp, Homo sapiens
  chr3:153838818-153838994
  hyper
tcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccc

SEQ ID NO: 28503 - DNA, 226 bp, Homo sapiens; identical to SEQ ID NO: 2308
  chr3:153839727-153839953
  hyper

SEQ ID NO: 28504 - DNA, 225 bp, Homo sapiens
  chr3:154145627-154145852
  hyper
cggagctggctccctgtccttggtgatgggctcctgggaacggcggggcacacccccagggttgggaggggtttcagcttttgagtgccggatctgcgcccgctgcctattcaagactccaccagaaaggcacagtctacaacgtgggggacgctagctaggaaacaggcgtccgtgaaacccgcatctgattctccgaatggcctttgtcgcctccctggaccc

SEQ ID NO: 28505 - DNA, 64 bp, Homo sapiens
  chr3:154146133-154146197
  hyper
atccttggccaccaccgatatggaaaactaagtcgctcgcgacggaaagcgatccccatgcccc

SEQ ID NO: 28506 - DNA, 436 bp, Homo sapiens
  chr3:154146542-154146978
  hyper
aggcttcagccccagcggcagcgggcgcacccggtccgaacacggtgtcggagctcggagagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccgatcttctggaggc

SEQ ID NO: 28507 - DNA, 306 bp, Homo sapiens; identical to SEQ ID NO: 7081
  chr3:154797472-154797778
  hyper

SEQ ID NO: 28508 - DNA, 184 bp, Homo sapiens; identical to SEQ ID NO: 7082
  chr3:154797835-154798019
  hyper

SEQ ID NO: 28509 - DNA, 272 bp, Homo sapiens
  chr3:156009028-156009300
  hyper
acccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggac

SEQ ID NO: 28510 - DNA, 265 bp, Homo sapiens; identical to SEQ ID NO: 333
  chr3:156009318-156009583
  hyper

SEQ ID NO: 28511 - DNA, 30 bp, Homo sapiens; identical to SEQ ID NO: 7085
  chr3:156009875-156009905
  hyper

SEQ ID NO: 28512 - DNA, 182 bp, Homo sapiens
  chr3:157155252-157155434
  hyper
caaggcaggcctgggcgggctgctaacgtgtgtgtatcccgtactctagccacgccgtgcgcctgcggtcaggagcactcggaatgggacaagctcttcatcatgctggagaactcgcagatgagagagcgcatgctgctgcaagccacggacgacgtcctgcggggcgagctgcagaggct

SEQ ID NO: 28513 - DNA, 30 bp, Homo sapiens
  chr3:157155701-157155731
  hyper
aggtaaggaggcaagcggggccgggacctc

SEQ ID NO: 28514 - DNA, 105 bp, Homo sapiens
  chr3:157156015-157156120
  hyper
cccgatccgactaagcgctgcaggagtccactggcccgttataaccgtgatccctcttgccgcccagcttccctccgttagggatttccacgtcttctaatttta

SEQ ID NO: 28515 - DNA, 83 bp, Homo sapiens
  chr3:157261119-157261202
  hyper
gagggacccggtccccgccccgcgtgctcaggctgaacagcttttcttccctgatctctcggaggcgccggctgctggccaac

SEQ ID NO: 28516 - DNA, 104 bp, Homo sapiens
  chr3:157812154-157812258
  hyper
aagaggaggcaagggcgccgcgagctccccggatgcactggtcccacaggccgtgcccgagtggagcactgcgaatggggccaagaaattttggcctttctcgc

SEQ ID NO: 28517 - DNA, 209 bp, Homo sapiens; identical to SEQ ID NO: 2312
  chr3:157812436-157812645
  hyper

SEQ ID NO: 28518 - DNA, 97 bp, Homo sapiens
  chr3:157812973-157813070
  hyper
ctctttcagtctttgcggaaggtcccgtcatcacaagagcccgcgcgggaaggaaagttcctgccttggacatggtcagggccgagtcttcaaagtc

SEQ ID NO: 28519 - DNA, 140 bp, Homo sapiens
  chr3:157813465-157813605
  hyper
ggaattatagcaaaacgaataacgagagtccatcttggggaaggaagttactctatcctatgttattttacttcttatctgttctttcattaatttggtataaccctgtttctatgctgggtggataaaatggagggggc

SEQ ID NO: 28520 - DNA, 38 bp, Homo sapiens
  chr3:157813669-157813707
  hyper
cggcacgtaagagcagaggcaagcgcttttccaagttg

SEQ ID NO: 28521 - DNA, 372 bp, Homo sapiens
  chr3:157820497-157820869
  hyper
tggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaag

SEQ ID NO: 28522 - DNA, 126 bp, Homo sapiens; identical to SEQ ID NO: 2315
  chr3:157821536-157821662
  hyper

SEQ ID NO: 28523 - DNA, 30 bp, Homo sapiens
  chr3:157822056-157822086
  hyper
ttgtggactcatggccgggaggctgcactg

SEQ ID NO: 28524 - DNA, 15 bp, Homo sapiens
  chr3:157822865-157822880
  hyper
gcccgggagaagcag

SEQ ID NO: 28525 - DNA, 109 bp, Homo sapiens
  chr3:157823011-157823120
  hyper
cgaccggagggttaagctttccacctctgccccttctccctcccggcaaactctgcgctagaggctagctttagtcccgccgtctggttcagcaccccctcctgcagcc

SEQ ID NO: 28526 - DNA, 736 bp, Homo sapiens
  chr3:157823138-157823874
  hyper
cgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttcct

SEQ ID NO: 28527 - DNA, 30 bp, Homo sapiens
  chr3:157824303-157824333
  hyper
ttcccgggtagcagtcgcgcctctaccggg

SEQ ID NO: 28528 - DNA, 211 bp, Homo sapiens; identical to SEQ ID NO: 7097
  chr3:157824698-157824909
  hyper

SEQ ID NO: 28529 - DNA, 230 bp, Homo sapiens
  chr3:157825059-157825289
  hyper
cgctctattattcgtgtcctggagcccagctgactcctctatggacagaccccgctaaaagggaccagtcgatttaacaagtttccccagcagctgttagctgacagatctcattttaaagtgtttccttagcgcccggtcaaggacagctcgacttcgttcgtttcctctctgaggtctcagaactcccacccttctcccttactctctgcactcggacccctctatgg

SEQ ID NO: 28530 - DNA, 92 bp, Homo sapiens; identical to SEQ ID NO: 7099
  chr3:158288920-158289012
  hyper

SEQ ID NO: 28531 - DNA, 230 bp, Homo sapiens
  chr3:158449969-158450199
  hyper
cgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggc

SEQ ID NO: 28532 - DNA, 247 bp, Homo sapiens
  chr3:159756650-159756897
  hyper
ccgccctttctcctccgtggctccccagccaggaggctgcgcttacctgctccgcacgacctctgcggcttgggggctctcagctctgtcgctgcggggctccaggctggtgcttgtgctgagaatgactgcgggaggggctcgcgtgcccagcactgcaccgcgaggcgaccaaccgctgacatgtggggcgattgggtggacaggaagactcggcgagcttttgtagccgcgggtagggacagcc

SEQ ID NO: 28533 - DNA, 300 bp, Homo sapiens
  chr3:159943920-159944220
  hyper
cggggaggcggcgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggaggtcgtgctgccagtgtcggtgcttggccgccctcgaggcggggtcgccgcggagcccgacggcggcgagggccgctaccctcttatctgagcgctcggggatcggcggctggtgcagggctgggggctgcgggtggcaagcaac

SEQ ID NO: 28534 - DNA, 166 bp, Homo sapiens
  chr3:159944437-159944603
  hyper
ccctctgccttgcctcgtattgtggttcactagtaagtgcctgcttccctagtcaaagagaacacgtgagccctttggtgcgtcgagagaagggcggtcttctttagggctgaggagaaaggaccgcagttccactcctttccctacctgccgcctggacaggtct

SEQ ID NO: 28535 - DNA, 185 bp, Homo sapiens
  chr3:160167683-160167868
  hyper
tcaactgcaaggcatcggccaatgggaactattgctgggctcgttcgaaagtaaacggtggacggcgcggcccgaggcaggtggcgggagtcagtttaaggctggcgcccagctttccgcgcctgcgtgctaggcgcaggccgcctctcggaagcttggcctcgcaggagcggctctctatcctg

SEQ ID NO: 28536 - DNA, 109 bp, Homo sapiens
  chr3:160822766-160822875
  hyper
ctgggccccttctcccgcgctcaccggaggcgggcagctgctcgtcaccgagacccgagacccacggtgcggcggctcaacctgggccacgctccgctctagaggagtg

SEQ ID NO: 28537 - DNA, 217 bp, Homo sapiens
  chr3:161090326-161090543
  hyper
tctcggcccggactgcggcaggagggcaaactggggaaagaaggctgggaggcggcccggtggtgcagagacgcgcggcgcctgctcccgcggctcccggggctggcgtgccctgcgcttacgctccgcgctcgaatatcttccccggagggctcgggaccagcgcgagcaccttccctggaagcccacatccatcacccagcgatctcctctccat

SEQ ID NO: 28538 - DNA, 137 bp, Homo sapiens
  chr3:164911621-164911758
  hyper
actcaaatatttctccgtgaaattttcggggagtgaatcctagggagtagtgggagtgggggtggaggtgattgaaggaagatattgtattgtagagggactaccagatgacagttcaggaacgctttcagaggaat

SEQ ID NO: 28539 - DNA, 63 bp, Homo sapiens
  chr3:164912404-164912467
  hyper
ctcccccccatcccccgcccagcactttgggtacccaatgtgcagaggcggtgactatttatc

SEQ ID NO: 28540 - DNA, 35 bp, Homo sapiens
  chr3:164912977-164913012
  hyper
tctgctgtcgtcaggcgaaacgcacaatggtctgt

SEQ ID NO: 28541 - DNA, 1140 bp, Homo sapiens
  chr3:164913244-164914384
  hyper
cctagcacctgtgagcgtacagaatacaccgcggccaaactcgatgtgctctacaatgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaattagcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacg

SEQ ID NO: 28542 - DNA, 449 bp, Homo sapiens
  chr3:164914796-164915245
  hyper
cctctcccccattatcggtcacaacctggcagctcttcaagagacaccctgtgaaattgagtgtcgggaagtcagcattctgtacccgtggattgatttgtaacttttatttgcaaatgagagagatgcctgtttggaaaattacagcccaaaaggtggagggtgatcaaattaagaacatctgagctgtattggtgggcggtatcgctaaacgcctccggggagcggtttccaagtgatttgcagtaatcccccaccttcatgatacatgggtgacgatttgaaagtacacatatttcctcatctgtttacatttgccgggggcggggggcataaaactgtagggcacagggagttgggaggggggcatttgcctgagagatgctggataccatttcgcgataaattagatacggacactggaacaattaatacgtgtaataacacgt

SEQ ID NO: 28543 - DNA, 30 bp, Homo sapiens; identical to SEQ ID NO: 7107
  chr3:167097947-167097977
  hyper

SEQ ID NO: 28544 - DNA, 66 bp, Homo sapiens
  chr3:167967494-167967560
  hyper
cgagcctctggggctcgcccggccgctcctcgcgctcccagacgcctgtgacgcctgttggggcca

SEQ ID NO: 28545 - DNA, 384 bp, Homo sapiens
  chr3:167967946-167968330
  hyper
cacctgcgggggctgcgggctgtcccgggcggagcgcggcggaacgcagtccccagctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattc

SEQ ID NO: 28546 - DNA, 47 bp, Homo sapiens
  chr3:168864015-168864062
  hyper
tctagccaaagggtccgaatgtgactttctcgcgaagcagcacacga

SEQ ID NO: 28547 - DNA, 30 bp, Homo sapiens
  chr3:168960419-168960449
  hyper
tatcatactgattgacgaaaccaagagtga

SEQ ID NO: 28548 - DNA, 149 bp, Homo sapiens
  chr3:169375895-169376044
  hyper
ttttagaaagaagaccgtggctagtggagtggggaagtcgggagggaactaatgatttatcctgcgccgtccaggagaaaagaaaagcagaccccacagaccgttttagaaaatgcctagacagcggcttccagcggaagaagggttaa

SEQ ID NO: 28549 - DNA, 30 bp, Homo sapiens
  chr3:169376305-169376335
  hyper
gcagcgcgccaggcacgcagcccctctgag

SEQ ID NO: 28550 - DNA, 141 bp, Homo sapiens
  chr3:169376602-169376743
  hyper
ggttctccatctcaccgcccgcttccagcggaggcaacgcgcaggggggtgccgggagagagggggccgagccgggcgtgccgggggcaactccgctctcttgtccttctagcccggggaggagggcgtccccccttcctg

SEQ ID NO: 28551 - DNA, 210 bp, Homo sapiens
  chr3:169379435-169379645
  hyper
ctcgcggggctacaccgccgactccaatgcccgcgaagccgagcctgctgaggtgccgccgacttcccgggctgctgcagggacgcagtgagcaaggaggcgtggatacgatacctaccgtatttggttctaatgtgcgagggtcgcgcggggggagactgggatttcactggggagaagcatcccacccatctccgatctctcatttct

SEQ ID NO: 28552 - DNA, 42 bp, Homo sapiens
  chr3:169386544-169386586
  hyper
ttaccttctctacctcgtaaaacttgccgttttgtaaattgc

SEQ ID NO: 28553 - DNA, 64 bp, Homo sapiens
  chr3:169483001-169483065
  hyper
aggacgttgcccttccgcacgtccgggaaaggctttgcgtctttacttccgaccttctttaaag

SEQ ID NO: 28554 - DNA, 428 bp, Homo sapiens
  chr3:169529973-169530401
  hyper
ctcctctcctgcccccggtcgcaaagggcgaccggggactcttctcctgccctcgtttctgggcgccccaaacctctggccacagctggggttcccaggggcccccctcccgcctcgacgccttgggctggcgggctgctgggaggactcctgccgtgcgaccccggcgcccctcgcgcgttttgtctgggccaggccgcgcagacgtgctccctacttcttaccgcgctggaccgccagggccgcgcccggagtactggcctgagtggaggcccaagccggggacctggccggcgcacgggcggcctcccgggagctccccatgctcctctcacccactggccgcggcggctgcgctgccatggcgaccgcgcgcgcacttacagtccgcctgcagctgtgaggcggctacacgagcctcggcgcca

SEQ ID NO: 28555 - DNA, 107 bp, Homo sapiens; identical to SEQ ID NO: 7111
  chr3:170136940-170137047
  hyper

SEQ ID NO: 28556 - DNA, 133 bp, Homo sapiens
  chr3:170302544-170302677
  hyper
ctaccttgcccccagcgctctcctagaccctatacctagggggaggcagggtgacatcctgcggcccttgggcaattcgggccagtgacgttcaccgacactcaggcggggatcccttcgccagagccagttc

SEQ ID NO: 28557 - DNA, 114 bp, Homo sapiens
  chr3:170303029-170303143
  hyper
agcttccctggacaccgctcccgtcacgtcctcttcgccgctcccgggagagtcaccactctccggggacagacgcccctcggggcgccaccatcctggtcggggtgctgggct

SEQ ID NO: 28558 - DNA, 116 bp, Homo sapiens
  chr3:170303379-170303495
  hyper
cggcgccggagccgcgctggcccccgccccgcccggcagctcccgcgagtcagagcccggtgcccccagaccgcgggcagtcggggcctcattccgggccagagcaggaaagagcc

SEQ ID NO: 28559 - DNA, 177 bp, Homo sapiens
  chr3:170303738-170303915
  hyper
tggtggctggcagtccgcacttactgcgcggagctgtctctctagctgggatgggaagtggtggtggcggcaaaggaaggcaggaggcagccgctgctgctgaacagctcctcaattattcagattgggcccccaccccccgaacccctccccgtgcctgctcgtcctccctccagc

SEQ ID NO: 28560 - DNA, 346 bp, Homo sapiens
  chr3:170625828-170626174
  hyper
agtcgcagaggagctcgctgagggtggggacacccgccctgggcgctcctccgtgctggaaacagcaggttgcggcccccatcgccccaccgcagaagccggcgaccttcccccgccgcccagccctcggccgccgccccgaaccctactgcgggggacccagcccaggccgcaggtccccgcgaaggatgcggggtaacagaacctggccagcagcacccggccctctgctagctggcgcgcaccccgccctccacccttcaacgtcgccgccgcggccgcacaggcgccccctgttctgccggcatccagggctcagctcggcccggcccggccccactagggc

SEQ ID NO: 28561 - DNA, 63 bp, Homo sapiens
  chr3:170626617-170626680
  hyper
ggattagtgcacttccggcgtggagcgcactttcagcagtctggttgccgagggtgagctcgc

SEQ ID NO: 28562 - DNA, 353 bp, Homo sapiens
  chr3:172165432-172165785
  hyper
gttctggtccctgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgct

SEQ ID NO: 28563 - DNA, 368 bp, Homo sapiens; identical to SEQ ID NO: 2318
  chr3:172165866-172166234
  hyper

SEQ ID NO: 28564 - DNA, 278 bp, Homo sapiens
  chr3:172166235-172166513
  hyper
tgactgcgctgggaggctggaccgagctggctcccgaggaggtccgcttaggcgcgggagggtgcgagggaggagcgggtgcagacgcgtagggaggatgcttggagaagaaagagagggaggtgagaggcagaagccgaggaagaaggtgagatggggacaaggaagagggagagagactggtggtcagtgggtgagagagtgacccactgctttctctgacacctcccctttcccccaccaactcccccaaagtttctcccaacacatcctccggc

SEQ ID NO: 28565 - DNA, 33 bp, Homo sapiens
  chr3:172166672-172166705
  hyper
cgctggactagtgtgccccggaaggacaggtca

SEQ ID NO: 28566 - DNA, 45 bp, Homo sapiens
  chr3:172166999-172167044
  hyper
cggatctcccacccggttgggacttctgagcgcacaggggcaaga

SEQ ID NO: 28567 - DNA, 43 bp, Homo sapiens
  chr3:172167431-172167474
  hyper
aataaatagaagacgcgttgctgttgagaagtagaagctgtgc

SEQ ID NO: 28568 - DNA, 322 bp, Homo sapiens
  chr3:172167595-172167917
  hyper
cgaattcacaaatccgaccggcccctcccggcccaccgacctcgggaccgccccaggaacatattcagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcct

SEQ ID NO: 28569 - DNA, 32 bp, Homo sapiens
  chr3:173113479-173113511
  hyper
aggacgctcggctgccgcgggaggagtaaggg

SEQ ID NO: 28570 - DNA, 386 bp, Homo sapiens
  chr3:173114201-173114587
  hyper
tttacatgcaggaaacgtatatatgtttatataccgaccgcataatatataaatacatatacgcgtgcccaagggcctggttttcgtctctcctccccacgaaacggaatgttttggagccgatggataacaagaacactattaacattcttttgagcctgttttttaaaagggggagggagcgtgaagaattgtttaacatttggccatcgtttggctgcacactaagcaccacgaagtatttatggttgcagatcaggtgcaaacggggcttagagagaaaggtaagggagcttcctgcgtccgccgagctccggcgtttaccttaatcccggggattgccgagaacttcctattccctgcctctccttcgccttccccacctt

SEQ ID NO: 28571 - DNA, 709 bp, Homo sapiens
  chr3:173114985-173115694
  hyper
acagtggaggagattcgccttccgtttctgcataaaaccaatacattttacttggagggtaatttgccagagttgagcgagacgaagccgtgtctaaataagtacatgacactaaatttccttttaaatccaccttttacaccatggccagtcgcttgtttaactcccgttcaagggacacggttttcaaacgtgaccttttggggagatgtgggaacttcccctcatttcttcttctgtgccgctaacctctttcctcctccgcgcggcatctccagccccggcagtttgtaaattgcccgttttgcccaccctcctggtgggcgttctctcccccactccactcctgccccctctgtcctttcttcattggcgtcttcggagcagatgcatcttctttcttcttggcctcactctcccgttcccccgtcagtccccccacccgcggctccccacttgccccagctctcctcgccgctcctccccgcctccccgcggagggttgacccttcaattcggagtcccggcctgtgggcgggcgggggagcgccgcggctgtaagccgaggatcaggcggcggcgcggagagcgcgcccgggcggccagcgccgagcgcgcggagctggcgtggggagacacggcaggaaaggcgagtcggagtgggtgatgagaggccgggagagcccgtccgagccggagagaccggaga

SEQ ID NO: 28572 - DNA, 210 bp, Homo sapiens; identical to SEQ ID NO: 7127
  chr3:173115965-173116175
  hyper

SEQ ID NO: 28573 - DNA, 23 bp, Homo sapiens
  chr3:173302646-173302669
  hyper
tggaacaagaattaccgggtgct

SEQ ID NO: 28574 - DNA, 291 bp, Homo sapiens
  chr3:173302927-173303218
  hyper
aatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggctt

SEQ ID NO: 28575 - DNA, 896 bp, Homo sapiens
  chr3:179168744-179169640
  hyper
gttattttgggggcacgcacgggctcgtgctctgagttcctggaaggaggcctcggggagtgacgagaaaccaggggggtctgcaggacttggaccgccgaccgttcctcgctccccggggcgagcggtctggaccgcccgggaagtgcctgcgccggcggtcgtggggccagttcccgcgtggcagctgggcgcgacacaggcgcgccctcctcgtccctcccgggcagcgtcggccgcccgagcccggggagacccgccccgccccgcgccgtcacccgggccccgttccgcaggggtggctcgcggcgccccacgtccctgcgagaagcccgggatcgcttcgcggggcgcaccgacgagccgccgctcgcgagctcgccgcctacctggagggagctcaggcccgcgtcgaccgcgcgctgccggtgtccgctgggcgctcagcagcccctggagcgcggagccggcgtggagagcgcagctcacagccgagaccagagccgccggccacacccagtcccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 28576 - DNA, 15 bp, Homo sapiens
  chr3:179754178-179754193
  hyper
cccttctcccacctt

SEQ ID NO: 28577 - DNA, 245 bp, Homo sapiens
  chr3:179754238-179754483
  hyper
cggtcatgttgcatcacttcacttgttgagctgtgcgaaggcagcacttgaccacagaaacttggtgaaccgccttgctcttaaattagcccccaagaattctctccagccctatagaaatgtcttacctgcatgtgtccctggtacattctgcttcggtttcttcagggctccctgaggccaccggatgcttttcccccgtgcttacttgcccaccaaaagaggggaaaaggtgggtgcacagc

SEQ ID NO: 28578 - DNA, 276 bp, Homo sapiens
  chr3:179754484-179754760
  hyper
ggttctcagagggtgctcctgagccccctggagctccgggtactcggccggccggcggccactcggcagcgctgcgggctgccgggaactgttctccgctcggggtgctgaaagcggacgcgggagagcgcgcagagaaggcgaggagccgggtcggccaggctctcctgcaggcgcgggtcctgctcgcggggcgtctctagaactcactccttcttcgccgaactctttctcgcttcctgccaggttgcctcatgtctctctctctctgagctg

SEQ ID NO: 28579 - DNA, 70 bp, Homo sapiens; identical to SEQ ID NO: 336
  chr3:179754803-179754873
  hyper

SEQ ID NO: 28580 - DNA, 286 bp, Homo sapiens; identical to SEQ ID NO: 337
  chr3:179755086-179755372
  hyper

SEQ ID NO: 28581 - DNA, 732 bp, Homo sapiens
  chr3:180397310-180398042
  hyper
ttaccaaacaggaaacgctccagcccgaaggcgaaacttccggttgagaactccctgcctgcaggccgaagaatctttttcttaccttgagcactgagggatgagcagcaacttgcccctcccgacgttcccgggggttgccaggcggcagcgtaactttccacgaaaaggcggctctcggatcgctcccggagcgtgtgaaaactgtggcccccggagctggctggaggaccacggggcagctggctggaagtaaaccacacgatcctccgattgcctgggggaagacgggagccaacagggattataaactaagtttcttttcaaggtgtgtttgctgtgttgtgtagatttcagctactacagtaggtgaaagtagaccgaagtgaactggtgtttggaaacaactctctctctggcatcactgggatgttctgatcgtcgcctgtttcagtcggccagccttcctcaccgcactcaccggccccatcgcggatgtcccagtcgatcacagacgcggaccgcgcggaggccgcacacttgtggcgcggtgtggtggtccctccggcaccactcccatacttgcatttttctttgcatttttgtttgctaacatttaaagtgtggaatttcgcataaacgtctgtatttcctctgcttgaaaaagggtaggtgacacaatccccattatcaaaaggcaatgttccgctggagaggcgccccctttagacc

SEQ ID NO: 28582 - DNA, 982 bp, Homo sapiens
  chr3:181413421-181414403
  hyper
gacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggtcattggctccctggaacatccagaccctgatcgtgcgtatcgtgtttccttataagcagcactcgcgatttaaaaacaggtcccggtgcccctcttgctgatcctctctgccattagcccgcttaattccctttttgtaaattcccctctttacctttctttcgtccctccctccctctctttcttctttcctcctctccttttcccctttctctttttcttcctcaatctaggtcgtttctgctgaatg

SEQ ID NO: 28583 - DNA, 95 bp, Homo sapiens
  chr3:181419696-181419791
  hyper
tgttggctcagaaaccgtgtaatttctcatccgataggagtttctttatgagaacatcaaaggataaaaagctctgcattttcgtagttggttaa

SEQ ID NO: 28584 - DNA, 575 bp, Homo sapiens
  chr3:181419911-181420486
  hyper
aaagaatttagcctttaatctctttttatccacgaagactaaagctctgtactcgaccccgcgagcggctctcgccttccggggctggaacccgactcagatgtgaagcggcactgagccgctgcgcaggttcgtgcccagcgccccctgttggacacagtaggagctgcgcagcgccagtcccagaaatcgctggaatcctgctctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactcttttgaaaggttctgcgatggtaaaacaggtaaagaaaagtgacgaaaaacaaagcatttttctgtagccgtggagaatcaagcaaagtatacttcctccgttttgtccacatttcaaaaaattaaacggaagatgctgctgcttgctgttttgacgttgtcagcagcgt

SEQ ID NO: 28585 - DNA, 1136 bp, Homo sapiens
  chr3:181421249-181422385
  hyper
acctcccaaaattagcgaattcgagataacatttcaaggggaattgctatttagtgcgatgagagatgacttctccatctggttccagaattagatctcggcttaggttttttagtaagtaggttcagatgcaatggaaggagagaagaatcaagccttttgataaaatctctaccccgaattctatggaaaagacaggcaagcgggattccagccacagcacccccaccttttgctctaccaaaaggcttgtccccattacagaaataatatagtcggtgctagttttgtgaacccgcgccaaccgataaggtaagaaacggtgcgctgacagccgaggtccgaaggctgctcagtggttcccgcagcccgtggggtagggaggccaaagccagcaaaatgttggaggcgacgccagaaagagagtatatgcctgctattcggaagtgatgtcgaacgtgcaatagcagagtcctggagatttccaccccgttccgcacccagggatcccagcctgtggggtagcaggttgttgggtgaaggcaggagggagaagccgcacctggctgagggcgggtgggcgtgccgggagcgagtgcccaactttctagggcccatggagaaagcataacccctagttgaggaaagagagctaaacaagtgggtggcccaggcctgggaatgccacccagctctcccgacgcagtgttatttctgtggtcccagggggccccagcacctgcccgaatcccactccccaaggccgccagcaggaaggcagcccctccatctttgagggctgaggagggggcagcgagtgacttgattccttagtagcagggaaaaccgcagcggctggcaacgggccgcgtttctccgcggcggcaaagcgccctttaggggcggggcgggcatttttggtctcctgtcccagcgtccaggcctgagcccgcgcgggttggctgggcgccctgctttgtaagtaaccaatcttgctggattctgaggactatccaggcggatgggcccacttagcttaggcccactgagaccctgccaactcctcagacccttttccccttcatccctcacacctttcatgatgaacccaggaaagaacccgaactctgaaaaac

SEQ ID NO: 28586 - DNA, 250 bp, Homo sapiens; identical to SEQ ID NO: 7141
  chr3:181422925-181423175
  hyper

SEQ ID NO: 28587 - DNA, 515 bp, Homo sapiens
  chr3:181428313-181428828
  hyper
ctattgaaatctttacgtcgggacaatgggagagcggctaaaattaccctcttgggtcctgggcgggcaagattcctgagcccctacccccgcccccatctcatcctcctctaacccgggccttgctgggctcccccttccccagtcccggccgccttctcccagtgtgcgctgcctgcacctgtgcctggagagcatcgaccccgcctcccaggccttgagcccctttgcggcgcagccccagccttgcgcggcctgggctttgcggccaccacaatggaaatctacggggaaaatgccagggctggttctgctggagtcctgggaactctgcgtgggagggagtttgtgactgcggcccaaaagccacctccatacagtgccgtgggatgccaggaagttgaaatcaccctcccccatcgcctgcacttttgagcgcccttccgtctgtgtctttccccagcccccatttgaaagccgcacgaccgaaacccttcttacggggaggcatggga

SEQ ID NO: 28588 - DNA, 32 bp, Homo sapiens
  chr3:181430289-181430321
  hyper
ttcatggtgtggtcccgcgggcagcggcgcaa

SEQ ID NO: 28589 - DNA, 627 bp, Homo sapiens
  chr3:181430695-181431322
  hyper
acccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaa

SEQ ID NO: 28590 - DNA, 170 bp, Homo sapiens
  chr3:181437129-181437299
  hyper
gttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgac

SEQ ID NO: 28591 - DNA, 230 bp, Homo sapiens
  chr3:181437300-181437530
  hyper
agctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagc

SEQ ID NO: 28592 - DNA, 256 bp, Homo sapiens
  chr3:181438167-181438423
  hyper
gtattaaataaggagcggtgaattcttcccaagggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagacccc

SEQ ID NO: 28593 - DNA, 30 bp, Homo sapiens; identical to SEQ ID NO: 7147
  chr3:181440785-181440815
  hyper

SEQ ID NO: 28594 - DNA, 1407 bp, Homo sapiens
  chr3:181441019-181442426
  hyper
tcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaacatgcgtacacacacttgcactcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttctttctagacagtgttg

SEQ ID NO: 28595 - DNA, 587 bp, Homo sapiens
  chr3:181442963-181443550
  hyper
ctggaagagcacatgaaactcagagaactacaatgcagacgacaacgcctagaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccac

SEQ ID NO: 28596 - DNA, 143 bp, Homo sapiens
  chr3:181444050-181444193
  hyper
cataattatgcactgcagattctccagcctcctcgccctcaatcttggtaacctggtctttggttaataatatcgcaactcgggacttcaacgctcagaccccctccaggccccagcctccgtattctcggagccctccacta

SEQ ID NO: 28597 - DNA, 91 bp, Homo sapiens; identical to SEQ ID NO: 2335
  chr3:181444434-181444525
  hyper

SEQ ID NO: 28598 - DNA, 146 bp, Homo sapiens
  chr3:181444612-181444758
  hyper
cgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcg

SEQ ID NO: 28599 - DNA, 131 bp, Homo sapiens
  chr3:181444818-181444949
  hyper
actgtgctgttgcgtcttgcgcagcgcagacacctccactctggattgaaacgaaaaagctcgcggtaagagcagaaaattggtctattgatacattcgctccgagtgttgatcttggcatcaccgatagc

SEQ ID NO: 28600 - DNA, 1 bp, Homo sapiens
  chr3:181444988-181444989
  hyper
c

SEQ ID NO: 28601 - DNA, 735 bp, Homo sapiens
  chr3:181444990-181445725
  hyper
cggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacctttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatc

SEQ ID NO: 28602 - DNA, 62 bp, Homo sapiens; identical to SEQ ID NO: 2341
  chr3:181445799-181445861
  hyper

SEQ ID NO: 28603 - DNA, 30 bp, Homo sapiens
  chr3:182896611-182896641
  hyper
tgctgggaggcggaccgggagctcccagtc

SEQ ID NO: 28604 - DNA, 224 bp, Homo sapiens
  chr3:182896884-182897108
  hyper
cccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctggttgtcccctttctgccgccgccgaggctccggctgctttctgcgtagctgggcagggcccgggcccccacac

SEQ ID NO: 28605 - DNA, 313 bp, Homo sapiens
  chr3:182897157-182897470
  hyper
cgcagggaggtcagctctcctgggcggaggtcctcgggcgcagcgccctcgcctggaaaccagccgtcgcccccgcaggagccagccggcccgtggacgccccagcgcgctcctcctcggtgctgcgggtcgccctgcaattccgagaagaaagtcagagacgccgtggcccaaagaggcgcttagtctttcctcgctcacactcacgtttcctcctcatcgcgttcttctttttctccctggctgctttctcccctctccaggaaagcagatttggaggaacaggtttcgtgactgtcgtccgactggaaaa

SEQ ID NO: 28606 - DNA, 110 bp, Homo sapiens
  chr3:182971127-182971237
  hyper
tgttcttgagaccagcgactttagctccgatgcgggaaggaaagccgacctccgatttggacatttaaagagctgggcttgaacttcgtgagtttcgctctaaactgccc

SEQ ID NO: 28607 - DNA, 196 bp, Homo sapiens
  chr3:183145371-183145567
  hyper
cacccaccctactcccgtcagaagcagctaacggatggtaacagcccagcagccctcggtttggagctcaacggactcggcaaccacctggtgaaggcaccagcctcggccccccgacccccaccagcggcgcgccccagggatgccccccgctgggcaccgcaggcaggacccagagcagcgaggcccagatgcc

SEQ ID NO: 28608 - DNA, 55 bp, Homo sapiens
  chr3:183948534-183948589
  hyper
gcgtgttcgtgtacccgctggccgaggccgaggtggtgtccggcttcgaggccga

SEQ ID NO: 28609 - DNA, 78 bp, Homo sapiens
  chr3:183978018-183978096
  hyper
cgcagggagaaagcgcgtcagccgcgcggcctcggggggcggcggcgatgagaatgagccccgcgtcctagcttcccg

SEQ ID NO: 28610 - DNA, 522 bp, Homo sapiens
  chr3:183980079-183980601
  hyper
ctgtgccagtgtctccgtctcctgaatctgggtatttcagtctctcctaggaggggtctatagaaactgggccgacgcgcgcgcaccagggcagacacccccagccctagtccggtggctgtagccccccgcggctctggagtggtgcgctcgcagtgtaggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgatgggaacatgccctcttctccccttgcctcccgcccccacaacccccgccctggctggccgtcacccgcggcgtcacctgcttgccagcgcgcaggagctctggcgcaatcactggccttggggaggagggggtgtctcacatgcggcgacagtgacggcagcgctgaaaacggtaatgatcaccc

SEQ ID NO: 28611 - DNA, 37 bp, Homo sapiens
  chr3:183993816-183993853
  hyper
agcgggggtgctgcgcggcggccgtgatggctggtga

SEQ ID NO: 28612 - DNA, 374 bp, Homo sapiens
  chr3:184243074-184243448
  hyper
ccccccacaaacgcacgtaaaacctctataaagggagaaccgccttgctgctgagggcgcggtgggacccgtcgcagggccagctgctccggcaggtgcccccaaagggtcccgcaggtgatcctcggggactgagcgcccatcgcccttcctacgcactcagatccgccgagcccagcgcccgccagagcccagagagtcctcggggtcagagtggtcacgtcaccgtcattcttttcctgcccgactagtcgctctgggctccccggggccgggggccgggggccgagccgccgccccgattccggcttcacccgcccgcagcgcgcggcgccccgcgctccattcgcgctacctggcggctggcaggctgc

SEQ ID NO: 28613 - DNA, 169 bp, Homo sapiens
  chr3:184301502-184301671
  hyper
ccgcgccgccgcagccggcccgggggaggggcgccccgcacggctaagctctctgcgtccccggggcggacgcggggaggggaggggaagggacgcagcctctccgccgaggcctccttcctcccctagtgggggggaggggctgtgcgggggcaggggcgggcgatgc

SEQ ID NO: 28614 - DNA, 15 bp, Homo sapiens
  chr3:184319828-184319843
  hyper
cccggggctggggcc

SEQ ID NO: 28615 - DNA, 223 bp, Homo sapiens
  chr3:184319873-184320096
  hyper
cggcgggcccctcctggccattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggc

SEQ ID NO: 28616 - DNA, 95 bp, Homo sapiens
  chr3:184321779-184321874
  hyper
gaaacgttcagtagtcggacctgggccacggagggcacagcggccactctttctgagaggcagaggtcggtgggctccaccctcccactccgagc

SEQ ID NO: 28617 - DNA, 47 bp, Homo sapiens
  chr3:184322209-184322256
  hyper
cgccccttgccaaggtcaatcaaaccctcccacgctccggaggcgcg

SEQ ID NO: 28618 - DNA, 46 bp, Homo sapiens
  chr3:184870261-184870307
  hyper
cgggcccggagcccacggcggccccagcctccggcagagcagcccc

SEQ ID NO: 28619 - DNA, 262 bp, Homo sapiens
  chr3:184871031-184871293
  hyper
tgaacacacactcctcggccgctttgtactcacatgcacgccagcctacatatgcacttccccccgagtgacactggccaccgagaactgacacacgcgtccacacgctccacggagggctgcgcacacctggcccacgcccacccgaacctcctagtggcccgggccgggtgcatcgcgtagcgaggatctcacacacacagcctgtccccacaggcgtctcacatctccctcgtacacacctccccgtgtctgggcatgg

SEQ ID NO: 28620 - DNA, 43 bp, Homo sapiens
  chr3:185543626-185543669
  hyper
gtgtggtcgaaggatcgcgcgcgggagtcgggacgcctaggac

SEQ ID NO: 28621 - DNA, 60 bp, Homo sapiens
  chr3:185544035-185544095
  hyper
gagggtggctggaagcggaggagcgcaggctgtgtaggagttccccgagcactgggaagg

SEQ ID NO: 28622 - DNA, 608 bp, Homo sapiens
  chr3:186078723-186079331
  hyper
agtccgaggaggcagcggcgcagcgcgggagagcgcgcccacgggttcacagcgctcccgggcaccactgcggcgcagccacagatcgcttcgcgctgcagcagacgctcccgccgcggggggcgactgggggaggggtctcgaccgccaccctgagttccgcagctcatccctcccatctgggaggtggttctagctctagtcccaagctttccactgcagtgatggtggggatgggggcagcacgtcaaatcacctgtagggctttttagaactccacagccccctcccctaattctattccactagttcaaacgaagaaaatctcagactaggcaaggggaggtggaccggtggagtctgcgaaagcaccacaggtgactccgggtacgcactcctcaggacacaagcacacacacggacacatcttgtgactctgagactacacagatcaacctcagattcgacccttccctcctttattctctgaggtgtccgtgttcgcttcagcttccctttaagtcgccctgcgcaggggctttgtggagtgcccccaaagtcctagaaccccgcgggacggtcggaggctttggcggccagacattagg

SEQ ID NO: 28623 - DNA, 104 bp, Homo sapiens; identical to SEQ ID NO: 7167
  chr3:186079667-186079771
  hyper

SEQ ID NO: 28624 - DNA, 427 bp, Homo sapiens
  chr3:186079818-186080245
  hyper
cgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcacacacgaatgtggatccgctcgatgggaacctgaccccctttggtgcaactagggcgc

SEQ ID NO: 28625 - DNA, 49 bp, Homo sapiens; identical to SEQ ID NO: 7169
  chr3:186080246-186080295
  hyper

SEQ ID NO: 28626 - DNA, 664 bp, Homo sapiens
  chr3:186857050-186857714
  hyper
tgcaagggcctggggcgcgggcggaaaaggcgggcccagctccctcaggtctgcgtgtcaccgacccgaacccgctccgtcgtcctgacgcccccggcctagctgcagccaccttgtcgcaggggccttggtgtctctgagactccgagacgcctcgcccccacctggcgttcggaggcggttgcctcgctgggcgcagcaattcaaccgccgcgcgccggatgctaagaccgcgatttccccggatgctagggcggtgatttcccccgtgacaggccccgccccggccccgcccaggcccgggcggtcccgccccactgagctgtggctcggggagccgtgggtccgactcctgcgtgtgatgtgtcaccaagttgactttggggtcccccattcttccttagttctctattttacctcagcgcgttgtctagctgctgcctggccacggtacttagcacacagcgtgacttaatactggataaacgaggaaaggattcgtacgccctggcggggccagaggctcacagcttgggttcccgcgagcacacgagccaggaaccgccaatgcctccagggggcgctctccctcccatcgagccaccgccgggccattggagaccaggaggacctctcagctccatccctgcgtctctaacaattg

SEQ ID NO: 28627 - DNA, 130 bp, Homo sapiens; identical to SEQ ID NO: 341
  chr3:187387791-187387921
  hyper

SEQ ID NO: 28628 - DNA, 202 bp, Homo sapiens
  chr3:187388006-187388208
  hyper
cgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctctcaaccgtctccctctgttt

SEQ ID NO: 28629 - DNA, 1255 bp, Homo sapiens
  chr3:187455388-187456643
  hyper
cttccagggactgcccgcccctgggcgatccacctcgaagccccccgcaaggcgcgacggaggctttgtggtatgaccgtggcggcccttaatttagttacattcaaataaaacttttggtgcacctcggtagctaacattgtgtgtatgcctttttttttttttttttttttttcctgttacgccgtcaatgcagcaggcaatgaggggaatgacacagccctctcattcccggaacgtagtcaatctcggctctgcggatttcacagaacacactttgcctattgccggctccaacaagaagtaactttccaggaagctgccggccccggcagccgccaggatcgctgcctgcgctgcgctggccgccggggattcacccagggaggcggggccgctggggaaggctcgcggggaatacagcacactttcccctaaatccctcgtccgcgccgagtgcagggctctcagagttcacctagtcccacctctcacccacaacagtttataaatggggaaggtcagacaagttagtagcagagctgggtctagaacccaggagttcgaatacaatccgaggctcatatcgagactttaagttgtccgattccgaagtttatttgcttttttccctctttttgccttccattctccctcacccccgttcttttaggggaatgtttgagcgagacttcaaggtcaaaagatggagtccctaggggctgagggtctccatcataggcgccccaggcaaggttggagaaaaactaaacagaaagccccttccgcctacgttggcaagaacgggaacccagctccacttggtttccgcccaaagtctttagaacaggagctgccaagccgtaaggatttccgaatccgatttccccgaaaccgtagagacacagcttggactcggcaaaggccggggccccgacccctgcgcgcgcactggcactctccaaagttgcctcgccttcctgtggccctcccgggaattataacccccgggtgccatgtcctaattggtctcggtagcaggctccggggtgcgctttcgggggctaggggacagcgaaagactcagccacaaaggccgcagtctggtcctaaaactagccagtggcgtcacactgcgccgctcatcccttctgcggcaagcggaagggtcagagtcggtctgcaaagaacgagcctttggcctcaaaatcctacattgaggctttctcaccccttcgcccggtgggataaaggt

SEQ ID NO: 28630 - DNA, 542 bp, Homo sapiens
  chr3:187457112-187457654
  hyper
agccaactagctgcacggctgcagacaccaccgtggtccggcggcagggggtgaggtcaaatcgcggagctgtttttattcttgggggaaaacactcttcgccctcttggctggggaacgggagggtgcaggagacgacagtaaataaaagcgaatttgataacgcgatggcctcgacagccgctttggataaccgaggtgttcggggacattgtgtcctgactttcatttctatcacgtttcctgccaacagtgctcttgcaagcctgcaagcttctaggaaatgcaataaaacagagggatgtgttttatcatcaagatctgaagaggagttgcagaagggacgttccccatacgctcagcgcgagacagccttccagaagggcccgaagacaatgccagcaaatcgcgtcccggagcagagatccctcggccgtcctggctggactgggctcagcctttgcaaaaaggctggcgggggaggggagaagcatgatctcctcaagcaaacaatgcctttaaaaatccgatctggaaagaag

SEQ ID NO: 28631 - DNA, 329 bp, Homo sapiens
  chr3:189838508-189838837
  hyper
gcgctcccgcatcctccgcctcagagaggcgcgggacggttacgctcgagagggcttcggggcacctcgcgtccgggtcccctctcccaccttccctcggggaagcgcgccgactccgccgcgatctggccgctccgcgagccccaggtgaccgccggcgctccgcgtactgagaggcggaggccgtgcctggccagccgctcttaaagggacgcccacagctcacacgctcctcctgctgcctgagactccgagagccgctctcccaggctccccgctgcagcggcggggctgccaggggcggcacactccagcgccagccagagagc

SEQ ID NO: 28632 - DNA, 39 bp, Homo sapiens
  chr3:190039913-190039952
  hyper
gcagggcagtgctgacgatggcgccgatccatcccagga

SEQ ID NO: 28633 - DNA, 48 bp, Homo sapiens
  chr3:190529604-190529652
  hyper
tgcatctctaataaacgggatggtttcttgcggcggcttttgctagag

SEQ ID NO: 28634 - DNA, 107 bp, Homo sapiens
  chr3:190580805-190580912
  hyper
gacgggcggcgaccccgcagccgggaccgaggcgagggccgggctccctcccgctccacgcgcagcgcggggcagggccgagccgggccgggcgagaagatggtcca

SEQ ID NO: 28635 - DNA, 1 bp, Homo sapiens
  chr3:192125828-192125829
  hyper
c

SEQ ID NO: 28636 - DNA, 483 bp, Homo sapiens
  chr3:192126228-192126711
  hyper
ttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggc

SEQ ID NO: 28637 - DNA, 63 bp, Homo sapiens; identical to SEQ ID NO: 344
  chr3:192126786-192126849
  hyper

SEQ ID NO: 28638 - DNA, 110 bp, Homo sapiens; identical to SEQ ID NO: 345
  chr3:192126850-192126960
  hyper

SEQ ID NO: 28639 - DNA, 412 bp, Homo sapiens
  chr3:192126961-192127373
  hyper
ctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggc

SEQ ID NO: 28640 - DNA, 175 bp, Homo sapiens; identical to SEQ ID NO: 348
  chr3:192127556-192127731
  hyper

SEQ ID NO: 28641 - DNA, 204 bp, Homo sapiens
  chr3:192127936-192128140
  hyper
cgcccaggtggggccgagctgggggccgggcccctggagcgctgggaagcacagcgcgctctagtcaggttccctttcctggagccctccgcttccagactcccttctttcctccctccctcccgccacccctctccctcctctctgtgtcttctgtctctccccttttctcctctctacgcaatcctacgtgattgaggtttg

SEQ ID NO: 28642 - DNA, 201 bp, Homo sapiens
  chr3:192231876-192232077
  hyper
ctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcac

SEQ ID NO: 28643 - DNA, 97 bp, Homo sapiens
  chr3:192232078-192232175
  hyper
agcaacttttcggagacactgaacaactccaagtcgcgcgccgccctcgcaaatcgcagagagggccgcgagaaggtgcgaacgcaggtcacggcca

SEQ ID NO: 28644 - DNA, 245 bp, Homo sapiens
  chr3:192232574-192232819
  hyper
ctccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggagg

SEQ ID NO: 28645 - DNA, 103 bp, Homo sapiens; identical to SEQ ID NO: 7188
  chr3:192232849-192232952
  hyper

SEQ ID NO: 28646 - DNA, 435 bp, Homo sapiens
  chr3:192233094-192233529
  hyper
gcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggc

SEQ ID NO: 28647 - DNA, 30 bp, Homo sapiens
  chr3:192445447-192445477
  hyper
cctccctccccaatacggtcctcagttatc

SEQ ID NO: 28648 - DNA, 136 bp, Homo sapiens
  chr3:192634345-192634481
  hyper
cttcggaatgttgaccgccggccacgcaccgcttgacagccacggatccgctggcggagccgcaagttacaacccaggcgcctggcaaactcacactacacctcagtagcaataatcccaacggcaggacacctgg

SEQ ID NO: 28649 - DNA, 32 bp, Homo sapiens
  chr3:192959076-192959108
  hyper
cgggcgtctcagagccgcggaggggccgccgg

SEQ ID NO: 28650 - DNA, 103 bp, Homo sapiens; identical to SEQ ID NO: 7190
  chr3:193776076-193776179
  hyper

SEQ ID NO: 28651 - DNA, 69 bp, Homo sapiens
  chr3:193776392-193776461
  hyper
ttctccagggccctgcggggtgggctcccatcttcatctcgcaagcatccaacccggggaggtggcttt

SEQ ID NO: 28652 - DNA, 33 bp, Homo sapiens
  chr3:194208225-194208258
  hyper
attctcatatgaccacggactctgcgccccggc

SEQ ID NO: 28653 - DNA, 118 bp, Homo sapiens
  chr3:194208467-194208585
  hyper
cgcgcccggccacctgcagcctctggctgcggccatctttccgcctggggccacctggcctgcgccctttgtgcccggcccgctccgtgactgttcttcttgccgctacttacagaac

SEQ ID NO: 28654 - DNA, 216 bp, Homo sapiens
  chr3:194407566-194407782
  hyper
gaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctggg

SEQ ID NO: 28655 - DNA, 394 bp, Homo sapiens
  chr3:194408375-194408769
  hyper
aacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgc

SEQ ID NO: 28656 - DNA, 281 bp, Homo sapiens
  chr3:194408838-194409119
  hyper
cgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggt

SEQ ID NO: 28657 - DNA, 95 bp, Homo sapiens
  chr3:195474927-195475022
  hyper
tggaactgcagctggcggagggcccggagcccaggtctgcgtggggccgcggcttcctgcgctgttaaccagcggagccccggggactgctgatg

SEQ ID NO: 28658 - DNA, 10 bp, Homo sapiens
  chr3:196255622-196255632
  hyper
gcggtgtcgc

SEQ ID NO: 28659 - DNA, 174 bp, Homo sapiens
  chr3:196366687-196366861
  hyper
ggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcag

SEQ ID NO: 28660 - DNA, 30 bp, Homo sapiens
  chr3:196755999-196756029
  hyper
cccgtcccaccatcccgggccctgactccc

SEQ ID NO: 28661 - DNA, 145 bp, Homo sapiens
  chr3:197183201-197183346
  hyper
cagagaatgtagcatcgtggcagagaggaaaaggaactaagggaagcggaagtatcagtaaggagcctccgacagaaatggtaggctggcaacatcctgatcagcagcagaagtgattttcccgtgtccccgtgtccctgctcac

SEQ ID NO: 28662 - DNA, 131 bp, Homo sapiens
  chr3:197840417-197840548
  hyper
agggaggaagagaggcgggaaagacagaagaaaggcaggggaggcgcgacggggcgagggacggggaggaaagcggtctcccgcctccagggcgggccgagggctgggcccgcggggcgctcacgtccctc

SEQ ID NO: 28663 - DNA, 616 bp, Homo sapiens
  chr4:330715-331331
  hyper
gggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgtataatttcta

SEQ ID NO: 28664 - DNA, 172 bp, Homo sapiens
  chr4:331562-331734
  hyper
cagccagagaggaggcggtggcttccgggatgtggcgcgggtctttgcgtctggctactaccagaccgcgggttaggggcttcatctctctgcgttctcagttgtgggaggccttggtgattcggccacagctcagcctccgtcgctctgtgacctgcgggtattggatgat

SEQ ID NO: 28665 - DNA, 121 bp, Homo sapiens
  chr4:332122-332243
  hyper
tgttcggaatgagatcgaggccccatcaaaacagagttcatgtgagcaaatggggactcattaatgggacagcgccggccgtggctcgtggtttgggggctgccagcgggtcttgaaggaa

SEQ ID NO: 28666 - DNA, 30 bp, Homo sapiens
  chr4:380533-380563
  hyper
tttgggggctgctggcgggtcttaaaggaa

SEQ ID NO: 28667 - DNA, 340 bp, Homo sapiens
  chr4:568313-568653
  hyper
tcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaa

SEQ ID NO: 28668 - DNA, 69 bp, Homo sapiens; identical to SEQ ID NO: 2356
  chr4:569047-569116
  hyper

SEQ ID NO: 28669 - DNA, 162 bp, Homo sapiens; identical to SEQ ID NO: 2357
  chr4:569274-569436
  hyper

SEQ ID NO: 28670 - DNA, 273 bp, Homo sapiens
  chr4:569460-569733
  hyper
cgagcatgaagaccaggacgccgagcagaagcaggttctggctgctcaccggccccggggccccggccgcggcccccgactcgcccggcgtggcctcgggagcgcctgccggcgccgcggggacccccaaacccgggcccggttccgaccccgcgaggggcgcgtcccggggtccgcagcagagcagggcggcgccgagcagtgagaggccggcggccagcagcagcccggagtagaaggcgccggcggcggcccccaggcggaacggctccc

SEQ ID NO: 28671 - DNA, 33 bp, Homo sapiens
  chr4:570224-570257
  hyper
cccgggacgcccctccgcttcctcctcccggag

SEQ ID NO: 28672 - DNA, 203 bp, Homo sapiens; identical to SEQ ID NO: 7201
  chr4:570298-570501
  hyper

SEQ ID NO: 28673 - DNA, 1117 bp, Homo sapiens
  chr4:570836-571953
  hyper
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgagcgtgtgcccgcggttcgggggatgagtaggggcgctgacttttaggaccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagaccccagaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccaga

SEQ ID NO: 28674 - DNA, 108 bp, Homo sapiens
  chr4:779786-779894
  hyper
ggggcggagagcggccgcgtgcggacgcaaatactcacggcggagcgatccgaaccccggagtccgcgtgcaggagggggacccaggccccgccgccctcgccccgcc

SEQ ID NO: 28675 - DNA, 154 bp, Homo sapiens
  chr4:788810-788964
  hyper
ccacctctaaggagccgaggattcgtgctccccgcaggctgcaaagccactaggctcagagggacccgccgcgaacctggggagcgtcacagatgccgcccacgcccccccgcttttcggcccgggtactgcagggaggcgcctccagaaccac

SEQ ID NO: 28676 - DNA, 341 bp, Homo sapiens
  chr4:789169-789510
  hyper
gcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggata

SEQ ID NO: 28677 - DNA, 15 bp, Homo sapiens
  chr4:967602-967617
  hyper
cgggccagacttctc

SEQ ID NO: 28678 - DNA, 36 bp, Homo sapiens
  chr4:967716-967752
  hyper
ggccgcgcaggacgcccccggcgaggggcagcgctg

SEQ ID NO: 28679 - DNA, 119 bp, Homo sapiens
  chr4:995875-995994
  hyper
cggacccgctggtgggctggtccctgccacagccgtggagggcggacgtgacctacgcggccatggtggtgaaggtgggccggcccaacgccctgcgcgccccccggccaccttcctcc

SEQ ID NO: 28680 - DNA, 75 bp, Homo sapiens; identical to SEQ ID NO: 7206
  chr4:996100-996175
  hyper

SEQ ID NO: 28681 - DNA, 44 bp, Homo sapiens; identical to SEQ ID NO: 7207
  chr4:996495-996539
  hyper

SEQ ID NO: 28682 - DNA, 124 bp, Homo sapiens
  chr4:1165449-1165573
  hyper
cgtgagcgccccctgcccccaccgcatccccggaaccgcacaccgcaggcgctcggcaaacattctggtgttagagtctcccgacgtcagcacgccccagactgggaagcgccgccgtgcagct

SEQ ID NO: 28683 - DNA, 307 bp, Homo sapiens
  chr4:1165999-1166306
  hyper
ctcctgcggtgcttccgagacccccatcagcggaatggacggcgcggggttagatcgcccgtgcgcctgcgagcgaccaggggtaacgggcaggttttcagtccgagtccctgcagcttgccgggccggtctgggtgcggcctccgggatgccttcgccgtcgcagggacccggggccttggccgactggctgcccccgggactagacccttaaagctcggtcgcagccagtcctgggggtccctctggaggtgccacaaggttctgggccgcggggaaagtgcaggaggcccgggccctctctggg

SEQ ID NO: 28684 - DNA, 187 bp, Homo sapiens
  chr4:1396406-1396593
  hyper
ctcaaggccaacacccgaggagccttggtccccaccggagaggattcacgggtgggcccggccgggcggagggcggcgcgggagcctgggagaagggggcgcggccgcctgcggtttattgattgagtgaagttccgcaaagtgcttcgcagcgggccgagcccgcgggagccacctgcccggcccc

SEQ ID NO: 28685 - DNA, 103 bp, Homo sapiens
  chr4:1396594-1396697
  hyper
acgcgcatggtcatttataaatttaaaactcttccgtagcaaccggttatgtacagagtcaacgactggaatcgtagaaaacagccgggcccggcagcggcct

SEQ ID NO: 28686 - DNA, 119 bp, Homo sapiens
  chr4:1397376-1397495
  hyper
cgcgccctggcaacccgacccgcgggccccgaggccgccgccgcctccccgcgcctcctccgcgcctcgcgccgcctccgtctcgggcgcttcgtcctcgtcgtcgtcctcgtcgtcgg

SEQ ID NO: 28687 - DNA, 97 bp, Homo sapiens
  chr4:1398277-1398374
  hyper
gggtagggccctgctcggcctcaccaggagggctgggcgggcgtgcaggtcggagtggctccccgcggcctaaaggcccggtcggccgagtctgaac

SEQ ID NO: 28688 - DNA, 72 bp, Homo sapiens; identical to SEQ ID NO: 7212
  chr4:1399065-1399137
  hyper

SEQ ID NO: 28689 - DNA, 30 bp, Homo sapiens
  chr4:1399500-1399530
  hyper
aggcgaaccctggaccggcctcacagccct

SEQ ID NO: 28690 - DNA, 92 bp, Homo sapiens; identical to SEQ ID NO: 7213
  chr4:1400248-1400340
  hyper

SEQ ID NO: 28691 - DNA, 525 bp, Homo sapiens
  chr4:1400997-1401522
  hyper
cgttccgtgggtctcggtcccgcctctctcacttgctcccgcttggggtctccttttgcgtctccagggtctctcttgctcagggtctgtgcccctccatcccttcccacgcccgcccctttcacgtcgtcaaattagggcccgacctggagtgccagcagaggggcggagccggcggtccccgggccgctcattagaagtggaatcgaaaatgagagactgcttgtccctcttaacccgcccccaaaagggggaccgacaaattgcacacacagcaggcggcctacataaaatcgatcctcttcaagtaaggagaaaatgtgtgtttcttccaaaaagaatacgacaaatgcccccttctccacatctggataaataggaagccccgcggcctgagtctttatttgggtacgttttatctacagcggcggtgtttgcaggacagggccctgcggcccgcggccctcggccctcgaggattgggcctggcgtccggagtcccagtgcgggatcgtggtagctccc

SEQ ID NO: 28692 - DNA, 188 bp, Homo sapiens
  chr4:1401642-1401830
  hyper
cgcgtgcaccggcgggtgtgcgcgccgccttacactgcggtccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagccccaggg

SEQ ID NO: 28693 - DNA, 99 bp, Homo sapiens
  chr4:1402294-1402393
  hyper
cgccagcgccagctccgcgctggtgttggttcctctttcactgtttcccgaggaggggcacaccagacactttccagattgctgcgccccctccccagg

SEQ ID NO: 28694 - DNA, 99 bp, Homo sapiens
  chr4:1403967-1404066
  hyper
agtgtttgcctcgtgcgaagtgcactccaccccacacttggccccacagcctcgctgtgcacctccttgcatcggccggacgggggcggggggtgcggg

SEQ ID NO: 28695 - DNA, 411 bp, Homo sapiens
  chr4:1404120-1404531
  hyper
cgcgccacggcgacccatgttgatcaccggagtttgggaagtcagaggggagccctctgctttcaggcctgggttccttctctaagatatgcccacttaggggcctgtgactcctccagaatgagtgtaccacactcgggacaccagaagcgagaggggacacaggctctgacctcgagagcacgtcagctctggagacccgcggccccagcctcgtgtgcctccgcacagggcagcttcagcactgcgaacagcgccagcaccgcggacagcgcgctcccacctcgcccccggaggccacgggctcgggccgtgttcagcaccgcggacagcgccagcaactccgagggtctcctggcctccagcccgccgtctctgacctccctgccccgccctcgactccttctcaaa

SEQ ID NO: 28696 - DNA, 172 bp, Homo sapiens
  chr4:1407948-1408120
  hyper
tgaggaacgctcctgcggaagccttggagagtgattctggcgccaccgcctgcttggggccgcccgcagggagggagtcggggtgggcgcgtgtccgcgggagggagtcggggtgggcgcgtgtccgcgggagggagtcggggtgggcacgtgtccgcgggagggagtcggg

SEQ ID NO: 28697 - DNA, 41 bp, Homo sapiens
  chr4:1515026-1515067
  hyper
ccgggagctgggagccgcggccacatcggtggagcagggcg

SEQ ID NO: 28698 - DNA, 42 bp, Homo sapiens; identical to SEQ ID NO: 7219
  chr4:1811789-1811831
  hyper

SEQ ID NO: 28699 - DNA, 66 bp, Homo sapiens
  chr4:1864167-1864233
  hyper
gtgggcagcaatggccgcgcgccctgctctgggtggtcccgaccccggggaagtccctgtgcagaa

SEQ ID NO: 28700 - DNA, 75 bp, Homo sapiens
  chr4:1864268-1864343
  hyper
cgcggcacccaggcctcgctgtcttccctttcccttcgagggacctcgcgctgcaaaatccgaagagcccggctg

SEQ ID NO: 28701 - DNA, 17 bp, Homo sapiens
  chr4:2042106-2042123
  hyper
tagattgtccgtgggcg

SEQ ID NO: 28702 - DNA, 91 bp, Homo sapiens
  chr4:2042168-2042259
  hyper
cgagcgggcgcagcgtgggaccgaaggggagaaggacgcctgcggcccggcgcgtccccggaggcacgtcccccccagggctccgcggccc

SEQ ID NO: 28703 - DNA, 56 bp, Homo sapiens
  chr4:2042655-2042711
  hyper
gcagtcccagcttgtgccgggaagaccaccggccagaaccccgggggttgggggta

SEQ ID NO: 28704 - DNA, 82 bp, Homo sapiens
  chr4:2043082-2043164
  hyper
tcacgggactgaaatcggcacagagaggccgaggacctgtggtcggggctccgcgcaagcggttctccggtctccgaggaca

SEQ ID NO: 28705 - DNA, 90 bp, Homo sapiens
  chr4:2048818-2048908
  hyper
ttcccctgggctgctcggcggctccccgcgcccctgttcttcctccccacggactcgggctcggggcgttcgcggcgggataggagcgcc

SEQ ID NO: 28706 - DNA, 148 bp, Homo sapiens
  chr4:2060007-2060155
  hyper
cccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccc

SEQ ID NO: 28707 - DNA, 115 bp, Homo sapiens
  chr4:2060173-2060288
  hyper
cggggaagctctgctccggcagccctcggggtggtgctgggaggtcgcgcagaactgaagggggctaggttcgagaagcgccgaggatggggtctgcgaccgcctccccgcacct

SEQ ID NO: 28708 - DNA, 44 bp, Homo sapiens
  chr4:2061725-2061769
  hyper
ccccccgctttctgccgcgccgggccccgcgcagggctggctat

SEQ ID NO: 28709 - DNA, 114 bp, Homo sapiens
  chr4:2061972-2062086
  hyper
ggggaggccgcctcccgctcggtgctaatttatgaggggaagacagccggcgccgcggggggtgcgcgcgcctggcacagccggggcggtcgcagagggcggccccttcagcgt

SEQ ID NO: 28710 - DNA, 107 bp, Homo sapiens
  chr4:2418673-2418780
  hyper
gagccctcaaacctccgtgccgatcttccaaacccacctcccgccttcctggaatgggcgcacgcgaggcacggatttcaggaaacctctgccgtgacagctcaccc

SEQ ID NO: 28711 - DNA, 449 bp, Homo sapiens
  chr4:2765778-2766227
  hyper
tggtatgggaccctccgggtgggcgcggccccgcggggccttgcggccacaccgccaccgtgcccagcggccccatcagcgcatattcaggatgaaccccggacacgcgcccagaaccgtctggtgacccagtgatgaaagctcgaatcttataggatccgtattcatttcccgtgggctcaagcccagcctccgcgggcggcgcgggccctcgcggcgagtgtccacgaggaggcggtgtggacccgcggccccagaccaggcctcaggcagaaggcgagcgcgagcgccccgcccagcccctccccgtcccgcaacccgcgccccgaccagcgcccccagcacctctccaccctcgctctcgagcagtctccacgtttgtctcagaggagacccactttgctccccagcgtgggcccctgagcgctgggggaagttggttggtttgt

SEQ ID NO: 28712 - DNA, 584 bp, Homo sapiens
  chr4:3767309-3767893
  hyper
gcgcgcccccgcctgcgcccatgcctgcgccgggggaggcgaaggaggctccagtcttagaaagagcagcttctggaactcaccacccaggccggccgccgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcaggcggccgcactcgcgcccagcgcagggcggcggcggcggcggcggcgcagctccggcgagcgaggcggcggccgcacggccaagcgtggaccgcggggggcgcccgcgcccgggagcagccggaggactcgcggcggcgccggcgccccgcccgggaaagtaaagttggagacggagggagcgcgcgggcgcgggggcccggaggagcggcggccggcgccccggcgcgccgagccctagccggccggatgggaggcgga

SEQ ID NO: 28713 - DNA, 91 bp, Homo sapiens
  chr4:3768116-3768207
  hyper
cacgctcggcagctgcggggagcccggcagccacgctctccggcgcgccgcccgcggagccaccacggccgagggccggctgctgggcgcc

SEQ ID NO: 28714 - DNA, 111 bp, Homo sapiens
  chr4:3768839-3768950
  hyper
ggccaccatcgtggccgtgtggctcatctcggccgtcatctccttcccgccgctggtctcgctctaccgccagcccgacggcgccgcctacccgcagtgcggcctcaacga

SEQ ID NO: 28715 - DNA, 196 bp, Homo sapiens
  chr4:3768994-3769190
  hyper
cgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccgga

SEQ ID NO: 28716 - DNA, 63 bp, Homo sapiens
  chr4:3769559-3769622
  hyper
cgaggcctgccaggtgcccggcccgctcttcaagttcttcttctggatcggctactgcaacag

SEQ ID NO: 28717 - DNA, 686 bp, Homo sapiens
  chr4:3873083-3873769
  hyper
actggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccccactgccatccaggccgtcgcggcgcggctcgaacactcacagaggaagcacctactgtgcgccaaccctgcgcc

SEQ ID NO: 28718 - DNA, 154 bp, Homo sapiens
  chr4:3882096-3882250
  hyper
gctgcgctgccagggcgctgtcaggatggcgcccagaggacgggctgctgccctggggctgcctgaggagggtccgcagaagttccctctcgagcgggaggaggggatttgcatattcacttagaaggatgaagcgctgcggggaaccttccca

SEQ ID NO: 28719 - DNA, 96 bp, Homo sapiens
  chr4:4145235-4145331
  hyper
ggcggccgagtccagcgggctcggggccaggccggggtcccgcgggcggcgcctcctcctccgcggcgtccccatactcgccctccgcgtcgctct

SEQ ID NO: 28720 - DNA, 46 bp, Homo sapiens
  chr4:4145386-4145432
  hyper
cgggatgtggggctagcgcggggccatgccccgccgcagcttctgc

SEQ ID NO: 28721 - DNA, 84 bp, Homo sapiens; identical to SEQ ID NO: 7234
  chr4:4228084-4228168
  hyper

SEQ ID NO: 28722 - DNA, 87 bp, Homo sapiens; identical to SEQ ID NO: 7235
  chr4:4228188-4228275
  hyper

SEQ ID NO: 28723 - DNA, 253 bp, Homo sapiens
  chr4:4229644-4229897
  hyper
ctgccctgttgctaccggcgcccaagcgtcttcactagccccttccaaagccccggtgcccgcctggcacccgcctgctcccggaaggggactgagtctgccagggagccccgctcgggtgccgctaagtggaggtctgggaagtttcagctgaagagcgttctacgggtctggcgtggctgacaggaggcgccggaccccagccccccagccgcaggttggagaggggagttgggagcgagcctggggcaag

SEQ ID NO: 28724 - DNA, 1045 bp, Homo sapiens
  chr4:4387460-4388505
  hyper
gtcacctgtcaaagacggctagccctcctggggattttgaaatcagggcacccgcggcaagttcccaggctgtgcctggggctcaaggcggtggctgctcctgtgctctgggcttattcccaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggc

SEQ ID NO: 28725 - DNA, 505 bp, Homo sapiens
  chr4:4388506-4389011
  hyper
cagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggtgagtgcggccggccgcgcctgggcttgccgaggccagaccttgcccgcccaggagcagtgcccgggggatgcccatctcccggagtacgcgggacggggctgtgaacag

SEQ ID NO: 28726 - DNA, 35 bp, Homo sapiens
  chr4:4389262-4389297
  hyper
tgcccacttcccccccgccccgccccgggtcttgc

SEQ ID NO: 28727 - DNA, 30 bp, Homo sapiens
  chr4:4854402-4854432
  hyper
ctgcctgcgggttcccggtgaccctttccc

SEQ ID NO: 28728 - DNA, 523 bp, Homo sapiens
  chr4:4854669-4855192
  hyper
ctctcctgcctgggccgacccggcgctttactgcttctcacgaaggtgcgccggctgctccagaaatcgcagactgcctccaggaagaacttgctggagtcacagcagcttctcagcgacttgacagcagtgattcagacttcaacttgggcggaggggcgggggaggagaaagagatttccagagaaaacgactgagcggtagggaggggaagagagaccgagccacgcgcctcgagaagcagtgcagagagcggaagagacagaggctgcgagacctacccacagagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactcccacacaccaggctgtccgcgggccgccttgtcacagaaaggcagctccccagccccgcagagtcccgacagctgcccccgcgaaggtgggg

SEQ ID NO: 28729 - DNA, 413 bp, Homo sapiens
  chr4:4855230-4855643
  hyper
cgcccctcctttccagcctcagctctggcctttctcggcatccccagcttgccttcagtttcactccatatctgggtctctcagaggcctcgggaggtcttccgttctctctgtcgccgtgtccacggaaggagcctccccaaccctctgtggctccgcgcctcttgggccggagcatctctgtcttccggagtctcttgatcattgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggag

SEQ ID NO: 28730 - DNA, 171 bp, Homo sapiens
  chr4:4858696-4858867
  hyper
tctgcctattaggcgcgctgaggaatcgtgacacattgtttatccccgcaattagcgatgcggcccttttcaggccgcccgcccccgggccccccgcccccccccccccccccgcggcggagtccaggccttgctgcgctcctcaactgcgaccgccgcaagttccacact

SEQ ID NO: 28731 - DNA, 226 bp, Homo sapiens
  chr4:4861342-4861568
  hyper
ccgccccgctggcctcgccttattagcaagttctctggggagccgcggtagggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcc

SEQ ID NO: 28732 - DNA, 183 bp, Homo sapiens
  chr4:4861780-4861963
  hyper
ccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgc

SEQ ID NO: 28733 - DNA, 280 bp, Homo sapiens
  chr4:4862165-4862445
  hyper
gctcctggtggcctccggcgcctgcgtacctgcagccggtgctagggagccgtgggctgcaaggccgggtcttgcgcctccctccactcccacccaggaagaaggttccagacctcctcgccttggcccagagacgctgcgggtgggagttaacggataggacaccgatgtctgggcaccctgtcctcctgcccccaccaaacgacctcaggggtccatgatccctcatctgatcccaaactctgtttcatcggcttcaccccagcggatgaatgtgtgt

SEQ ID NO: 28734 - DNA, 311 bp, Homo sapiens
  chr4:4862799-4863110
  hyper
tctactcagagaacacgctcggagatatttcaggagcacgggaaattcccaagttttcctcgtttcctccgattattttgctcggcataatagcagccagatttcaatggcgtgatgctgaggaatgatttttatctggggattaaacgtctttgaaaggccagtccctccctaagcctaatggccggagaaggtggccccgctctgggttgtcgccgctgaagggagtgacgtttctctcggcgcccgcccctcgggcggcccggcggaaagctagttgggggccaagcgcttcccggactcccggtggc

SEQ ID NO: 28735 - DNA, 185 bp, Homo sapiens
  chr4:4867591-4867776
  hyper
agagcaacataattgcggtaatgagcaacggctcaccctctgcagacgcgtcgcggctccagcgaggcggtagctgcaggcgaggcgggcgcgcctccccgccccctccctgcgccgcagcccgggtgcgagggcccggcctccctgggaccccggcccgcgcgcgcctccgcctctggctgctg

SEQ ID NO: 28736 - DNA, 30 bp, Homo sapiens; identical to SEQ ID NO: 7247
  chr4:4868050-4868080
  hyper

SEQ ID NO: 28737 - DNA, 248 bp, Homo sapiens
  chr4:4868545-4868793
  hyper
ataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacct

SEQ ID NO: 28738 - DNA, 172 bp, Homo sapiens; identical to SEQ ID NO: 2363
  chr4:4868828-4869000
  hyper

SEQ ID NO: 28739 - DNA, 127 bp, Homo sapiens; identical to SEQ ID NO: 2364
  chr4:4869131-4869258
  hyper

SEQ ID NO: 28740 - DNA, 61 bp, Homo sapiens
  chr4:4870173-4870234
  hyper
aatcgcctgagggaacgctgggagttcccccccccacccgcccccgcgcaagaacagccag

SEQ ID NO: 28741 - DNA, 44 bp, Homo sapiens
  chr4:4871340-4871384
  hyper
tctagtgctttgagtcgctgtttctctgacgatgctgcttttaa

SEQ ID NO: 28742 - DNA, 149 bp, Homo sapiens
  chr4:4871883-4872032
  hyper
tccaactcagacagccggtgccaccatctggcgcccctaaatctcagttccctggtccgcggaatgggaacactttcgggctggtgcagaggaaactatgggtgactccaaaggcagcgcgcggtaagaactccgggtgagaaggggag

SEQ ID NO: 28743 - DNA, 108 bp, Homo sapiens
  chr4:4872059-4872167
  hyper
cggagcatagaggcaggatggtgacctgagcgctctttgctggccggctctgctctccgcagcgccattggaattccttactctccagtcccccgagggtgtgtgtgg

SEQ ID NO: 28744 - DNA, 97 bp, Homo sapiens
  chr4:4873139-4873236
  hyper
cgaggtagaaggggccgcgtgcccttgtaggagagggaagtgtcaatggccgggaccaggggtggctgcctgagacgtgcctcgtctttggtgattc

SEQ ID NO: 28745 - DNA, 1184 bp, Homo sapiens
  chr4:5052921-5054105
  hyper
ctacctctagacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgcagggaccgagctcccggccgagggaggagggccgagcagggattcagattcttccgggccgatccctttctcagctccttccgccctgccgccgcccactgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacccaggcatggccacttcgcccagcgaatgcagtgtgtgcccgacccgtgccaggcgcggcgcttctgctgaggcaactcctaggtacccagtgccgtttagtagtcgggacggtgcctagcgcgggactggggaggcggcttcagagagttgaacccgaaacctgcacttgggggtgtggaagggaggagttgacttcggaggccagtcgggatggttctaggctcgggctccccaggaaaccgaggtttccttgagagcctgaggctgacggaggtggcctggaagggcgggttgcaccgtgtgtctgtgtgtgtgtgcgcgtgcccacgacgcatttggtctcgtgcaagggcctgt

SEQ ID NO: 28746 - DNA, 79 bp, Homo sapiens; identical to SEQ ID NO: 7255
  chr4:5709906-5709985
  hyper

SEQ ID NO: 28747 - DNA, 341 bp, Homo sapiens
  chr4:5712891-5713232
  hyper
gctgaaagttttgagcggtgatccaggctcctccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcct

SEQ ID NO: 28748 - DNA, 1490 bp, Homo sapiens
  chr4:5889116-5890606
  hyper
tgggctccagtggtccgcatccctcaggaacagtcaggctccacgctgatgccaggcaggaactggggcggagggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcgggaacattaacccttcccgggccgcagccgccagcgtcgccccattaggttatttttagctgcggggaggggtggaccgagcttccatcatggcgctgtccctaggtccggacttccactccatcagtaaaggcggggagtggggagcgctggatgatctttttccctcctccagcgggggaggtaccgggctgtggggtgcatgggccggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggccgcttaccgtgatgtgcgggatgctcttcttgccctggtacgacatggccccctctggcgccctcggcccggccgctgacctgcggggctgtctgactggaaccggcgctctcggccccgctcccagcgggcgcgctgacaaaggcccgggagggatagagacacggacggaggctcggcgcccgtggatgcccacgcgcggctgccccggctgctcggcccgcccgccgccgctccggctgccagcaccgcccggatcggcgaggagggcgggagaaggaggagggagaggcgagggcgggaggagggggctgcagacagctcctcccggcggcgcggagcgaagccggattcgcccctctcggctcgaaccaggaagcgcttcccttccgatctcccaccccgccccccgccccccacccgcccagccccgccgacccccgccctgcgcacacgcccttggcgggccctggcctcgctctcgcgatccagagagtatggttttcagggctcctttaaaagaaaaagacggcgcggtcagggcccgcgggcggcgccacaggtgtgtggccgcgcgtctggaggcctccccggaacatctgcgggggtgtggggggagggagtgtgggacgggggccaaggatcggcccaagctgctg

SEQ ID NO: 28749 - DNA, 116 bp, Homo sapiens; identical to SEQ ID NO: 2367
  chr4:5891966-5892082
  hyper

SEQ ID NO: 28750 - DNA, 120 bp, Homo sapiens
  chr4:5892109-5892229
  hyper
cgcagaaacccctcctgcagcccagggagaagcctggtgggcggggggggaagggccggggcacccgttgcgaagccctggagcggtgaggcccgccccggaacccgagcccactgtaac

SEQ ID NO: 28751 - DNA, 30 bp, Homo sapiens
  chr4:5892597-5892627
  hyper
cctagtactccaccacgctttgaggaaggc

SEQ ID NO: 28752 - DNA, 237 bp, Homo sapiens
  chr4:5893517-5893754
  hyper
tcaagagagaatacccgcagggcccaagccctagcgttccctctccctgatcctcccggccccatgctcaggtccgggaggccagagaccccagttcaaatcccagctctacctccaccttgctctgtgaagcaggcacatcggtgtgtgctgtggagctcaggagtgccccttgaatctactggcgcttgagggtaggggtttacggctccaactgcccgacgaactaaatcctta

SEQ ID NO: 28753 - DNA, 102 bp, Homo sapiens
  chr4:5893981-5894083
  hyper
ccagaggttccttcgcgtttaagcgtccatgcggtagctttagccaacttcccctctcagaacctctctccctttctgtagaagaggagccgggactggacc

SEQ ID NO: 28754 - DNA, 300 bp, Homo sapiens
  chr4:5894812-5895112
  hyper
cggcccagggaggggaggggcggggcgtggcgcgcgccggggcggggccggggcggggcctctgggcggctgcgggctagcggcgcggccagctacaaaggaccaggaggcggggatcgcggctggggcggggagggacggtgacgctcccgagccgcagcgcggagggcgggccgcggcaccgcagtgccctcgccgcaccccccactctccgcccccaggcggagcgcagggcgcgaggagagcgcggggcaggagccgtgtgcgtacactcgcgcgcccacacgctctggaggcaca

SEQ ID NO: 28755 - DNA, 465 bp, Homo sapiens
  chr4:6200828-6201293
  hyper
cagctgaagttagggcgttcgcggagagagcacagcactggcaaaggccaaggacagtgtgcctgcgagtgtgcgcagatggggcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgc

SEQ ID NO: 28756 - DNA, 299 bp, Homo sapiens
  chr4:6201349-6201648
  hyper
cggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaa

SEQ ID NO: 28757 - DNA, 763 bp, Homo sapiens
  chr4:6201895-6202658
  hyper
gccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggg

SEQ ID NO: 28758 - DNA, 73 bp, Homo sapiens
  chr4:6223724-6223797
  hyper
cagccccgggctgctcggaaaggccggagtccggagcacagcaacgcgcggagcggcccggcccctctggtgg

SEQ ID NO: 28759 - DNA, 35 bp, Homo sapiens
  chr4:6224121-6224156
  hyper
gtgctgaaggagccacgccccgggctccggagcct

SEQ ID NO: 28760 - DNA, 518 bp, Homo sapiens
  chr4:6247199-6247717
  hyper
ctcgggtgtgggggtcgcccgcgctcctgggagccgagcaagggcgcgcaccccgcagtgggagaggggcttcctgcgcagcgcgggaggagcttccaggacgggagctgtctggggcagagccctggctacggtggcctcgcagcacagcgaaagcacagggactgcgcagtcgggaggcgcttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 28761 - DNA, 30 bp, Homo sapiens
  chr4:6472398-6472428
  hyper
gcagaaaccacatcccggacccacgctgat

SEQ ID NO: 28762 - DNA, 100 bp, Homo sapiens
  chr4:6472882-6472982
  hyper
actggggcacccacccggggaatccgcgcacacttctgcggccgggccgccagcccgtgggttagcggctgacagtccccgcactcgggcagggctccag

SEQ ID NO: 28763 - DNA, 172 bp, Homo sapiens
  chr4:6473792-6473964
  hyper
acatcgcgcggtccaaaccttcggagggcattcggtgcgacggcatccccacgccgcggccggccggaggggtctcagacaacacgtacgttaccttcagtcacatagctgtggtcccgcaggaagctgtggttaattttccgcgtgtccgtgtcctcgcccattgaaggcc

SEQ ID NO: 28764 - DNA, 277 bp, Homo sapiens; identical to SEQ ID NO: 7269
  chr4:6473965-6474242
  hyper

SEQ ID NO: 28765 - DNA, 40 bp, Homo sapiens
  chr4:6474447-6474487
  hyper
ctgcaccgccgtgctcgggccctcgcggtgggcaccttgg

SEQ ID NO: 28766 - DNA, 136 bp, Homo sapiens
  chr4:6564642-6564778
  hyper
tcttcgggctctgggcgcgccactgtcatggactgtccctgccagccaaaaaaaaaaaaaaaaggcttctccaaaccagagcagcagccgggcctgactcagcacccaccggcgcgggcagcgggaggagcgcgta

SEQ ID NO: 28767 - DNA, 97 bp, Homo sapiens
  chr4:6565004-6565101
  hyper
gttccctcaagaccccgagagcacgcgctccggagggaccccggcacttcggaccctagcagagccagccctgccccaggaccgccccggggtcggt

SEQ ID NO: 28768 - DNA, 161 bp, Homo sapiens
  chr4:7194377-7194538
  hyper
cgcaccgggggccctcgcgcgcctcgaagggccccggccccaccgcccgagccccgagccccggggctccgccgccgccgcgctcgccgcgctcgcggccgctcctgctgctgctgctgctgctgggcgcctgcggggcggcggggcgctcccctgagccc

SEQ ID NO: 28769 - DNA, 93 bp, Homo sapiens
  chr4:7194789-7194882
  hyper
cgtgctcaagggggacgcgacgcacaaccaggcgatggtgcactggacgggcgagaacagcagcgtaagtgacctccacgcgctcgccgcggc

SEQ ID NO: 28770 - DNA, 30 bp, Homo sapiens; identical to SEQ ID NO: 7272
  chr4:7195153-7195183
  hyper

SEQ ID NO: 28771 - DNA, 30 bp, Homo sapiens
  chr4:7195419-7195449
  hyper
ttgagctcttgctgccggtcgccccgcctg

SEQ ID NO: 28772 - DNA, 290 bp, Homo sapiens
  chr4:8201139-8201429
  hyper
gggctccggggcaggcggggcgtggactggccgagcaggctgctgtctgccagtcttgccatggttggatctttacactttcttgaggacttttctgacctgtttgggatgggggtggagcgaaactgcgagctgggggcctcggggaggtcgtcggcaccctcagcagaccccactcagagctcacaggtgctggcagtgccaatccgcagtgattgagggcaatgatttcagctttgaccaagcacccttgcttctgggacctggcctgaccccgtgctggcccttgg

SEQ ID NO: 28773 - DNA, 289 bp, Homo sapiens
  chr4:8271325-8271614
  hyper
agtcccaaggcctgccgggtgggtccaggcccggaaggccaggcggggccctgtcggggcctgggcggggctggcggaggggccgggccgccccttccagcgagggcgggctgggcggtcgcctttaaaggcgcgggacccgccgcccgcggaccgtcaggctggagggagctggtccctgcgctccctgcgccctggggatgcccctgccgccctgacgcccgccagcctgagccaccggcgcatgtgaccgcgcgtccgccccagtcccatccgtaggcgcccggcg

SEQ ID NO: 28774 - DNA, 70 bp, Homo sapiens
  chr4:8582115-8582185
  hyper
tataagccaccaggtcgctccagtttggtgccagcgcctggagggagaggcgtggcgagggctgtgctgc

SEQ ID NO: 28775 - DNA, 39 bp, Homo sapiens
  chr4:8594420-8594459
  hyper
actgtaacccgactccggcatttgcgtttggggcgccct

SEQ ID NO: 28776 - DNA, 137 bp, Homo sapiens
  chr4:8690019-8690156
  hyper
tatttggttctttcccgtcccttccccggaggcctggcctgcagctccccgcaaggccactgcgtggcgccctgtaccccaggcgggacggccggcgccgagcccaggattcgtccacgcctcgcgcagtggagctt

SEQ ID NO: 28777 - DNA, 254 bp, Homo sapiens
  chr4:8858794-8859048
  hyper
gcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggt

SEQ ID NO: 28778 - DNA, 557 bp, Homo sapiens; identical to SEQ ID NO: 351
  chr4:8859381-8859938
  hyper

SEQ ID NO: 28779 - DNA, 108 bp, Homo sapiens
  chr4:8860445-8860553
  hyper
ctgagctccaggcaacgaaaaacgaaggtcctggagtcggtcctgagtgcattcctccactgggccccgtcgagaatgaaactctcggagcatcgtcactgggaggtc

SEQ ID NO: 28780 - DNA, 98 bp, Homo sapiens
  chr4:8861448-8861546
  hyper
agtcgcactgggacccgaatgaggacatccccccgccccttcgtcatcgtgggaataccgtggaacaaggcgggcaaagggctgatcagctcccgtcc

SEQ ID NO: 28781 - DNA, 148 bp, Homo sapiens
  chr4:8861605-8861753
  hyper
cgggcagtggcccacggctctgggcccggatctgtgtccacctctggatacccaattcccgccaccatgttgttgggagcaaggaggcacaactgcccgtggtgggagtggagggcttaggtccccattagaaccggcagagccccga

SEQ ID NO: 28782 - DNA, 265 bp, Homo sapiens
  chr4:8861918-8862183
  hyper
cgccaaatggaagtgggggcgccccctggcctttcctatacccggggccaaaaccgctgggaccgatatactgcaggagtccgggcacaggctgaggggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaaga

SEQ ID NO: 28783 - DNA, 419 bp, Homo sapiens
  chr4:8862393-8862812
  hyper
ctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtc

SEQ ID NO: 28784 - DNA, 197 bp, Homo sapiens
  chr4:8863330-8863527
  hyper
ggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcgggg

SEQ ID NO: 28785 - DNA, 79 bp, Homo sapiens
  chr4:8863856-8863935
  hyper
ggaggccgggaaagctgcgtggaaaagaggaagggttaagactgaaatcattctacagagaccacgttaatgggtttaa

SEQ ID NO: 28786 - DNA, 90 bp, Homo sapiens
  chr4:8864526-8864616
  hyper
cgtttgctccccaggcggtgaggctggctcttcgaccacttagctgttctcggcgcccgatcctgtgtgtccttccgtgcatgacacgca

SEQ ID NO: 28787 - DNA, 190 bp, Homo sapiens
  chr4:8864930-8865120
  hyper
gcgggtggaggagggcgccggggagcctcagtgccaccgtgctccagaattcctgcccctctcagaaccccggtttccctttccaacaagttgcaaggtggggcggaaggccacgaaagactcttgggggagaggcactgacagaaagggaaagagaagcccacccggcctctcccgcctccctggtgct

SEQ ID NO: 28788 - DNA, 136 bp, Homo sapiens
  chr4:8868710-8868846
  hyper
agggacggcacccagcgcagcttgagctgtctctgccctcgtgatcacaaagcagtgaaactgtccagaaaatgtccctttttattccatacgcaaataagtagattcatttaaaaaaacaacaacccggaggctg

SEQ ID NO: 28789 - DNA, 340 bp, Homo sapiens
  chr4:8868931-8869271
  hyper
cgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcc

SEQ ID NO: 28790 - DNA, 477 bp, Homo sapiens
  chr4:8869368-8869845
  hyper
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtg

SEQ ID NO: 28791 - DNA, 30 bp, Homo sapiens
  chr4:8870046-8870076
  hyper
gtctccggtgagtcccggtcgctggctgca

SEQ ID NO: 28792 - DNA, 349 bp, Homo sapiens
  chr4:8872724-8873073
  hyper
cctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcc

SEQ ID NO: 28793 - DNA, 211 bp, Homo sapiens; identical to SEQ ID NO: 7286
  chr4:8873773-8873984
  hyper

SEQ ID NO: 28794 - DNA, 59 bp, Homo sapiens; identical to SEQ ID NO: 7287
  chr4:8874476-8874535
  hyper

SEQ ID NO: 28795 - DNA, 172 bp, Homo sapiens
  chr4:8875756-8875928
  hyper
ctggccaccaccaggcgggtggtggccctgagcgcataacgctcgcgggtgtcttcccactgcctctggggggcgcgcatgagaggggcgcttccacacactgccgcgtggggcctgggatgggagcgaagaggggcggtggatccgaagcgaggaccgtgcacccttttcc

SEQ ID NO: 28796 - DNA, 128 bp, Homo sapiens
  chr4:8878547-8878675
  hyper
gtctcgagacattctcgttgtcttagtctgatccccacgtcgcagccagcaggaaatgtccttgcagctgtggagatgtggatcggaactagggcacctcactccagctcagccgctggcccactaag

SEQ ID NO: 28797 - DNA, 103 bp, Homo sapiens
  chr4:8879491-8879594
  hyper
cctggagcctggaaccgccggggccagctgagaagccgcctccgccgctggagtccctgggaagggtcccctccacctgcccacagccagcctgggaggcaga

SEQ ID NO: 28798 - DNA, 61 bp, Homo sapiens
  chr4:8893403-8893464
  hyper
gctccatcctatccgcggacagaaacgaatccgagccgcagctgcacgtttgaaccccgca

SEQ ID NO: 28799 - DNA, 216 bp, Homo sapiens
  chr4:8893815-8894031
  hyper
cgaagctgcgagttgtctcgggccctcccggagctgcgggcggctcctcgagaaactcagagagcccaggcgcaccacgggccagccaggacatccccaggcggccctgttagccccattttatggaggaagactgaggctttgggttgcatgggacccgcggttaccccgcaaacacagacgcttacgaagacgctatcgcgagccgaacagtct

SEQ ID NO: 28800 - DNA, 317 bp, Homo sapiens
  chr4:8894641-8894958
  hyper
ggaaacgcctgcctccggtcggtctagcgcggcgtgtgcgagtgcagcccccgcggggacgtgggcaccaacagcaggcgagtgactaccgcggcgcagttcccgaggacccagcgcctctcccgaggccaccctcccgggcaggaattactgtctgccggcccgaagccgccaccccacccgccgccctgtttcaaagttggggagagtccatgccgcgacggagcgagcagacttggacatggtcgagtgcctggtgcgcacgattggtcttaagagtttagggaaaaaagcacgcggggaaaccacgcggggcc

SEQ ID NO: 28801 - DNA, 353 bp, Homo sapiens
  chr4:8895231-8895584
  hyper
cgcccgcgctaccttcctgccctgtggcctacctgggtcccccttacacctctgctcggtgcagccctgagcctcggtttcccagacggcgcagctgaggctctcgaggtgacgagaggctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctggcaggcagacacgctgcgccactggggacaa

SEQ ID NO: 28802 - DNA, 134 bp, Homo sapiens; identical to SEQ ID NO: 2375
  chr4:8895964-8896098
  hyper

SEQ ID NO: 28803 - DNA, 205 bp, Homo sapiens; identical to SEQ ID NO: 2376
  chr4:8896117-8896322
  hyper

SEQ ID NO: 28804 - DNA, 40 bp, Homo sapiens
  chr4:9499335-9499375
  hyper
taggcggggaaggtgcggggcgaggcggccgcgggtccct

SEQ ID NO: 28805 - DNA, 113 bp, Homo sapiens
  chr4:9499921-9500034
  hyper
ccaagcacagtggttcgaaaatacagctgaaaccctgcgggcccttagcaggcgccccagcgccggagcagggtcagggtcttcttgcgacccggccccgctccagatccccc

SEQ ID NO: 28806 - DNA, 15 bp, Homo sapiens
  chr4:9783081-9783096
  hyper
gggactagggtctgg

SEQ ID NO: 28807 - DNA, 265 bp, Homo sapiens
  chr4:9783125-9783390
  hyper
cgcccctacactctggcgcgctgagggcggtgagcgagggcgccaaggcacaggtggggcgggagtcgagcgcggaggctcggggggcgggacgcggggcctgggagcggccagggaccgcggcagcgcctcagtgccagcctggcgcccgcgactgcctgccccagcccctcagtggcggcttgctctcttctctcgctccgaaccagacacagccgctgccgctgccgtccggcgcgctacagactcccgagaacagccctgg

SEQ ID NO: 28808 - DNA, 873 bp, Homo sapiens
  chr4:10458378-10459251
  hyper
aaccaaaaccgtcaacgctcagctccgaggcccgcaggaggctttaaaaatggcctcctgacgacacttcctgctcggcgcggacggtaggagccctcggaggaggcatccttcataacgctgggggcggggagcgcaggccgggccagcggcgccacacgaacggccccgcgggacgctgccacccccgcctcggtcgccccggcgcgtcggccgagtccgcggggtcgcggcgcacaaaggcgagctgggggcgccgggccggaccccgaccctaggccaggcccgcgtacctgctcaacgcgcgccaagccgcggcccgggcccccaccccagccggtgccccacgcccaccagccggagcccgcgttcggcctacccggtgccacttgccacgacgccagccctcagcgcgggcacgcggggccgcggccgctcgacccgccccggcctggccccgtcaggcccccgccccgcgcgcccccacgacccggccgcagctggcgcttcggtcacgtacacgcggatccgggggccctcgccctcccgctcagctacttacccggcaggccggattcgggtgccaggtcccggcgaaggggcgtctacaccgccggccgcagaccgccggcgccgcgcccgctgtaggtccctacccggggggcggagcccgcgccagccccgcgcgtgcgcaatgtgaagcggcggcgcggctccagcgaggccggcgcctgaggtctctaaggctgcgcccgcccccgccgggcttctaagctgtccagagcggggagcctcagacccagccgagccccacttctgggcttagagcttgacccaacacgttcgcaccgtagcgagcgaggtccacattta

SEQ ID NO: 28809 - DNA, 273 bp, Homo sapiens; identical to SEQ ID NO: 354
  chr4:10462775-10463048
  hyper

SEQ ID NO: 28810 - DNA, 184 bp, Homo sapiens; identical to SEQ ID NO: 355
  chr4:10463072-10463256
  hyper

SEQ ID NO: 28811 - DNA, 280 bp, Homo sapiens; identical to SEQ ID NO: 356
  chr4:10463257-10463537
  hyper

SEQ ID NO: 28812 - DNA, 111 bp, Homo sapiens
  chr4:11429592-11429703
  hyper
gagctggggtctaggcgttccaaccgcgggttcgcaccccgccatccctcacctccatccgctgccactacccaagggcccggaaatagaaaaccacgaagggggaaaaaa

SEQ ID NO: 28813 - DNA, 304 bp, Homo sapiens
  chr4:13523948-13524252
  hyper
tccctaccttcctcccgagggagaggcagagcctctagctccatttcagacctgcaaggaaagggctttgagaagggaactggggagaagcacgttccaggtgtgggttcagctcggcactcgccacaggcctccgcaggtggctctccttggcagcgaggcaaggcgcaaacccgctggcttgggaagcctgacgtgacccccgcccgccaagcctggcaggaagcgacgccggggttctccgcaagaagaaggcggcctccgggtgtcggccgcagccaggctactgtgctccggggcaaac

SEQ ID NO: 28814 - DNA, 37 bp, Homo sapiens
  chr4:13529606-13529643
  hyper
acaacatcctctcagcgctcaacgccccccatcactc

SEQ ID NO: 28815 - DNA, 68 bp, Homo sapiens
  chr4:13530912-13530980
  hyper
agcacagcttcgctgcggcggggaaggaggaccgtcgggcccagagttcccgccgccacatatggtct

SEQ ID NO: 28816 - DNA, 84 bp, Homo sapiens
  chr4:13537658-13537742
  hyper
aaccgcaactgctggcggcaccagggactgcgagcaggggcatggagtgggagggaaagctgaggagagcgggctttgagcctg

SEQ ID NO: 28817 - DNA, 30 bp, Homo sapiens
  chr4:13539344-13539374
  hyper
agcctttctgtaaagcgagttaaacttcgt

SEQ ID NO: 28818 - DNA, 43 bp, Homo sapiens
  chr4:13541880-13541923
  hyper
agccccaattgcacccgtccgaggaaaacgctcgggtgaccct

SEQ ID NO: 28819 - DNA, 121 bp, Homo sapiens
  chr4:13545940-13546061
  hyper
cgcccctctggcgcggccagcccgccgcgctcctctttcttgttgaggatcgcctggatggagaaggacgtcaaggtgttggcgccgcgcacagccatctgcgccgcgggcaggagcggcc

SEQ ID NO: 28820 - DNA, 240 bp, Homo sapiens
  chr4:13546362-13546602
  hyper
gtgaaggaggattggcgggggcccctccgtggcagcagtcccctcccgagcgccgccggggcgcacagcccgagtcactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaactttttta

SEQ ID NO: 28821 - DNA, 88 bp, Homo sapiens
  chr4:13548502-13548590
  hyper
aaagatgtggtttggcgactttgagttgtcgggtatttttgtgtcccaggagtgtgagaaaggggctacgttccgcgtcttccggagg

SEQ ID NO: 28822 - DNA, 1001 bp, Homo sapiens
  chr4:13548634-13549635
  hyper
cgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcgggcggcgggcggagagcgggatttgactgcgaaagccaagggggcggggaaggggaagccccggccctcgggggcgcgcagtaaactgctgcacacgtgcccgcgctcccgaggggggcgcccagtgggctcgggatttcctggctgcgccaccgcgcgcctcgcccccgacgcccgccacctgtgccctgggccgccttccctgacgccagcggccggaggtcgcgcgcgccgggtgctgcccagcaacgaaaggccatgcggggttcgtccctcagatgccggtgaccttgattg

SEQ ID NO: 28823 - DNA, 516 bp, Homo sapiens
  chr4:15780044-15780560
  hyper
actgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgaggtgggttggcgactaaggcgcaccggtgggcactgcggggacagcagggccccgcgcgcagggaagccgcccggatcgcccggaaccgggcatcttccgtggcgggtcagccgagagcccgccgggtggtgctgagtagggagtcccgggctcggggctccgcgggccgctttcaggagcagctggccttggcaccgagcgtgcccgcgggaggcgggggggggcgctgctcggtggctctgctgcgtagccggtgaacacttggcaccgatgcccgccttctgggcaag

SEQ ID NO: 28824 - DNA, 48 bp, Homo sapiens
  chr4:16083930-16083978
  hyper
ttcaacccaacatatcgcagcggttgttcgtgtcgcatgagtctcggg

SEQ ID NO: 28825 - DNA, 60 bp, Homo sapiens; identical to SEQ ID NO: 7312
  chr4:16084408-16084468
  hyper

SEQ ID NO: 28826 - DNA, 78 bp, Homo sapiens; identical to SEQ ID NO: 2384
  chr4:16084741-16084819
  hyper

SEQ ID NO: 28827 - DNA, 14 bp, Homo sapiens
  chr4:16085166-16085180
  hyper
cgcagagcgaaccc

SEQ ID NO: 28828 - DNA, 121 bp, Homo sapiens; identical to SEQ ID NO: 2386
  chr4:16085181-16085302
  hyper

SEQ ID NO: 28829 - DNA, 251 bp, Homo sapiens
  chr4:16085351-16085602
  hyper
cgccagaccctggctcgtgaattatttatgacccggcttctgggaccaccgcgacggctttcggagagcccgcctcccactgccggccgcggaggggctcaggcggcgctgcggccggaccctcggacgtggcgggaggcaggagaaaggcccgggtgcccggggggacccgttgcggcttcctctgtcccggacggggacctaggtatggggccgccgtaatggaaaggattccttaaacatactcaccg

SEQ ID NO: 28830 - DNA, 26 bp, Homo sapiens
  chr4:16085674-16085700
  hyper
cgagccctggacgcactctgattgga

SEQ ID NO: 28831 - DNA, 30 bp, Homo sapiens
  chr4:17326218-17326248
  hyper
atttttctccccccccgcagaaaagaaact

SEQ ID NO: 28832 - DNA, 356 bp, Homo sapiens
  chr4:17782938-17783294
  hyper
gcactcagactctctcgttttctccctgcccaccgtgtgcacgtgcgtgcgcgcgcgggcgtgcgagcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgc

SEQ ID NO: 28833 - DNA, 27 bp, Homo sapiens
  chr4:17783295-17783322
  hyper
gtgggcgggcactgcgctcttggacac

SEQ ID NO: 28834 - DNA, 158 bp, Homo sapiens; identical to SEQ ID NO: 2390
  chr4:17783323-17783481
  hyper

SEQ ID NO: 28835 - DNA, 275 bp, Homo sapiens
  chr4:20253687-20253962
  hyper
gcaggccgaagctgccgcgctttctgggcacggcgggagtgctgagcagaaaggggagcgccgggggcccgcagccggctccggaggcgcgggccgggtttttgtttggctacgctgagcgccagtcagccccagcgaacaactccagttacgacaacaacccaccttccttccagacaagcgagacttgggctgctgcgtccgtcctattgtttagacacttgccaggggctccggagtcggcagagccaccgagtccccgctctgagtcgtcg

SEQ ID NO: 28836 - DNA, 84 bp, Homo sapiens
  chr4:20254239-20254323
  hyper
cggctcttgtttcttctacctttgccatcaggtgtctgccgcggagctgcggcttatctgggagacgagcggggttgacacgcg

SEQ ID NO: 28837 - DNA, 30 bp, Homo sapiens
  chr4:20254720-20254750
  hyper
gtgtttgtaaaccatcgttggctgtcggga

SEQ ID NO: 28838 - DNA, 51 bp, Homo sapiens; identical to SEQ ID NO: 7323
  chr4:20255045-20255096
  hyper

SEQ ID NO: 28839 - DNA, 38 bp, Homo sapiens
  chr4:20255330-20255368
  hyper
ggttgctagccccgccgggcactgggcctcagacactg

SEQ ID NO: 28840 - DNA, 762 bp, Homo sapiens
  chr4:20255524-20256286
  hyper
ggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcag

SEQ ID NO: 28841 - DNA, 15 bp, Homo sapiens
  chr4:20256562-20256577
  hyper
aagtaaatgcagacc

SEQ ID NO: 28842 - DNA, 62 bp, Homo sapiens
  chr4:20256841-20256903
  hyper
gctctgacccgcacgtctccacccgcgcagcccattgcacttcaagtcgcccttcttatcca

SEQ ID NO: 28843 - DNA, 32 bp, Homo sapiens
  chr4:21950123-21950155
  hyper
gcagccgtcttggctcgcgagggaaggagggc

SEQ ID NO: 28844 - DNA, 140 bp, Homo sapiens
  chr4:21950156-21950296
  hyper
gaagcgggcgcccgctcgcaagcttattgcatcctaccgcctgtagagctggcctcctccagctgagccgaaatgctttccaccctcctcacattcatgtctagggacgcagggtgcagaagcgagactcgagagtccac

SEQ ID NO: 28845 - DNA, 40 bp, Homo sapiens
  chr4:21950838-21950878
  hyper
gccgcgccttctcaacgcgccgctgcgtcccccaggggct

SEQ ID NO: 28846 - DNA, 90 bp, Homo sapiens
  chr4:24473588-24473678
  hyper
ggcgcaactggaaggcgggtaggcgccgggcgcacaggggcgcggcgcccgcggcgacttggggaaggttgcgctcgagttccctggttc

SEQ ID NO: 28847 - DNA, 48 bp, Homo sapiens
  chr4:24801867-24801915
  hyper
cgcggcccccacccggcggcggccagggacccccgaggcccccctctg

SEQ ID NO: 28848 - DNA, 242 bp, Homo sapiens
  chr4:24914406-24914648
  hyper
cccatcccgcctggccggcgccgcggcctcacctcgctcaccagcccctgccagtcgctctcagtccggtcgccgttcatggcctcctcctccatgcgctggccggcctcctggacccccgccgcctcctcctcctcgcgacgtcgcgtcgccgccgccgcccgggccccgcgcggccccgagagggcccggcgcctccgagccgctgcgccgccgcctctcgcggccgccagcgctgttga

SEQ ID NO: 28849 - DNA, 235 bp, Homo sapiens
  chr4:25657130-25657365
  hyper
cacttgcgggaatctcgtgcggaccgagtcggggcgggagagggcgcgcaccagccaggctagggcgcgcggggcgccgaggggcgcggggccgtttggggccgttcgggccagttcgcgcggcggggcccgtcggagcttttctctcggcagcctggctggccgcgcgtcttctccgcgcagcgggcgaagtcgcgatgggttcattaaggcggcaggtaggcagtgccccggc

SEQ ID NO: 28850 - DNA, 48 bp, Homo sapiens
  chr4:25657366-25657414
  hyper
gcggctgcggcaggcggtcctggaatgtgcgaggggcgtgatgacagc

SEQ ID NO: 28851 - DNA, 62 bp, Homo sapiens
  chr4:25657415-25657477
  hyper
gccagcctctttgcgcaacaccttcgccatatatacccggggcgctgcgctccacctggccg

SEQ ID NO: 28852 - DNA, 137 bp, Homo sapiens
  chr4:26030429-26030566
  hyper
gcagaggaggggcagcgtcggggcggcggagtccgacctcgggggattcaccctgagggttacaggcaaggccgctccaggcacgcagcacctgccgggcgccacccaggagggggcagcagcgccattcgcaaagc

SEQ ID NO: 28853 - DNA, 15 bp, Homo sapiens
  chr4:26030635-26030650
  hyper
cgtcccaggggacct

SEQ ID NO: 28854 - DNA, 30 bp, Homo sapiens
  chr4:27086432-27086462
  hyper
aaattgcaaagtaaacggcaagatgttgcc

SEQ ID NO: 28855 - DNA, 250 bp, Homo sapiens
  chr4:30719374-30719624
  hyper
aatgctttgaagatgcggagaggcttattcaagtttatggtctggagagggaagagggagtgcacaacgtttctgcccaagcggctgcctgaagtttgcaaaatcttagtaaggcgatgaggggagtgagtgcactgcaccatattgccgcgcatcggaatgcacggcgcaaggccgcggagtggagacggcttctcccatttgcctccaacctgggaaaaaggggaaccagggtcggaggtttggagag

SEQ ID NO: 28856 - DNA, 43 bp, Homo sapiens
  chr4:30719991-30720034
  hyper
cttggaaatctctgccgcctctccctcctcattcctgttcctg

SEQ ID NO: 28857 - DNA, 367 bp, Homo sapiens
  chr4:30720054-30720421
  hyper
cgctacatctgctcgttgactttattggtgtttgtcttgtttaaatcattctgcctcgtcacccaggtctcgtaaagaatacccacactggacagattttattttttcggctttaaatttttctttgaggggaggcccttaaatgtgtatggatacgtcaggcgagctgaagactaagcaaatcccagcagcggccctttctctctttcgagatggtaaaaattctccccaaatacctacagtccgtctcagtcgtcttaatcctagccgggcctcttcgtttacagccactgaaataaatgagtaaatggctcagttcaaaaacacaaccagacctgagatctgatgaggccggctgcggtggtcg

SEQ ID NO: 28858 - DNA, 34 bp, Homo sapiens
  chr4:30720861-30720895
  hyper
gagtggctttctgggcgctcgtaggttccccagg

SEQ ID NO: 28859 - DNA, 30 bp, Homo sapiens
  chr4:30721247-30721277
  hyper
cgggccctcctccctcgctctctcctagtg

SEQ ID NO: 28860 - DNA, 30 bp, Homo sapiens
  chr4:30722839-30722869
  hyper
aaaagaagcatctatcgctgccctcccacc

SEQ ID NO: 28861 - DNA, 225 bp, Homo sapiens
  chr4:30724228-30724453
  hyper
gaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagct

SEQ ID NO: 28862 - DNA, 45 bp, Homo sapiens; identical to SEQ ID NO: 2391
  chr4:37245537-37245582
  hyper

SEQ ID NO: 28863 - DNA, 525 bp, Homo sapiens; identical to SEQ ID NO: 2392
  chr4:37245836-37246361
  hyper

SEQ ID NO: 28864 - DNA, 211 bp, Homo sapiens; identical to SEQ ID NO: 2393
  chr4:37246489-37246700
  hyper

SEQ ID NO: 28865 - DNA, 223 bp, Homo sapiens
  chr4:37247015-37247238
  hyper
gctggccggttttgcctgcacacttctattaggacacccattctccaccccgggttattcccctgggtcaatccaagaaacatccaaggcattagccggcccttctggaagctccattctgccgccgccgccaccaccacctcctgtcccccgcccttttttttttttttaaagcggtttcttctccgagatgaccgcaaacacaaacagtagctctcctccc

SEQ ID NO: 28866 - DNA, 138 bp, Homo sapiens
  chr4:37247293-37247431
  hyper
cgaggtgagttccttgagactctcctcctgcaggtgcgatggtgccctttgcagaggccaagcagacttttgtgaaccggaggtcgagggggacaccctctgtgggtcccggaacaggcttcgcggtggggcgcgcag

SEQ ID NO: 28867 - DNA, 116 bp, Homo sapiens
  chr4:39047287-39047403
  hyper
gggatcagaagctggcggtaaaagtttgctatgtcagagagtaaagcgttactgtcgttttttatcgcttcatttcattttcaaaaatattcttcagtagtcgacaagttcacaga

SEQ ID NO: 28868 - DNA, 73 bp, Homo sapiens; identical to SEQ ID NO: 360
  chr4:41258716-41258789
  hyper

SEQ ID NO: 28869 - DNA, 765 bp, Homo sapiens
  chr4:41259085-41259850
  hyper
cgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgt

SEQ ID NO: 28870 - DNA, 208 bp, Homo sapiens
  chr4:41362555-41362763
  hyper
tgtgctccccctccccgggggcggagcggccctcgaaggtggggaggagaagaagctcccggcgcctccgcgctcgctcccgcgggtcactcacggcgcgttggagcccgggcggcgccgggaacagctgccgcggcgtcctctagcagcgcgcggctctcccgggacctgcgccggccgggggcggggagaggcggggaggggaggc

SEQ ID NO: 28871 - DNA, 157 bp, Homo sapiens
  chr4:41362780-41362937
  hyper
cggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggc

SEQ ID NO: 28872 - DNA, 412 bp, Homo sapiens
  chr4:41746824-41747236
  hyper
agaagaaaatgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatggcgggatggtgttcagcgaggtgggacaggcaagggggtgcgagaaagtcactccggccgccgggacagtctgagcaagtcgtcgccgcagtgacccgaacccaaggacacgataggaaggggggctggaacggcgtccctactcttccctgaagaagagccccaagagaatccgtgctgttaggagggagcggatttaggggttcacaagatcgagccttcagctcc

SEQ ID NO: 28873 - DNA, 324 bp, Homo sapiens
  chr4:41747445-41747769
  hyper
cagacacacattccccgagacagacacaaactgacacgcagacacagccccctgagagtgccccgcgtccaggccgcgctgctcacaacccccgatcagcaggcggagccctggccccgctgcgaggccccaggcaggtgcgaagccagggaagtttgtttgttttgtttgggggttgaggaagggggtaggagtggggttgaaatgagggcgacgccgttttccctttattcttagcgcgattactttaggccctcaatgaaaaagccatggcagcagcgacgacaatagccttgggcctacccgctcgcccactcgcccgcc

SEQ ID NO: 28874 - DNA, 124 bp, Homo sapiens; identical to SEQ ID NO: 7338
  chr4:41747888-41748012
  hyper

SEQ ID NO: 28875 - DNA, 624 bp, Homo sapiens
  chr4:41748143-41748767
  hyper
cgcagctgggggtggggttgggattgggacctgggcccccagtgctgtccgggtcagtgctcttggcctctttgctctcgtcgtccctggaagagtcagactttttgcccgaggagccgttcttggccgcggccgctgcggctgccgctgcgcgctcctgcttgcgaaacttggcgcggcggttctggaaccacacctggcccaagacggaaggagagacggtgaagcagggggagaaagaagaaaatgggaaagaaaagcaccggttagggtggcccaagttctacttcggcttgttttaacaccctcctccccatgcgctgtgatcacccccgcgcgcacatccaccaagtctaccgcttcttattgctgtgcattttcggagaaactttcttagggggagtgagcacgccagggacatgaaggcttgcggcagagtttaaaaagccgcaggtcccagaaagacccgaaaagggaaggccttattttggtgggcctctgttcagtcggcttcttgagcaagccccgagctcgccattcacccctaagcctaagttctaaagttaaactctaattggtagaaggaaaagggatcctctctgggtttgctccgctgcccatccc

SEQ ID NO: 28876 - DNA, 336 bp, Homo sapiens
  chr4:41749425-41749761
  hyper
ggggtagtgagtctccgcgaagaccctttccagctctttgagctgggcactggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacacccgcgcgagagagttgccgagagaagctgcgggaagaaaccgaggaaatttgttatctgcggaaacctgggctcaaacttcgggcttggcggagt

SEQ ID NO: 28877 - DNA, 497 bp, Homo sapiens
  chr4:41750102-41750599
  hyper
attttctaagctttacgtctcatcgcaaagtaaataaattatgcctatcattttggcagcttaagataattttgttggcggttcgggtgtgactaggatagtgtaaccctgtaagtgaattacccctccctgcaatcgcttctaacgtgataaattctttcatttgtgtaagcaaatttcgtttggtaaatactaaacacatttccattttcaaatgcaatcaaggcttcctatatacgggcggaaaggcggcttcctccgctgagaaagctgaaggtccttacctgcggcgtacggactgctctggtggtccctgagggtgcccaggctgcaggatcccggcgtgagggaagggcagccggacgtggccccaaaagtggtccttatcgggttatactggaagccactggcctggctgcaggaactgaagtcagcataggctgaagccaggctcgaggtgtccatcccagccatacaggactcgtaggcagaggaat

SEQ ID NO: 28878 - DNA, 30 bp, Homo sapiens
  chr4:41751372-41751402
  hyper
gggggtttatgtgaacgataagcggatttc

SEQ ID NO: 28879 - DNA, 181 bp, Homo sapiens
  chr4:41751719-41751900
  hyper
ctctttcatctctttcgggcgctctccctctttctcgcctctttttttttttcaggtgcccacaatcctccacagacccggggattgtgtctgtttgccttttaggtttgcggactgtagtgagggaaattcttgccatgtaaatgcccaggcaagggctccaggtcgggcacctttcttg

SEQ ID NO: 28880 - DNA, 49 bp, Homo sapiens
  chr4:41752441-41752490
  hyper
tgcaaatcctcggggcgtgaggaagcgctaaagtcgggagtgcagggag

SEQ ID NO: 28881 - DNA, 758 bp, Homo sapiens; identical to SEQ ID NO: 2398
  chr4:41752954-41753712
  hyper

SEQ ID NO: 28882 - DNA, 90 bp, Homo sapiens; identical to SEQ ID NO: 2399
  chr4:41753713-41753803
  hyper

SEQ ID NO: 28883 - DNA, 113 bp, Homo sapiens; identical to SEQ ID NO: 2400
  chr4:41753804-41753917
  hyper

SEQ ID NO: 28884 - DNA, 41 bp, Homo sapiens; identical to SEQ ID NO: 2401
  chr4:41754030-41754071
  hyper

SEQ ID NO: 28885 - DNA, 224 bp, Homo sapiens
  chr4:41867612-41867836
  hyper
cgattacaaaaagagaaagtgctaaatcccgggagctggggcaagatttcaaaaggcaacacaccgaatccaagtctgtactttaacttttttaataacgatttttttttttctgggctggaagctcgcactgaatcctggaggaattgctaaatcggattaaggttatattttgcaacagactggatggagcaataaaggagagcgcgcggaaatgggacttc

SEQ ID NO: 28886 - DNA, 341 bp, Homo sapiens; identical to SEQ ID NO: 363
  chr4:41875410-41875751
  hyper

SEQ ID NO: 28887 - DNA, 88 bp, Homo sapiens
  chr4:41881343-41881431
  hyper
ccacgcgcccccatccgaggggacctcacccctgggaagactccaataaatgcaacccggcgccactcgattccgggataatttttaa

SEQ ID NO: 28888 - DNA, 30 bp, Homo sapiens
  chr4:41881717-41881747
  hyper
gctgctgccacaattcgcatccctcaccca

SEQ ID NO: 28889 - DNA, 1 bp, Homo sapiens
  chr4:41882112-41882113
  hyper
c

SEQ ID NO: 28890 - DNA, 1538 bp, Homo sapiens
  chr4:41882894-41884432
  hyper
tcgggtgttagtgagcgtaatctgaccgcagaaaagctgatgggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaagaaccttgcctaggagcgcgtggaaacagcaagggcgcccgagcgggagaggttccctcggtgagggggtccgcgcagcggcggaccccgcaccccggcccccaacggcgcctaggaagttgtcactcctctcatttaaagcctcagaaaaatgcattcatgagattgtttctttatttttcctttctgcccctctccgcattctttgcctatttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgatggatccgttttcaaacggcgcggggacggcagtgccggaggccgcgtctccttagtaatcgcgcgggcagggctcggcaaggggtcgctgcaagggtcgcgctcacccgccccgggtttgggcgctgggggtggggaagggagagaaggttcgaacagttttgtctctcccgcgccccggctcccccagggtgctgcgcctccagccgccccgaggcgcttcccccggcgtccgcgcgctcctctccgcaggggtctcgcgcccacggtgccgcagccgcgcggctcagccgccctccgcacccgcgcctttccagcgcccgggttcccaaaccatcgctaaaggcggacggggggcgccaggagtaacggctgctccccggagaccccaccgagcccagcgcccgcccccgccccctgggcgccctgccccattttctccctttcccaactatcccagacccccagaagggccagaattttccagaactgtcccactccacccgcgcccagggcttctgcacattgcccttggcaggacgcgagccggtcgaggggcatttaggggtggccctgcacggccctcactgctgtcccttcttctccctccgttctccgggccagggtcctcggagaccccgttccgcggcaagtacccctcccccacccccggaggcgggtgcagtgcagggcgggggcggcggtcgcagcggctcagaagccgaccctccttgaacccgaagctgccctggcccgagtatccgcactggcctgggcccgagcgaggctgcaaccctgtgaaaccccctgcaaggcggaagcctccaaacccaaacgaccccgagggcgattccgccagaaatccaacgcgggcccaaataaagtccgaggcctttttgtcggaagcccgggaggtgcccggc

SEQ ID NO: 28891 - DNA, 48 bp, Homo sapiens
  chr4:42152718-42152766
  hyper
gcaaccagcccatctcgctccctgcaggcaggcagtgggctgctttgc

SEQ ID NO: 28892 - DNA, 451 bp, Homo sapiens; identical to SEQ ID NO: 365
  chr4:42152961-42153412
  hyper

SEQ ID NO: 28893 - DNA, 101 bp, Homo sapiens; identical to SEQ ID NO: 366
  chr4:42153532-42153633
  hyper

SEQ ID NO: 28894 - DNA, 504 bp, Homo sapiens; identical to SEQ ID NO: 367
  chr4:42153881-42154385
  hyper

SEQ ID NO: 28895 - DNA, 711 bp, Homo sapiens
  chr4:42154386-42155097
  hyper
ccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccggcttccgaaacgagctcgtggcgccccctgcatgaccccaaactctcggggttgcacagaggaggggctagtcgttggggcggggtcgtcagagtacgtgtgtattacagcaagttcttctaccaatcgggaattgctctccgatccttctgaaaagaacctcttgaagatcttggcccgggtggtcgcgcggtgtttacggggctttggggtcctgctttccccgagcatcgcggcctctgagctcatgcggaacataaaagctcgcaaggcgtagaactttttcacgttttcatttgtttcccgtaggggccccgagaacgtgcatgacaccatgatttcccccccattataaagatgagaaaaccgaggctctgagaggttgaagggaattgcccaaagtcagacactcgggagtgtgcggctgtgttgcact

SEQ ID NO: 28896 - DNA, 30 bp, Homo sapiens
  chr4:42398814-42398844
  hyper
ctttgcgggcgtgaacggagaagtcgtgct

SEQ ID NO: 28897 - DNA, 1396 bp, Homo sapiens
  chr4:42399099-42400495
  hyper
cttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgcctgtctggggtactcgcacgtggggaacaaattcttttcctccggctcctctcgggacccggcgatcgccacaggttgggactctgtgcggcgctggagttggcagccccgggcgctatggctcccttgaggagtggggagggaggtggccggggggttggcgcgcccctcgcgcggggagcgctatgagccgggcgaagggcggcagcgacagccccagcaactgcctctgccggcgcctcccgcaggccctcgccaactcgccccgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcggccgggtgggggaatca

SEQ ID NO: 28898 - DNA, 207 bp, Homo sapiens
  chr4:42400850-42401057
  hyper
ctgtcttaatgatagcgtttctaagccacggccccgttctgcagacttcctttcaattctctgcatcgaattaccctctccggcccaccccctattgtcacgcctttcagaaatgcccaggtcttcgaggtggagatttagaaacaagggtcgaaggggcttccccgccccctattctcacttcggaaaacacgggtcaaatttccg

SEQ ID NO: 28899 - DNA, 77 bp, Homo sapiens
  chr4:44448966-44449043
  hyper
ccctttccccacacccgctctcatgcccccgccccctcgaggggctctgggggcacctttatcgcttctcccctgcc

SEQ ID NO: 28900 - DNA, 90 bp, Homo sapiens
  chr4:44449480-44449570
  hyper
tgccccggacacccccgcggggcctccagcggggctcaaactggcggcggctcagcagggggcgaggggtgctgggaaacgccggggctg

SEQ ID NO: 28901 - DNA, 91 bp, Homo sapiens
  chr4:44449652-44449743
  hyper
cgaggagttacacgccaccatgtggaagccggcctcggacaggcgatcaaaggcctgctccaagtaggtgaacttgaggtagaagcgggac

SEQ ID NO: 28902 - DNA, 206 bp, Homo sapiens
  chr4:44449971-44450177
  hyper
gggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctc

SEQ ID NO: 28903 - DNA, 294 bp, Homo sapiens
  chr4:44450741-44451035
  hyper
gagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtc

SEQ ID NO: 28904 - DNA, 32 bp, Homo sapiens
  chr4:46391678-46391710
  hyper
gagatgaggcatgcacgcgaggcaaagacaaa

SEQ ID NO: 28905 - DNA, 30 bp, Homo sapiens
  chr4:46392469-46392499
  hyper
gtgttggtgtaaagccgggaatgtagtgtg

SEQ ID NO: 28906 - DNA, 851 bp, Homo sapiens
  chr4:46994970-46995821
  hyper
cgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacacgcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctcc

SEQ ID NO: 28907 - DNA, 567 bp, Homo sapiens; identical to SEQ ID NO: 2412
  chr4:46995822-46996389
  hyper

SEQ ID NO: 28908 - DNA, 30 bp, Homo sapiens
  chr4:47034011-47034041
  hyper
ggacttcggaggtaacgcttcatctttttt

SEQ ID NO: 28909 - DNA, 432 bp, Homo sapiens
  chr4:47034321-47034753
  hyper
agcagggagggagcccgttaagaatggagtaagggctgggaagcccccagaccctccccagcctgctgtcactgagagaatctgttcctaatgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgcc

SEQ ID NO: 28910 - DNA, 222 bp, Homo sapiens
  chr4:47034754-47034976
  hyper
tggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcccggatgcaccaaggccctgccaccgagagcacagtctg

SEQ ID NO: 28911 - DNA, 30 bp, Homo sapiens
  chr4:47839373-47839403
  hyper
ggggaagggggcttacgtctggggcaggca

SEQ ID NO: 28912 - DNA, 34 bp, Homo sapiens
  chr4:48485255-48485289
  hyper
agaaccacttactggcgattcacaggaggggacc

SEQ ID NO: 28913 - DNA, 287 bp, Homo sapiens
  chr4:48485589-48485876
  hyper
cgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgc

SEQ ID NO: 28914 - DNA, 130 bp, Homo sapiens
  chr4:48486356-48486486
  hyper
ggggagcaagctagacggcgagggagctgctccaaggctgggattccatgcgcagcgcggcccttcagcagggtccctcgccgtcctccccgagcgtcggggtggcagcgcaggtcgttgtccagtggaa

SEQ ID NO: 28915 - DNA, 352 bp, Homo sapiens
  chr4:48492267-48492619
  hyper
cgcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctg

SEQ ID NO: 28916 - DNA, 213 bp, Homo sapiens
  chr4:48987912-48988125
  hyper
catctgggtctccagcggtccttcctctctgccttctcctcgcagagcaccccgtgggcctagtctaaacgagggcaccactggtccggagttgcacttgttcgctccctcctgggctctggcagcgctgcatccccggggttgcttcgggttcgggcccaatagcagagtcagagccgagacgcatgtcccctgcaccggccaagggtgccg

SEQ ID NO: 28917 - DNA, 68 bp, Homo sapiens
  chr4:48988465-48988533
  hyper
aaatcctcttggagtcgctgctgggtaagccgaagcccctcgccgcgagttcgcgggtgccagctccc

SEQ ID NO: 28918 - DNA, 75 bp, Homo sapiens
  chr4:52917590-52917665
  hyper
cagggtatctatggccgggctcaggcggctgctggggagccaggagaccgcgcgggacggcggatgaggcgcggc

SEQ ID NO: 28919 - DNA, 117 bp, Homo sapiens
  chr4:52917964-52918081
  hyper
tgggtgaaaaacccccggggttcgccctcccataggttccagcacagcccttgtcggggatttcttagggctggagttggtggccactttgcaaagcctccgcggttgcgattccta

SEQ ID NO: 28920 - DNA, 114 bp, Homo sapiens
  chr4:53617401-53617515
  hyper
ggcagcagaggagctcggggcgggcaaagctcgaggggacacggggcgagcccagaccctgcctgggagccctccccgccggagaccaaagggcagaaacgcactcacagtgca

SEQ ID NO: 28921 - DNA, 52 bp, Homo sapiens
  chr4:53617855-53617907
  hyper
caggaaacttcgggacgagggcaggacgggggctggacgggcccagccattg

SEQ ID NO: 28922 - DNA, 181 bp, Homo sapiens
  chr4:53728041-53728222
  hyper
ccaaatcagggcgggcggcactaagccggggagcaaacaccgctcccggcccgcccagagcagacgccctaggttggggctgcagcgagtgcgcgcgtgggctgtggagccggcggaggcagcggtccggaatggctctgtggaggctgcgctctcttcctggccccgcagccacagcagc

SEQ ID NO: 28923 - DNA, 309 bp, Homo sapiens
  chr4:53728688-53728997
  hyper
gaacatgtgcaccatcgccgagtaccccgcgccgggcaacgccgcggcctccgactgctgtgtgggcgccgccggccgccgcctggtcaagatcgccgtggtgggcgccagcggcgtgggcaagaccggtgagtcgtcgcgcttagccctgggtctggtcttggacgacccctgacgggagttgaggctgaacaaggcgtggggagcggtgggagctgcagcccgaccgctctccgtccccgcgcagggagccgctgccccttgggagtgggcttagccgttgtctacgccacccgcctgcttccacag

SEQ ID NO: 28924 - DNA, 1693 bp, Homo sapiens
  chr4:54965799-54967492
  hyper
aggggtaggtgtaaccgtggccagagctgcgctcagggactggacgactgccagtccgtcgcccgcacaatcctgctccaaaccgcaggcctcacacttcaccgcgccgcagccacccctaccacagaggagctggaaacactgagcattcctattaaataagcctccaagtccccacctggtacgctttgcggtggggcgtggggaagagttgggctgcggccagggtagcgagagggggtgggatggaggatgcagcgctgtgatttctcagtaaagcgtggagaaagagggggaggaggccggcctccccgggaaattaacaaaacctacactttgcaaagtctcccccatccccctcccccgagttcttccccgccgcgcgcccgcccctcctcgcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagg

SEQ ID NO: 28925 - DNA, 24 bp, Homo sapiens
  chr4:54969747-54969771
  hyper
gagtgttgtctttagcgcgcgcgc

SEQ ID NO: 28926 - DNA, 684 bp, Homo sapiens
  chr4:54969831-54970515
  hyper
gaaggaaaatccctcttcgttccgtcaagggacatagggaggagggcccgcactgtgtgaggctgaaaagggagctgccggcgctttgtgcaatgtgctgagctctgtcctgcgcagaggtcccagacagccggctcactactgcctggcctgggaagctcaggcctctggatctctttcctcctgtctctcacgcgcagagctccgggctcttcgccctgcccgccacgaaagggaggaggcgcaggccggctgcctttccaaaagattctgtctcccttcttcccaagaagcaggcctctccgcgcgcgagaacagaggtgggaggacgggagtttgcaggcgcaaagaacaggagtttaagcagactatttccaccaggggaaataagaagcacaaagagcgcctgctgcagctctttgcgctcttgcccaaagctaagcttcctctgggctgtggggagactcctctggtccccgttccatctacccagcccggcccctctggggctcagcgcttgggtttagccctcccctatgtccatgactagccccgatcacagtctcttaagcctctcccggcccccggctcccaggccctgcggagccaagcacttggaacaccaggtaccgcgcgcggtggacccagctctgccatgccgcagatagccgcagtgccaaccct

SEQ ID NO: 28927 - DNA, 164 bp, Homo sapiens
  chr4:54975768-54975932
  hyper
atattaatagtgtggcgaaagttttttgtgtgcgtgtccttttctaggtcgggggtggggaggggcggtgggtggacgcagagggaggaaggctcagccttggatccttgccacctgaacaacgtcgcctctgcccacgtggaaagcctcgcttgtctggcagc

SEQ ID NO: 28928 - DNA, 126 bp, Homo sapiens; identical to SEQ ID NO: 370
  chr4:54975990-54976116
  hyper

SEQ ID NO: 28929 - DNA, 15 bp, Homo sapiens
  chr4:54976170-54976185
  hyper
cgtgggaaagagacg

SEQ ID NO: 28930 - DNA, 919 bp, Homo sapiens
  chr4:55092914-55093833
  hyper
aaaagacccgcagcccgcctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggtttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattc

SEQ ID NO: 28931 - DNA, 123 bp, Homo sapiens; identical to SEQ ID NO: 7383
  chr4:55093888-55094011
  hyper

SEQ ID NO: 28932 - DNA, 74 bp, Homo sapiens
  chr4:55094012-55094086
  hyper
ggtcgcgtagaagaactgcggcaatgggacccccagcgcagccccaggcgccctgttttcgaggctgacatccc

SEQ ID NO: 28933 - DNA, 92 bp, Homo sapiens
  chr4:55094514-55094606
  hyper
cgcggcgggagggaacggagggagaatcaaaaggcatcctcccccacgacgcggaggcggtggtacgattcctcaaacgcccaagcttgagc

SEQ ID NO: 28934 - DNA, 58 bp, Homo sapiens
  chr4:55096214-55096272
  hyper
tacagcacagggagccggccgaatgcgcgtgattactggacggcgctgctctgggaga

SEQ ID NO: 28935 - DNA, 103 bp, Homo sapiens
  chr4:55096538-55096641
  hyper
ggatttgaggaatttcgaaccgcacaccaaggggccctcattgtgctccgtggcccccgcccccgcctgtcttcccgcgccccctcctcggtggaatcatttc

SEQ ID NO: 28936 - DNA, 60 bp, Homo sapiens
  chr4:55097404-55097464
  hyper
atatcaggtccctaccgccccgcgtccgaaaagccgcgggctgggcggtgtgggaaatgg

SEQ ID NO: 28937 - DNA, 93 bp, Homo sapiens
  chr4:55098197-55098290
  hyper
cgtggtggccagcgccttcctgcagaccccacagggaagtactccctttgacctccggggagctgcgaccaggttatacgttgctggtggaaa

SEQ ID NO: 28938 - DNA, 164 bp, Homo sapiens
  chr4:55098605-55098769
  hyper
aaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtg

SEQ ID NO: 28939 - DNA, 104 bp, Homo sapiens
  chr4:55099069-55099173
  hyper
gccgagagggcgcatgctagctctcctcagcattcccggtgagccgctacccacggccgtgcggctctcgtgcccataggaggcgctggcgagctcctgtaacc

SEQ ID NO: 28940 - DNA, 30 bp, Homo sapiens
  chr4:55099383-55099413
  hyper
catcgccgccaaccccgggacaaccaagcc

SEQ ID NO: 28941 - DNA, 208 bp, Homo sapiens
  chr4:55523645-55523853
  hyper
cccatgccacctccacgagcagcggcgtccagcctcctcccgcccgaacgtgctcgaggggcgggcagtcgacctttattgtctggggagcacctggcaggtggcgggcccgtgccctaacgtgtgcgtggtgcccagcttcacaaagcgagcgggcagcacctccttggtccgggaacggcctcagcctggccgtccacatcccagg

SEQ ID NO: 28942 - DNA, 32 bp, Homo sapiens
  chr4:55524220-55524252
  hyper
ctgctcctactgcttcgcgtccagacaggtgg

SEQ ID NO: 28943 - DNA, 689 bp, Homo sapiens
  chr4:55524562-55525251
  hyper
acgttgcgcggggggcggaggcggggggctcaggggtttgcaccgagcgccttctcttgccgtgcgaggcgcggccgcagcttccttttgttaaaagttgcgtgtgtgtgaccggcgcccgggaggacctgcctgcaggttctccgccgcgctgagggcaaagttagagagccctttctctgctctgcggctactgccttccaaccgcaggcgctctttgtgcccagagctggggaccgacccgctgccgcctctgctcgcggcgccacccgtggagaccaatcgaaggctgcggcgtttccccgcctccgggttaggcttttgcgctgggagtgcgcggcgtggggctgttgtggggccggactcccgcgagcctggaggtggtggcgacagggacaacttgggcagggcgtgtggaaagcagccgctaggttgcagactttttgctttcgtacatcccgtgctcgcccctttctgccgcggcgccgtttcattcctgccgcgcgccccggggcggctggaggctgtgtttgccgcctgctccgggaaggcaagggacagcgtgctgggactctgcgttccctgactccaaccgcctagcacgccggccagagtgcccggcctgcctggcgggttctgaaagcccctagttcccggtgtctgcgacctgtattcgcaggtcctgtttt

SEQ ID NO: 28944 - DNA, 191 bp, Homo sapiens
  chr4:55990946-55991137
  hyper
ccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaagagcctgagggtgtgtcggcatctcaggaca

SEQ ID NO: 28945 - DNA, 30 bp, Homo sapiens
  chr4:55992154-55992184
  hyper
cgcgtctgaagtggccgagaatctgcagca

SEQ ID NO: 28946 - DNA, 86 bp, Homo sapiens
  chr4:56501604-56501690
  hyper
gcacacttgcctctccgactttatgtgatgagaagttctctattccttttcctgatctagtgcctgaaaaccgataaggcacaaag

SEQ ID NO: 28947 - DNA, 30 bp, Homo sapiens
  chr4:56503489-56503519
  hyper
cgcaccgcccctccccgccccctctccccc

SEQ ID NO: 28948 - DNA, 128 bp, Homo sapiens
  chr4:56659934-56660062
  hyper
cgcactccccgggtatgctgcgggccctctccatccggggaggcggggtccggggaggacacatccccggcccggcctctccgagagaccctttggatttttctcttccacaccgcctcatccgaggg

SEQ ID NO: 28949 - DNA, 30 bp, Homo sapiens
  chr4:57371838-57371868
  hyper
aagaagccctgcatccgcgaggtaagcggc

SEQ ID NO: 28950 - DNA, 166 bp, Homo sapiens
  chr4:57371869-57372035
  hyper
gttggcggcggtgccggggttggcagcgcccgcgggttgtctacgccgcggggcctacgtctctgtcgggcgtgcacctcgggagccacacctggggcccagagccaccgctcagcacgcgggcacgcggcgggagggaaggaaaccgcggcgctggggatggaga

SEQ ID NO: 28951 - DNA, 117 bp, Homo sapiens
  chr4:57372387-57372504
  hyper
ggaggcccccgaccgcgtgggagcgaatggatctcaactgagggctatttacctatggatgaaagagatgcgccaaactttgaacgacccatccccttttcccgggccccctgccca

SEQ ID NO: 28952 - DNA, 192 bp, Homo sapiens
  chr4:57396459-57396651
  hyper
tccttgctctggacacggggaacagggtcagcatctcgtctcctatctccaccgacctgtctctggcttttcttagtccccagatgcgcccagaaggtcctggagagtggtgcgtccccttggcaaccgtacaacgcgcaggaaggcggagtgagatgaggctgagtccggccggggcggggctgtgtggga

SEQ ID NO: 28953 - DNA, 379 bp, Homo sapiens
  chr4:57396946-57397325
  hyper
tgtgctcaggattctcgacactcacagagagcttgaggagtccgaggatcccgagaaacacgagaatcccgaggaacccgaggaggtcagggagcaagaccagagagacgagtccgaggaatgtgatgagcctcatgagtcctatgagccccacgctccctatgcgccccacaagccccgggactcctatgcaccttacgaactccatgggccccatgcagcccccaaactcctcaaggcccgtgaaccccgccagctccgccacacccgtgagccccgcaagtcccgcgaggccaaggaaaccgagttgcttcccagcgccgcagtaatgatctccccctctctgatcaccagagccccgccacggcctcagctgtct

SEQ ID NO: 28954 - DNA, 15 bp, Homo sapiens
  chr4:57521381-57521396
  hyper
aattttttaaaaaat

SEQ ID NO: 28955 - DNA, 159 bp, Homo sapiens; identical to SEQ ID NO: 372
  chr4:57521505-57521664
  hyper

SEQ ID NO: 28956 - DNA, 683 bp, Homo sapiens; identical to SEQ ID NO: 373
  chr4:57521700-57522383
  hyper

SEQ ID NO: 28957 - DNA, 396 bp, Homo sapiens; identical to SEQ ID NO: 374
  chr4:57522419-57522815
  hyper

SEQ ID NO: 28958 - DNA, 187 bp, Homo sapiens
  chr4:57687669-57687856
  hyper
gtcgccgaggccgcccggagcagggcagggtccgccgccggtctgactcccaaacccgcttttctccggaggtccccgctcgccaggaccgctccgagcgctacctgcgaaggtaactgccaggagcagcagcgccaagcgcagcaccgacagcgccatcctcctcccgcgccggctgtcttgcccc

SEQ ID NO: 28959 - DNA, 923 bp, Homo sapiens
  chr4:57975777-57976700
  hyper
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgt

SEQ ID NO: 28960 - DNA, 30 bp, Homo sapiens; identical to SEQ ID NO: 7405
  chr4:57977077-57977107
  hyper

SEQ ID NO: 28961 - DNA, 290 bp, Homo sapiens
  chr4:62065781-62066071
  hyper
gagagagagggagagcgagcgccgaggcgggcctcgaagccactggagaggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctg

SEQ ID NO: 28962 - DNA, 335 bp, Homo sapiens
  chr4:62066133-62066468
  hyper
cgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctgccgccgccaccgccgcctgtgactcgccccctcccctttctttcttctctttttgccttggtcctcttcctacgggtgtgcgcgcgcgcgggttgcacggtttgctttggcaggagctcgctcgtgtgtgcgcgtgtgtgagtgtgcgtgtctggagagcgccagtgcctcgct

SEQ ID NO: 28963 - DNA, 360 bp, Homo sapiens
  chr4:62066855-62067215
  hyper
gcggaaaggggaggacgtggaagaagaaaaagaaagagaaggggggtggggtgggagaactggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctct

SEQ ID NO: 28964 - DNA, 184 bp, Homo sapiens; identical to SEQ ID NO: 2422
  chr4:62067440-62067624
  hyper

SEQ ID NO: 28965 - DNA, 103 bp, Homo sapiens
  chr4:62068099-62068202
  hyper
gttgtgtctccttcacggcagtttggtttagacctgcgtgcccaggctttgttaggcggttttggctggagaaagctgccactttcgtgggtggcccgggctg

SEQ ID NO: 28966 - DNA, 116 bp, Homo sapiens
  chr4:62068237-62068353
  hyper
cggtgttgcacgaatccgggcggccgcggcgccggggcggggtgggcagagcattggtggtcgcggttggcgggttacaggtaggagagaaggcacctcggcgcttctctgaggag

SEQ ID NO: 28967 - DNA, 30 bp, Homo sapiens
  chr4:62068633-62068663
  hyper
cttgcttattgaaatcgcctgggatcctct

SEQ ID NO: 28968 - DNA, 30 bp, Homo sapiens
  chr4:66534335-66534365
  hyper
ggctgagcactgttccgggagcacgaagag

SEQ ID NO: 28969 - DNA, 265 bp, Homo sapiens
  chr4:66534894-66535159
  hyper
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaaggccagtggaaggggacgacaaataccaatt

SEQ ID NO: 28970 - DNA, 475 bp, Homo sapiens
  chr4:66535574-66536049
  hyper
cgccttctggcacgcggctcctccaaatgtaggaaccacggatccggctgagacagctgaagtttgcttctggctcctctcgcctccccctttggtggggttaaatgaaatattagttctggttgctagtgcagatctggactcggatcaagggtgtcgagagggtcctgggtcctgttcctttgcctttcaaaaagactttttacggattgagaatttttaaataccactaggggaaaggtgaaggttctttgcagccttcagtgttgaaatggacgaaggtaaggaaggcaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctga

SEQ ID NO: 28971 - DNA, 48 bp, Homo sapiens
  chr4:66536391-66536439
  hyper
gtgagtgttgcctagcggtctccgggaaaggcgcgtcttcctcccggg

SEQ ID NO: 28972 - DNA, 228 bp, Homo sapiens
  chr4:71600396-71600624
  hyper
ttcctatctaaaccacgaaagaggtgcatgctgcctctgatctgaccgtaacatactctgcataaaatcagcttttccttcctgtttcaggactactttcagtttcttcctgtctctttgatactcttgcactagcgttggcttcagtgcactgtcattaaccacagtgccttacagtattttcttctattggtgagccttttctggacctttcgtgaaacagagctt

SEQ ID NO: 28973 - DNA, 241 bp, Homo sapiens
  chr4:73433899-73434140
  hyper
ggatctctccctgtccggcccaaggacttcctgaaacccccgcctccggctgcccgaaaaaaccgtgagtcagttcggaggagagaaagctccaggaacccgactctggcggcagcagccagagcgctgggatcccggacccagcgtccagaacttcattcaagcgcccagaccgccctccagaaaggggaagcccagatggcccggcgaggatgggaactggctgcggtttgtcactagg

SEQ ID NO: 28974 - DNA, 279 bp, Homo sapiens
  chr4:73434964-73435243
  hyper
acgcagaggtgggggcgggaggagcgaaggggaggaggagaaggcaggcggaggaggtgggaggagtgggccgctcgccggctcctgttgctcgcagcgcggcagtctgctggctgctggcgacccgcggggcgctaataaggcgtccggagctccccggactgcccctcccgccgtggcgcccacgtcatgcggggcccgaacccgcgccccccgcaccgtgtcaggattggagaccgctcgggggctggtgtggcccgggctcgacctcccaccctg

SEQ ID NO: 28975 - DNA, 69 bp, Homo sapiens
  chr4:74702331-74702400
  hyper
gagtttcctgccagtcgggagggatgaatgcagataaagggagtgcagaaggcacgaggaaaccaaagt

SEQ ID NO: 28976 - DNA, 168 bp, Homo sapiens
  chr4:74809865-74810033
  hyper
gactcgctgggtgagcgggactgttggcgcggggtgctaccccagccgtgtcccgctccggagaccccagggcgccgggacccatctgccgctcgccggccggaggctaccaggagcaggagcagcagcgccgcccgcagtagccggggagcgcgggggacagcgggg

SEQ ID NO: 28977 - DNA, 62 bp, Homo sapiens
  chr4:74810262-74810324
  hyper
tgggtgggtggtgggcggtggctggttacccactggtgcagcctccccggctcgccttccag

SEQ ID NO: 28978 - DNA, 234 bp, Homo sapiens
  chr4:74904177-74904411
  hyper
cgcccaccccagccgcgtccggcccggggaccccagggcgccgggacccacctgctgcgcgccggctggcggccaccaggagcaggagcagcagcgccacccgcaggagccggggattgctgggggcggcggagagcgtggcgtgggccatggggctcagcagacgcgtcgggaagctgtgcgagaagcgggagagctggcggggaggtgcctgcgacccgggctgtgtggctc

SEQ ID NO: 28979 - DNA, 92 bp, Homo sapiens
  chr4:75230955-75231047
  hyper
tgctcccgccctgcccgtgcactctccgcagccgccctccgccaagccccagcgcccgctcccatcgccgatgaccgcggggaggaggatgg

SEQ ID NO: 28980 - DNA, 81 bp, Homo sapiens
  chr4:76555351-76555432
  hyper
ttgtgatttcttctgcggacgcagtcacgagtccagggcgaagcaggcagggaggcaggtgggcctcggtccgccgcaagc

SEQ ID NO: 28981 - DNA, 82 bp, Homo sapiens
  chr4:76555649-76555731
  hyper
cctgggaacctgcaccgctccaactacccctgggcgaaggcgttggccgcggagctgcaagggggggcggtttctcacccgc

SEQ ID NO: 28982 - DNA, 32 bp, Homo sapiens
  chr4:77228302-77228334
  hyper
ccaggctggttggtacgcgcaggcaggtttct

SEQ ID NO: 28983 - DNA, 30 bp, Homo sapiens
  chr4:77819543-77819573
  hyper
tctaagtctccgccacgcaggaaacaaaag

SEQ ID NO: 28984 - DNA, 15 bp, Homo sapiens
  chr4:79472968-79472983
  hyper
tgttcgcagtttact

SEQ ID NO: 28985 - DNA, 259 bp, Homo sapiens
  chr4:81106122-81106381
  hyper
tttcagaagcagttgcgctgggggtggggaaagggagggaagggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaattaatcacaaccaccagcggatgcaaaatgtg

SEQ ID NO: 28986 - DNA, 325 bp, Homo sapiens
  chr4:81123055-81123380
  hyper
ctcactaagcagggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgc

SEQ ID NO: 28987 - DNA, 232 bp, Homo sapiens
  chr4:81123381-81123613
  hyper
aagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggcc

SEQ ID NO: 28988 - DNA, 290 bp, Homo sapiens
  chr4:81123614-81123904
  hyper
gggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcac

SEQ ID NO: 28989 - DNA, 610 bp, Homo sapiens
  chr4:81124121-81124731
  hyper
gcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaa

SEQ ID NO: 28990 - DNA, 37 bp, Homo sapiens
  chr4:81186703-81186740
  hyper
ataacagtctggggacgttgcccgtacagggaaattc

SEQ ID NO: 28991 - DNA, 758 bp, Homo sapiens
  chr4:81187040-81187798
  hyper
cgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatccc

SEQ ID NO: 28992 - DNA, 517 bp, Homo sapiens
  chr4:81187799-81188316
  hyper
gtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatccca

SEQ ID NO: 28993 - DNA, 143 bp, Homo sapiens; identical to SEQ ID NO: 7425
  chr4:81188384-81188527
  hyper

SEQ ID NO: 28994 - DNA, 222 bp, Homo sapiens
  chr4:81189713-81189935
  hyper
cgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagc

SEQ ID NO: 28995 - DNA, 405 bp, Homo sapiens
  chr4:81256834-81257239
  hyper
actgattggcaggaacgaagtgggtggagcctcctgaccctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggtaagggcggagcgcggcagagtagccgccgccgcgcgtccctcggtccctcctcgagttcccgcttcgtgggctggtcgccccctggcgctggacagctcagctgtcaggcgccgcggtttcgggaccgcgacactaaagccgctggcgaggtgaattgccgcgtccttaccgccccgcgctccccggtccggacagaacttggg

SEQ ID NO: 28996 - DNA, 101 bp, Homo sapiens
  chr4:81951400-81951501
  hyper
aggaagctatgatgacgggctgcaggtgcaggggcccgcagtgtccgtcagaagaggctcgggaaagtaagcgagaatggtgttcacgttgtgactttgtt

SEQ ID NO: 28997 - DNA, 100 bp, Homo sapiens
  chr4:81951777-81951877
  hyper
tgcaagctaagagggcgaggacgagggagtgggagagattggctgaggactctacagatcagctagagagcgaaagaactaagtctctctctctcataca

SEQ ID NO: 28998 - DNA, 375 bp, Homo sapiens
  chr4:81951937-81952312
  hyper
aactcggaccagccgcgccgcagctgctccaatccctggaaaaggcaatcgagcgccctccggaccgctgcgcacagccccggctccgacctggcgcccaaaacagagctagtcctagtccctcgcgcggccagtttggccgggtgttcccaaaaataaagcgaggagggaaggtacagacagatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcc

SEQ ID NO: 28999 - DNA, 573 bp, Homo sapiens
  chr4:81952363-81952936
  hyper
cgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcaggtgagtgcgcgaggtgagactcccttcccgcggtcccgccccagctttctcccgggaccccccacagcttccttgtctgccccttgcttggtggcgctgcctagggacctttctccgccctcctcagctgccctctggattcctccgtccagtcacaccccgcgtgtcgccagctgcatctc

SEQ ID NO: 29000 - DNA, 15 bp, Homo sapiens
  chr4:82135873-82135888
  hyper
gcctccaggagctca

SEQ ID NO: 29001 - DNA, 286 bp, Homo sapiens
  chr4:82135919-82136205
  hyper
cgtacacacgtccacactcgaacagcacaagcaagagaccggctgggtgtggaatagaggcgcacatcgcgcaacgcattcacagcatgcacacgcgcgcaccccgaccccgtccctccccgcgcgccctcacaccccggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccag

SEQ ID NO: 29002 - DNA, 142 bp, Homo sapiens
  chr4:82136243-82136385
  hyper
cgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagac

SEQ ID NO: 29003 - DNA, 312 bp, Homo sapiens
  chr4:82136635-82136947
  hyper
ttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggcaggggttgaatcgagtttcgagggac

SEQ ID NO: 29004 - DNA, 316 bp, Homo sapiens
  chr4:82965388-82965704
  hyper
ggcggccgcccgccccgcggcgtccagcggtgcgagtgcgcgcagccccgtccgcagcccgagcctccgctctgcgggagccggggcgccgtcgccgcgctagccttttcctctgaatgtcactattaccatagtaaagggaagggccccgccgagggggtggcgggagggccaacggcgcctcaggatgggcgccaagcgtgagcaagggcagccggcgggcgcagcgccttggcgcagacaccggcccgacccacgcctgggcagggccactcttgcaacactgccgggcgggagcagacgccttaagctccga

SEQ ID NO: 29005 - DNA, 36 bp, Homo sapiens
  chr4:83482690-83482726
  hyper
gtcaaaggacggggccggggccggggccggggccgc

SEQ ID NO: 29006 - DNA, 278 bp, Homo sapiens
  chr4:83483094-83483372
  hyper
ggctgtgacctgctgcggtggcggcggcggcagcagtagcggcgggtagggcgcttccttcaggaaggggtgggatctgctcacccgcccgcccggccccctcctgccgcgccggggcccgcccccgacttattctggggtccccgctgctaggccttcggggagagttgatcccctgggtctcgggcttctgccacccccccggggcccctaatagtcacccggggcaggagccgggtgtgggcgggcgagccgcttccttccgaagcctttgtgga

SEQ ID NO: 29007 - DNA, 44 bp, Homo sapiens
  chr4:83719361-83719405
  hyper
cgcaccgcccgcagccgaggggcgagcggcgacctcgcgcgccc

SEQ ID NO: 29008 - DNA, 676 bp, Homo sapiens
  chr4:85402747-85403423
  hyper
cccctctgtctaccttgcggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgt

SEQ ID NO: 29009 - DNA, 152 bp, Homo sapiens
  chr4:85403776-85403928
  hyper
ctgtggttgccttttcggtttcaaagtaataaccaagcaaggaagagagaagaccgaaaactaccccgcggaaactagcacagtgtgcctggatgtctgtgtcccgggacctcggggaagagggcccgcaccggtctgcgaattgcaaggcc

SEQ ID NO: 29010 - DNA, 30 bp, Homo sapiens; identical to SEQ ID NO: 375
  chr4:85404111-85404141
  hyper

SEQ ID NO: 29011 - DNA, 252 bp, Homo sapiens; identical to SEQ ID NO: 376
  chr4:85404224-85404476
  hyper

SEQ ID NO: 29012 - DNA, 44 bp, Homo sapiens; identical to SEQ ID NO: 377
  chr4:85404649-85404693
  hyper

SEQ ID NO: 29013 - DNA, 26 bp, Homo sapiens
  chr4:85414088-85414114
  hyper
ggcaaaatctgggggcgagggggacc

SEQ ID NO: 29014 - DNA, 189 bp, Homo sapiens; identical to SEQ ID NO: 7440
  chr4:85414148-85414337
  hyper

SEQ ID NO: 29015 - DNA, 567 bp, Homo sapiens
  chr4:85414457-85415024
  hyper
ggctcggacgcgtgcagtaggaggccgccgccgccgccgctgctggacttgtgcttcttcaacagctgcgtgattttctcgtcgtccgagttgggatccagaggcttattgtagtcgtcgtcctcttcctcgttctccgaggcccccttgaggcgctctgtctccgagtcctgcttcttcttggccgtggccatctcggcagcgtgcttcttcctccacttggtccggcggttctggaaccagacctgagggcggagaaaagggaggagaggggaggcaagggcgaggaattaaacgagcagatccaggccatgctaccactcccgcatctcgatggccctcccgcggccccccgaaggcctgctgccctccctcgcagccctcccttttctcggccgtcaaagtcagtctccgtcgccccaagttccccctgagtaactggcaccaacaaactgactgccgttgccatagcgatggtaacacaagagtattgaggttgtcagtgagcgagttctcaaaagtaaaaacaaaactcggaaacttaaaaatgagcgtccctaaaagtga

SEQ ID NO: 29016 - DNA, 479 bp, Homo sapiens
  chr4:85416904-85417383
  hyper
aagtcttctccagggcgaagatctgctgtccggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctcgcctcctaatccagtcggtgctcgttcggccccggagcctttaagtg

SEQ ID NO: 29017 - DNA, 53 bp, Homo sapiens; identical to SEQ ID NO: 7444
  chr4:85417666-85417719
  hyper

SEQ ID NO: 29018 - DNA, 270 bp, Homo sapiens
  chr4:85417953-85418223
  hyper
gggtgttgagctccacgatgtccccaaatgtgcccggacgcagcgtgtgccagcccccagagtggaggcaggtgggaaagcgcgggcccagcgctggtgagcggctggaagcgctcgccctgccctggggacgctggactgtcttcaatgggctcacccaggccgagtgtactcgggcggcgagggcgaagaggtgaggtggggacaccccaggcggagacgtgcatgcaaatacactcacttcccgggcggtggagggctcaccgctgc

SEQ ID NO: 29019 - DNA, 106 bp, Homo sapiens
  chr4:85418264-85418370
  hyper
cgaaggcggaatggggcgctggacgacagggaggagccgggaaagcagagatgcagtggcctctcctcccctctcctccccatctttctaatccaggccaggcctg

SEQ ID NO: 29020 - DNA, 62 bp, Homo sapiens
  chr4:85418521-85418583
  hyper
cgagctcagaaaagcgagaatccctttctggaagccctggcccaacctaactggtgtgattc

SEQ ID NO: 29021 - DNA, 521 bp, Homo sapiens
  chr4:85419120-85419641
  hyper
cggggggctgccgagggatgagagcccccccgtggccgggggcttcaggccgcctgggttgtgggtgcccagaggcggggagggcgacgaggaggacgacgacgaggacgaggaggagggggggccggcaggcagcgggggatacgcggcagggtacagcggggtcttcatctcggccatgctgtgcagggcggccaggggagggctgctgagcaggaatgcgctctgccgggtgccctccattgcccccaccgctaacatcccacggccacgccggagaccgtagccttgcagcgagggcgctggctggtgccccccgcggggctcagaggagccggaagcgccgagggcgcgagcggagaggcactcggcgcgcccggaggcgagctgccaactgaaccaaaaatgccgctgccgggagttgctcgcctagctgcgcagcagagatgtccaaaccctccacgcgggaggcggcagctcgccgagaaaagcaggcgtcccggcgggctaggcagtccttt

SEQ ID NO: 29022 - DNA, 230 bp, Homo sapiens
  chr4:85419661-85419891
  hyper
cgatccctggctattctctcttcctcacttttcctagctgttcaaagtgcgctacttctcatcttctgcccccgggaaataagcaaaacaaaacccaggctggctccggagagtttgtagcaaagttagttgccgaatctccactttgaagttggagggtgggggtggcttgctttctttggggaggttcaaaggacgccttgtgcagcccgtggcgctcctctgatctt

SEQ ID NO: 29023 - DNA, 279 bp, Homo sapiens
  chr4:85422188-85422467
  hyper
taaggtgaagtccttcgtcagcatgaatagtgctaaggagtcaagccaagacttgcttcagaagagagctgatgtgcggaccttctgcatttccacgcggggatccagtgcttgggtctaaaccccagcgccctgccacctcggccaggaagctgcgggaggatggtggcaggcatagcccgtcctagccttgaaactggggggcctatgtctctggcttcgttacaaacgaaacgtttctcgccttcggacactccaccctggcggtggtacccaacc

SEQ ID NO: 29024 - DNA, 80 bp, Homo sapiens
  chr4:85422972-85423052
  hyper
cgctgggcagcacgggaaggcaggccggtgcctcctgccaggtgctagttgtagtggatctgctgcctgtctacagctgg

SEQ ID NO: 29025 - DNA, 197 bp, Homo sapiens
  chr4:85423633-85423830
  hyper
cagtctaacccttgacgcagaaatgccaagcgcgttttgatacttgttttaagttaaaagaatagccaccaaattcaaggtaactaacggaaggaatgcaaatgaactctcagctaaacgtactaacattctgaagggagggatgataacggttttgccccaaatacagtaatgtcaaatgtcgggatactcaagtg

SEQ ID NO: 29026 - DNA, 331 bp, Homo sapiens
  chr4:85424176-85424507
  hyper
tttgcttcctataaacgccgtagagtggaaactgcacctttgccacaacttctgctgcccagcacttaaggtagagatttgggaagaattgaagcagacagcgtggaaaagcgccgtaggatcttgcgttcggcgctctcccagtggaggccaacaccaaacaagtggggaagcgaccagtgtaaacagccccatccattctaccacagaaaagatctcgaagtccaggacctccctcagcgatatcgtcagtgagagagaggattacagctctccatagagtcgcagaatacgtacctgggagttaagtgcgctccgaagggtggcttct

SEQ ID NO: 29027 - DNA, 301 bp, Homo sapiens
  chr4:85504300-85504601
  hyper
cgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagc

SEQ ID NO: 29028 - DNA, 61 bp, Homo sapiens
  chr4:85887114-85887175
  hyper
ctccccaggaggcagcggaggactagggccaggccgcccaccctggcggcggcggcggctc

SEQ ID NO: 29029 - DNA, 127 bp, Homo sapiens
  chr4:87281168-87281295
  hyper
gaaaccattgtgcagcgtgatgctgcctgtaccattgtggaacctaccagaggagacggacagagggcttggggaatggggttgctatggcaaccgaaaggagcacacatgacgtcaaagcccagag

SEQ ID NO: 29030 - DNA, 835 bp, Homo sapiens
  chr4:87515216-87516051
  hyper
agcctctggctagtccgaagaacgcgaaaagccaggcccaaggcactggttgtcatggcaaccggggcgctggtctccctggcgacctcgtccctagggaggaggtggagctggatgccaggcgggccaatgaggtcgaggggagctcggggtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaa

SEQ ID NO: 29031 - DNA, 30 bp, Homo sapiens
  chr4:87813050-87813080
  hyper
cgtggcagtgctgagcgaccaaaggctctg

SEQ ID NO: 29032 - DNA, 287 bp, Homo sapiens
  chr4:89378338-89378625
  hyper
gcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcg

SEQ ID NO: 29033 - DNA, 30 bp, Homo sapiens
  chr4:89378867-89378897
  hyper
caggcgcggggtgagcgggatactggcgac

SEQ ID NO: 29034 - DNA, 208 bp, Homo sapiens
  chr4:90757517-90757725
  hyper
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaa

SEQ ID NO: 29035 - DNA, 822 bp, Homo sapiens
  chr4:90758090-90758912
  hyper
agtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatc

SEQ ID NO: 29036 - DNA, 56 bp, Homo sapiens
  chr4:90759319-90759375
  hyper
cccccacccaccacacgcacatgcacacagacatacacacgcgaacttcaagacaa

SEQ ID NO: 29037 - DNA, 95 bp, Homo sapiens
  chr4:93225325-93225420
  hyper
accagtgattctctgcgggctgtaggggcgggggcgggggtcttttttggtccgagagggtgcggggaagggggcacatccggcgtgaggggggt

SEQ ID NO: 29038 - DNA, 30 bp, Homo sapiens
  chr4:93226097-93226127
  hyper
tgttttgcagtgattcgtggaatgtggctg

SEQ ID NO: 29039 - DNA, 30 bp, Homo sapiens; identical to SEQ ID NO: 7459
  chr4:93226479-93226509
  hyper

SEQ ID NO: 29040 - DNA, 38 bp, Homo sapiens
  chr4:94750202-94750240
  hyper
ggcgagagagcatcccgtctacccgcctgagctgtccc

SEQ ID NO: 29041 - DNA, 30 bp, Homo sapiens
  chr4:94750621-94750651
  hyper
tgcgcaatgttatcccgtcgttcaacaacg

SEQ ID NO: 29042 - DNA, 735 bp, Homo sapiens
  chr4:94750864-94751599
  hyper
gccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttaggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttcca

SEQ ID NO: 29043 - DNA, 20 bp, Homo sapiens
  chr4:94752906-94752926
  hyper
ggaaaagctaatagtcgtgc

SEQ ID NO: 29044 - DNA, 166 bp, Homo sapiens
  chr4:94753279-94753445
  hyper
taatgcactagggagcgcaggttctggtctccttaagtaagaaactgcagaaccagctttttactgaccacctgggtatctgtggctttcagcggaagccgaccaagagatgcagagaacgtccgccagctctctgggagaagcgagcaggcggctggtgacactt

SEQ ID NO: 29045 - DNA, 30 bp, Homo sapiens
  chr4:94755600-94755630
  hyper
aaaggggaaactgagcggagaatgggttaa

SEQ ID NO: 29046 - DNA, 43 bp, Homo sapiens
  chr4:94756066-94756109
  hyper
gcaaccagcccagcacgcaaagaagctgcgcaaagttaaagcc

SEQ ID NO: 29047 - DNA, 136 bp, Homo sapiens
  chr4:95678866-95679002
  hyper
gtcggctccgcactccgcacacaggcggcggcgctggggccgctccaagtgcgttgagaagtgtaatccctccgctaagtacttggctctcagtctccaatcactagtgggagctggagagggcaagtgaaaaaaa

SEQ ID NO: 29048 - DNA, 76 bp, Homo sapiens
  chr4:95679062-95679138
  hyper
ccgcggtggcggcggcggcggcggcggagcggccgcggcggccagaagttgacggcgcagccgggcgcggggcgcg

SEQ ID NO: 29049 - DNA, 56 bp, Homo sapiens
  chr4:95679689-95679745
  hyper
cagggccagcccaggcgggacccgcaggcacccacctgccccggacgcctcccgag

SEQ ID NO: 29050 - DNA, 56 bp, Homo sapiens
  chr4:96469013-96469069
  hyper
cccatccccaactcccggccacactcttcccaacccggcttcgcccagggccccgg

SEQ ID NO: 29051 - DNA, 30 bp, Homo sapiens
  chr4:96469768-96469798
  hyper
tccagttgaaagcaacgaggcaaattgagg

SEQ ID NO: 29052 - DNA, 30 bp, Homo sapiens
  chr4:96470085-96470115
  hyper
gctgaatccgtgcaccgcgaagcagtccga

SEQ ID NO: 29053 - DNA, 64 bp, Homo sapiens
  chr4:96470823-96470887
  hyper
acgccgggagtgcagcgggcgcgccccgggccactaggctgtgtccagtggagctcagcctgcc

SEQ ID NO: 29054 - DNA, 73 bp, Homo sapiens
  chr4:96470888-96470961
  hyper
cctgccaccttcttcgccgcgccggcaaagcctcagccgaattccctaggactggactcggtctacgacttcg

SEQ ID NO: 29055 - DNA, 328 bp, Homo sapiens
  chr4:101111259-101111587
  hyper
ccggcgtcccgggagcgaactagcggaggaactcctttgccaaaggggtggaaccggcctctgcaactcaatttgacaaagccctgggagcggagccgcaacctgaaactaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcac

SEQ ID NO: 29056 - DNA, 75 bp, Homo sapiens
  chr4:101111797-101111872
  hyper
aagcctgtggtagagcggacacctgttgcttccagggtagatctcgggccactgggaccgcaattccgggtgcac

SEQ ID NO: 29057 - DNA, 97 bp, Homo sapiens
  chr4:101111873-101111970
  hyper
actcgtcaaagcctgaacctgattgttcagtgcgacccctccccgagcgtccgcgctttcacactcaggctgctcccggcagcgggaagctttaagc

SEQ ID NO: 29058 - DNA, 30 bp, Homo sapiens
  chr4:103997969-103997999
  hyper
gcaggccgggcagcccgttacttgttttat

SEQ ID NO: 29059 - DNA, 645 bp, Homo sapiens
  chr4:107955181-107955826
  hyper
aaaggatagctgaaacggttcacacttcaaagctctgggaagagttctggaactgcaaaactagcaaaactgcaaaattgtccccgtgagagggcagtagggggccaagcccgggtcttgtctctctgtccatcccagaatggctcggccctctcaaccaaccttcagccggctggctgcgctgtggacaggggcggcggaggacaccgagagcgcgcaaaacagcagcatcagtcggttccaaggaaactcggatctctggggcgtgggccgctgccaggggttgacacttgtgttgtgcgaggtgcgtgtgccattggtaaaatggctttctcagttttggcttcccacaaaaggagcggaagggggagctgtcatgattcccagtgcccacagagccccctctcctggccacagcgcgccagccacaactggtaccgagtgtgcgcgctcgtctctgtgcgtgtctatttgtataacagtttgcaagtggctttcaatctatctgtctgtatgacagagacagaggcgcctgcggaaagttccctctctcaaaaacgccttcagtgtcctgctgtatcgctggcgcctacgacgctgtcattgtcatctcatcattttgcttccttccgggtgatttatgta

SEQ ID NO: 29060 - DNA, 406 bp, Homo sapiens
  chr4:107956638-107957044
  hyper
gagttgagtttggcccgcgaactgccgatctgtgagctctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtgacccaaggtgc

SEQ ID NO: 29061 - DNA, 113 bp, Homo sapiens; identical to SEQ ID NO: 7472
  chr4:107957249-107957362
  hyper

SEQ ID NO: 29062 - DNA, 240 bp, Homo sapiens
  chr4:107957363-107957603
  hyper
ttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaagagtgacaaagagtgaaaatttttctctcactccccaccgcttccgcccccct

SEQ ID NO: 29063 - DNA, 68 bp, Homo sapiens
  chr4:107957925-107957993
  hyper
agaagtgagcatctgcgcatctgctcattagtattgtgttctttgtgagctcacgtttggttttagac

SEQ ID NO: 29064 - DNA, 112 bp, Homo sapiens
  chr4:107958393-107958505
  hyper
attcctgtcagcccccgggtctctccaggtccaattcccttcggccgaaggtcgaaggctgctccgggaacgactgggacgcgctggcgcttgggggcgccagtggcagccg

SEQ ID NO: 29065 - DNA, 99 bp, Homo sapiens
  chr4:108853188-108853287
  hyper
cagcgacttccacagcgtgcgcgaggcgctggtgcagcaggccgaggtcttcagcgaccgcccgcgggtgccgctcatctccatcgtgaccaaggagaa

SEQ ID NO: 29066 - DNA, 258 bp, Homo sapiens
  chr4:109088205-109088463
  hyper
gcctccccttcctcccgcctgtggctctgctcgtctccacctaagcctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaact

SEQ ID NO: 29067 - DNA, 231 bp, Homo sapiens
  chr4:109089045-109089276
  hyper
cgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgac

SEQ ID NO: 29068 - DNA, 30 bp, Homo sapiens
  chr4:109090379-109090409
  hyper
acccaccgaaaggcacgctttgcccgcgtg

SEQ ID NO: 29069 - DNA, 122 bp, Homo sapiens
  chr4:109092563-109092685
  hyper
gaaacagcaggaggacgcaggaggggcgaagtaaccccgggaagacgttcttccccctcccttacggattcagtgtagttcctggcataagcaattctgtcaccgggcggtcttttctaatt

SEQ ID NO: 29070 - DNA, 1141 bp, Homo sapiens
  chr4:109093142-109094283
  hyper
gagcccagccccgctcgggagcgggcaggagagacagggtagtgacccccactcacaccagaaaacccctccccccggcgattttgctgccaactcgagtcggctacagacagtccagtgagtccttaattacaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtc

SEQ ID NO: 29071 - DNA, 55 bp, Homo sapiens
  chr4:109094529-109094584
  hyper
agtcgcggcggctgccgctttcatcctttcttttttccctcgcaggcccctttgt

SEQ ID NO: 29072 - DNA, 190 bp, Homo sapiens
  chr4:109683609-109683799
  hyper
gtttccaaaaactttcgagttgtgtgggggtggcggagcgctatccttcttccacccatctcccatccctggaatggtgtctgctagggctattggccgtcatccaccaacccctctagccggccggcagcccccgctagtccgccggctgcagagcgagccggggactttcgagcgggcaggaagccca

SEQ ID NO: 29073 - DNA, 70 bp, Homo sapiens; identical to SEQ ID NO: 7481
  chr4:109684016-109684086
  hyper

SEQ ID NO: 29074 - DNA, 328 bp, Homo sapiens
  chr4:110223100-110223428
  hyper
ctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtgg

SEQ ID NO: 29075 - DNA, 20 bp, Homo sapiens
  chr4:110223578-110223598
  hyper
cggaggaccggacctgttgc

SEQ ID NO: 29076 - DNA, 368 bp, Homo sapiens
  chr4:110223599-110223967
  hyper
cctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaatacccttcgcgatgctcgcgtgagtgtgtgtgtgagtgtgtgagtgcgcgcgcgctccgagcacgacgtccctcccccgaccccctcccggcgcccggcgtccggcctgccgctcccgctgctgc

SEQ ID NO: 29077 - DNA, 393 bp, Homo sapiens
  chr4:110223968-110224361
  hyper
cgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatct

SEQ ID NO: 29078 - DNA, 72 bp, Homo sapiens
  chr4:111531853-111531925
  hyper
agcctaggacttcagcgcgacctcaagccaggacttctgcgaggtctcaggtccgagggccaggtcgggcgc

SEQ ID NO: 29079 - DNA, 28 bp, Homo sapiens
  chr4:111531943-111531971
  hyper
cgcgcctccccttcgtccccaggccctg

SEQ ID NO: 29080 - DNA, 77 bp, Homo sapiens
  chr4:111532245-111532322
  hyper
ccctcatttgtcctccgcttcctgcggctgaacggtccttgataagtggcctccagaagattcggtactttgggcca

SEQ ID NO: 29081 - DNA, 306 bp, Homo sapiens; identical to SEQ ID NO: 2439
  chr4:111532704-111533010
  hyper

SEQ ID NO: 29082 - DNA, 32 bp, Homo sapiens
  chr4:111533328-111533360
  hyper
cggttgacaagatggcccggccacccagagga

SEQ ID NO: 29083 - DNA, 30 bp, Homo sapiens
  chr4:111535304-111535334
  hyper
ttcttcagtcaaccacgtttcttgcttccc

SEQ ID NO: 29084 - DNA, 258 bp, Homo sapiens
  chr4:111536248-111536506
  hyper
agcgctcaaggagcacggcggcagtgcgctgaggccagtgaggcctgggcgcctccgggcccaacctcgagctcgccatttttgaacccaagcggggaaggttggtgctcatgctatagattatgttaaaggttcctttaagcactttaatacacaactagctcagaaatcattaagagacctagagaaggagaaaaaataccctcacactcaccggtaataagtgttgacatgcagcaaaaatcggttgagtggaac

SEQ ID NO: 29085 - DNA, 132 bp, Homo sapiens; identical to SEQ ID NO: 7487
  chr4:111536561-111536693
  hyper

SEQ ID NO: 29086 - DNA, 32 bp, Homo sapiens
  chr4:111536943-111536975
  hyper
gagacctaaatcctccgggcaggtctcgttag

SEQ ID NO: 29087 - DNA, 15 bp, Homo sapiens
  chr4:111537066-111537081
  hyper
cggagaggccgggac

SEQ ID NO: 29088 - DNA, 117 bp, Homo sapiens
  chr4:111539478-111539595
  hyper
cgacgggctactcaggttgttcaagttattcaggctgttgagactggagcccgggacgcctgtcactgctgagggcaccatgctggacgacatgctcatggacgagatagagttggg

SEQ ID NO: 29089 - DNA, 33 bp, Homo sapiens
  chr4:111539809-111539842
  hyper
tttctccatttggcccgacgattcttgaaccaa

SEQ ID NO: 29090 - DNA, 193 bp, Homo sapiens
  chr4:111540186-111540379
  hyper
cggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaaca

SEQ ID NO: 29091 - DNA, 49 bp, Homo sapiens
  chr4:111540595-111540644
  hyper
gtttggctttgcaggcggccacccaggccggccggcttccacccgtgtc

SEQ ID NO: 29092 - DNA, 30 bp, Homo sapiens
  chr4:111542950-111542980
  hyper
ggcaccgaagttcgccggccctttcccaaa

SEQ ID NO: 29093 - DNA, 156 bp, Homo sapiens
  chr4:111543190-111543346
  hyper
tgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttgggg

SEQ ID NO: 29094 - DNA, 293 bp, Homo sapiens
  chr4:111543403-111543696
  hyper
cgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggt

SEQ ID NO: 29095 - DNA, 2 bp, Homo sapiens
  chr4:111543720-111543722
  hyper
cg

SEQ ID NO: 29096 - DNA, 214 bp, Homo sapiens
  chr4:111543967-111544181
  hyper
aataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgc

SEQ ID NO: 29097 - DNA, 285 bp, Homo sapiens; identical to SEQ ID NO: 2443
  chr4:111544298-111544583
  hyper

SEQ ID NO: 29098 - DNA, 30 bp, Homo sapiens
  chr4:111549751-111549781
  hyper
ggattacagggtattcgcctagatgaagag

SEQ ID NO: 29099 - DNA, 188 bp, Homo sapiens
  chr4:111549982-111550170
  hyper
agaaactttgtgtaccgagtcagcagcgaggaacgcgacctgtgaagaccacttttgcgggcagggatccgcagggactgactactttcggacaactggtacaatttcccctgggggtgaaaaaccacaacgcggcggggcacctttcaagtgagctgcagatttgattggcgcggggggtgggggag

SEQ ID NO: 29100 - DNA, 341 bp, Homo sapiens
  chr4:111550508-111550849
  hyper
acgtagtatatgctccgcaaacattcgctgattgaatgagaggcgcgggggcggggcggcggagaggggtctgcggccgccaaggccgccagggttaacccaggtccttcgaagaaggttgggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagccaggcgt

SEQ ID NO: 29101 - DNA, 957 bp, Homo sapiens
  chr4:111552994-111553951
  hyper
cttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagagg

SEQ ID NO: 29102 - DNA, 15 bp, Homo sapiens
  chr4:111554950-111554965
  hyper
tccccctttctctcc

SEQ ID NO: 29103 - DNA, 537 bp, Homo sapiens
  chr4:111555259-111555796
  hyper
gcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 29104 - DNA, 815 bp, Homo sapiens
  chr4:111557628-111558443
  hyper
tgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagag

SEQ ID NO: 29105 - DNA, 90 bp, Homo sapiens
  chr4:111558498-111558588
  hyper
cggactcccactgtggaaaggaggaccagaagggaggatgggatggaagagaagaaaaagcaatctgcgccaacccggcagccctaataa

SEQ ID NO: 29106 - DNA, 448 bp, Homo sapiens
  chr4:111558803-111559251
  hyper
agcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 29107 - DNA, 30 bp, Homo sapiens
  chr4:111560186-111560216
  hyper
gggggaaaatgcccacgtgctgtttaattg

SEQ ID NO: 29108 - DNA, 277 bp, Homo sapiens
  chr4:111560442-111560719
  hyper
gtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcccctttcaggtttcagaggtttgcaaaccagggctgagaggaaggggctcgggaagctcacgttcctctcgccccccttctgtc

SEQ ID NO: 29109 - DNA, 24 bp, Homo sapiens
  chr4:111562353-111562377
  hyper
atctcgcactcaaaacggagtttc

SEQ ID NO: 29110 - DNA, 199 bp, Homo sapiens
  chr4:111562491-111562690
  hyper
cggtggctcaggccctttgctcggaccgggaccttacagttctaacccaggagcgttaaactctggaagactccgggccagccctggaggtgcgtggccccgcaagtcgccaggccaagcttgctttttctgtctgcccctccggcaggctgggcgcgctatggcagtgagctttccgcgcaaacggagagctggaacc

SEQ ID NO: 29111 - DNA, 78 bp, Homo sapiens
  chr4:113430619-113430697
  hyper
ctccaatttggatcccgggaggccgagcatctctcacgcggttgacacctctccaggctggagcgcgaagccggcgcc

SEQ ID NO: 29112 - DNA, 83 bp, Homo sapiens
  chr4:113431075-113431158
  hyper
cccactcattccactcggggactaaagagcgactcacttcaacgtcctccataagatgaaccccatcccggctggaaaaatca

SEQ ID NO: 29113 - DNA, 132 bp, Homo sapiens
  chr4:113431723-113431855
  hyper
cccaggctgggggagcgagaaaggggggtattggagccctcacgttttattggtctaacctaatttcactaattctcttttcacacatttcttttgcagattcggaggccgggactttcacgctcccgggag

SEQ ID NO: 29114 - DNA, 240 bp, Homo sapiens; identical to SEQ ID NO: 2445
  chr4:113431915-113432155
  hyper

SEQ ID NO: 29115 - DNA, 278 bp, Homo sapiens
  chr4:113432226-113432504
  hyper
cgcccagggccttcgcctcagctgggacaccaggagcgcccatccggctctggtccaggtgctgcgggcccgggaagcctcagcccctcctcctgcctccggctgagcctaggtccggctcccgtggcgggcccagcggttggcagtccgcctctctactttttttttcctccttcttggcactcagatggatgtatttaaaatctagtgaaggaaaaatgagccgtaacaaggcctgagcactttagaacaaataaatacagccagtcccggaacgc

SEQ ID NO: 29116 - DNA, 91 bp, Homo sapiens
  chr4:113432518-113432609
  hyper
cgacgctccaatgagaacaggacccaccttcgcgcctctccgcacttaggaaaacgcgccgcagcgcgctagctggcgttggaaagatcta

SEQ ID NO: 29117 - DNA, 748 bp, Homo sapiens
  chr4:113435837-113436585
  hyper
aggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtggggagcacctcgcgcagcgcgtccagtgccgcgttgaggttgtgcatgcggtttcgctcgcggttgttggccttcagtctacgggtcttcttgatgcgctgcaccgtctcggccgtcttggcgcctcgggagacggcccgcgcccgggaagggcgccgtttgcaatcgtgtaccagacccagcagccgtgcgggccggcagccctccgcacccgcagccacgccgccccgcgccccctgcccggcctcagccccgcgctgccgacgcgccccgcctgacgcgcccggctcctcctcctcttcttcgtcggcgctggatgacagcggggtcagggccgccaaggcgggggaggccgatccgagcagcactaaca

SEQ ID NO: 29118 - DNA, 314 bp, Homo sapiens
  chr4:113436841-113437155
  hyper
ccgggtcctgccctccgcgggcggtcctgcgttccctccccgagaagggactgcggcctccgcgacaaagattctgcgcggagcagagggcgtgcgggtgtggttggactgagtgcggggaaaccacctgcgtagttggaagcggtggctcgaatacttacttagttggctctaactgtgcctcagcgttgctgtgactttggcctgtgccgggaatctccgcgcagctgcgagcgcagcgccgggtccttcgcccggcgtgaaagctgcaagcccggcgctactgtggcgcagctccgcgggggacctctgcg

SEQ ID NO: 29119 - DNA, 579 bp, Homo sapiens
  chr4:113437622-113438201
  hyper
ctcctgttggagctccgggctgcggccggagctggcgaagccgcagcggccgcagaggctcaagctgcggctgttgtcgccgccgctgtccattgtgattggtggctcgcgctcggctggagcgtgccgctaatttattaatgaatggaggtcgcgaggcgcagctggccaatcagggcgccctggactccgggaggcctgcgagccacgcgcaccggagcccgctccctttcagcagctcattaggggcccgagcgctgggggcggatggggggacccgtgctaccgcccccgccttcgtcctcgctgccgccgaggctccccccgcccggcgcgcgcgcaggcaccgcacccggcgctgccggccctcctaactcccgggtgatgggaactaggaattagttaatgggggtcagaatcccggggaaagcagttagccctgtggtgctgccgggcgtctcttggcaaagcctcttaggggttgtatcaaatagtaaacgattttaaaatggattcatttggttaggggaggagaatggcgtggatggagagatgtggacacctcgtgaacaagtgtgt

SEQ ID NO: 29120 - DNA, 198 bp, Homo sapiens; identical to SEQ ID NO: 7510
  chr4:113438506-113438704
  hyper

SEQ ID NO: 29121 - DNA, 594 bp, Homo sapiens
  chr4:113441592-113442186
  hyper
gttgcaggtgactgtcgggggcgcgaaagagggcgcccttccctgagaggacaaaagccaaggtttggctatccagcgagcctgtcccccaattcacagtaaaccaccgtcggccaaaggagatggcgtgtctactctctgctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcc

SEQ ID NO: 29122 - DNA, 279 bp, Homo sapiens
  chr4:113442246-113442525
  hyper
cgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatccccacctgctctggggaaggcaaagctccgcagacttcttatc

SEQ ID NO: 29123 - DNA, 284 bp, Homo sapiens
  chr4:113444011-113444295
  hyper
tgttttatatatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataac

SEQ ID NO: 29124 - DNA, 152 bp, Homo sapiens
  chr4:113444296-113444448
  hyper
cagttgctagtacagctctcggcggaggagccagggccgggtctccaggccgggagggggcggccgcggtgcgcccgggcagcgctccctgcgcaagtagttcttctatgtctttacacgcacttccaaaaaaacttcgcaagtcacagaaa

SEQ ID NO: 29125 - DNA, 500 bp, Homo sapiens
  chr4:113444944-113445444
  hyper
cccctccctcatttacgccttcaagcagtatgggggcggagaagacttttaaaacaaaacacaaaacaagatcttttgcgagagcggtgtccgagggagccggagcgctgacaggtgtgcaggaggcgccccctacagcctgctgcccctctcggggttacactcccttcctgccgcacctgagcgttttcaggacgcgctctggtcctggagggccgggcccgcccgagggcagccgattcacggcgggcgcgctgcgaagtcggggcgccccctggtggggcacggaggtcgagggggtatcctgagagcaccgcggggcttcggggccgcgggggagctcccaagacagccggccaccgggggacagtggatttggggtctcctcgaggtcggtccggggacgccctctgggaagcttcacctgcggctcaggttacaaacgcacagtgcccagccacgtcctcacctgcagtttcaaaagccgaaagaaacaaaca

SEQ ID NO: 29126 - DNA, 99 bp, Homo sapiens
  chr4:113626580-113626679
  hyper
aacaaagaatgtgtgcgcgtggaggctagaggtgggtgggtgggtgggtgggtgccttagcacaactccagcggagagtgagtgcggataggaaatgtg

SEQ ID NO: 29127 - DNA, 53 bp, Homo sapiens
  chr4:113627418-113627471
  hyper
cgcgtcccccaagggcggggacctcaaccccaatgcggcggctcccctaggag

SEQ ID NO: 29128 - DNA, 64 bp, Homo sapiens
  chr4:114900586-114900650
  hyper
gtttgccaatctccccgacactcaccaggcggcgaagtgaggaagaagccgtttcctgatctcc

SEQ ID NO: 29129 - DNA, 55 bp, Homo sapiens
  chr4:115520068-115520123
  hyper
tcccggatacaattacgcggcagacacacactcaaactcgcgcggggcagccaag

SEQ ID NO: 29130 - DNA, 190 bp, Homo sapiens
  chr4:115520755-115520945
  hyper
ggtggcagggtttcacgggtccccgcgccgatttgggaatggtacggggtgcccttgcattagagaagcctgtgcgggcccccgggattagagaagaggtgagcgcctgcgggcggggagagaaggacgcgctgctggcaaaaagaagggcgccttccatggactggaggagcggcgagggagcctggta

SEQ ID NO: 29131 - DNA, 51 bp, Homo sapiens
  chr4:117847235-117847286
  hyper
gggcggccccgcgtccgggcggctctctgaggctacgcggtgcccggtgtc

SEQ ID NO: 29132 - DNA, 153 bp, Homo sapiens; identical to SEQ ID NO: 7517
  chr4:117847306-117847459
  hyper

SEQ ID NO: 29133 - DNA, 21 bp, Homo sapiens
  chr4:117847469-117847490
  hyper
cgggcccgctcgtcctgggac

SEQ ID NO: 29134 - DNA, 42 bp, Homo sapiens
  chr4:118955083-118955125
  hyper
cggggccggtctcctcgcccagaaacccgatccgggcgcctt

SEQ ID NO: 29135 - DNA, 47 bp, Homo sapiens
  chr4:118955468-118955515
  hyper
gcatctgtcttcccccgaagtggtaccaaagccggtcccttggcgac

SEQ ID NO: 29136 - DNA, 54 bp, Homo sapiens
  chr4:119273444-119273498
  hyper
gcgccgtcggggctccgacaaaagttgtggcgctgtcctcgcagctgagcccag

SEQ ID NO: 29137 - DNA, 66 bp, Homo sapiens
  chr4:121843230-121843296
  hyper
ctaaaggaaaagaggcgacagcggagcagcgtgcgcgcgggggaaaacacccgcccacgcgtgcct

SEQ ID NO: 29138 - DNA, 199 bp, Homo sapiens
  chr4:121844007-121844206
  hyper
gggcgcgggcctgggcgctgcgggcgccgggacgccgctcgctgattggcccgaagttggcggctctgacccgcgcccgggcgcgaagcccggagcagggctgaccccagggcctcaaacccggaggcccgcgagctgcgcgggccgtcagcacccctagccccggcgcggcggcgtgcgttcccgcctttgtccagct

SEQ ID NO: 29139 - DNA, 624 bp, Homo sapiens
  chr4:121992072-121992696
  hyper
gcccgcggcaaactccgaggagctgatgcggggcgggtccggggaactgccgggagctctcacgcctgggcctgggatagggtgcgggcagaaaggtgaaccgagagcgcacaatgcaacgaaaccgcactccaaattcagcagtttgcaaagtgcctccaagaaaacagctgggacctgcaatcactcgttcggactcctaggttatcggggccgcggcgactccgctcagttagaaaggtagcgcgggtgagagcgaaccccaactcacgcacagacaggacgagggcacgaagccgagtctcctggctggggccgtagggggcgtcacctcggtggccgctctgctctccggaagaaagtatgagccggtcccaggccacctcgctcagcccaaggaagtttctataacgatgctcgcctaccacgcagaggacaaatgaggagccagagcggttgggggtcgggccaaccgaactcccggccccggctgcgcagctcccagacgcccaccaagaactcgtgcgctgcctggacctctagcttttcgccctacacgcagacgccctctgcaaaaccccagtcccgcagactttccctagcggcgggcggagggcatgaacc

SEQ ID NO: 29140 - DNA, 280 bp, Homo sapiens
  chr4:121993436-121993716
  hyper
atcccggggcagcgccgagaagcggcgggaggtccttttaaactgcagggagcgtgcgggggctgggcggcgggaggatgccgcagcgacccgcggggctggcgcgggcttcgccggccgccgctagtcgcacaggcgcctggctggagcgccgcgcggggtgctgggagagccgggcgcacggggcggcagcggccgtggcgggtgcgctgctcagttagctccactctctcgcggctggaagtggggagtgtgtgttcgctcccgagtgtcactgctg

SEQ ID NO: 29141 - DNA, 352 bp, Homo sapiens
  chr4:121993995-121994347
  hyper
cccaaacaggaccctcgcgggcggcatcgcgagggacacgctgctgtcctaaccttagcgccactcggggagaatgaaggaggcccaccgagcccccgacaaagctgcaaaacccaggagacgcgcacgcgggaccatcacactgtcaagcagaccggggtgcacaatagagggaaactctggggttgatctgggggcagggagggggacgtgttaaatccagaaggttggtggttggaggcggaaagcagagtgtgcaaactgtgcattcatgtcccacttttcacccgaacgcctgcctatcacagccttcactcagggagcgcttccccctcggcgcagaccgagcctc

SEQ ID NO: 29142 - DNA, 291 bp, Homo sapiens
  chr4:122301422-122301713
  hyper
ttaagagagaaggagcgaaggagcggggcgcgactcttaccccccagccagttgtcggaaatgttctggagcatggtgacgggaatgcagaagaaggtgatgagcaggtcactgagcgccaaggagcagataaagatgttggtgacggtgcgcatggccttgctgcgggtcaccacgtagaacaccagagcattgccaaagagcgccagggcgaagatgagcacgccggtgagcacgagggccagcttggcgcgtcccggcagctctggggtgtagacgagcggtcgcagc

SEQ ID NO: 29143 - DNA, 376 bp, Homo sapiens
  chr4:122301962-122302338
  hyper
cgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctggggtgctggagcgccacgcgagggtcctggcgcctctggctccccgccttctggccatgcgatgcggacgccggacccgcttggggagcggtggagggtggggctgaactcggtgacgcctccctcacacccagcttcagtggcgccaacgccgcttccccgcaccctcagggcgagggaagacttccctggctcaccaacttgctgccgcccagcgcctttc

SEQ ID NO: 29144 - DNA, 46 bp, Homo sapiens
  chr4:122685845-122685891
  hyper
accccatacacccaccgtccctggcacccgaacgcgctgcgagccc

SEQ ID NO: 29145 - DNA, 340 bp, Homo sapiens
  chr4:122686113-122686453
  hyper
cgagaggcgcccgggctggagcgccccggccgtgttggccacggagttcttcagctgcttgatgaccacgaagagcaggaggaaaagtaagaagagcaggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatcc

SEQ ID NO: 29146 - DNA, 227 bp, Homo sapiens
  chr4:122686454-122686681
  hyper
gcgcagactctcccagctggcaccaaagccttccgcttcgccgagatcctctcaggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaat

SEQ ID NO: 29147 - DNA, 1252 bp, Homo sapiens
  chr4:122871208-122872460
  hyper
gaagtgagctggtggcgctttcatcccaaaggatataccttccctccatttcctgggccgtttccattccacgcttatcttcagcaataactgaaccacatcgggatgcgtcgctcatttaaaatcagaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcgccgcccgccaccatccgaccccaagttctctacctagttctgagcgttcttcctaaaaaagacagtaaaccctgcggcactcccagtgttacgtgacagaaaaaatacagagcatctcaccctgtgaaaccgatcaccctctttttatcttctctgcgtctcgcactgattaaaagctgtctccaagattggaaattaagaaaagttgctctttctcatgcattagcgcgccgaccgctccttcgtttagaaagagagagagggaaagaaagaaagagaaaaagagagcccgcgcgccggggcgcgagccgctgaccctgcaccgcctgggaaccgcagtcaaagttatcactaaagcggttccccggctgcccgatgcccactctctccctcaggggaccctatagggcttcggttccagttttaccccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcctccggccga

SEQ ID NO: 29148 - DNA, 497 bp, Homo sapiens
  chr4:122872667-122873164
  hyper
ccgctgcgagggcgccgagcgcggctccagccccccgttgacgcccctccagccccggcggcggcgctgcggctccgcgccctcgtcctcgccctcgtcttcctcctcctccggcgccgggaaggtcacccttgcttgttctttgcacttcctgaccttggtggacatcgcgccggctgcggtccgagtgtgggggtgccggctgccggcctcctccgccttcgcggcagtgcagtcttcccgcggcgccccttcaccacctcccgcggcttccggggccccgggcggcccagggcgggaaggcaggagcggagagcgtcgcggcccgcgatccagcagttagaggctagcgccgaagccgagctgccgccgcccaccatcaaaccgtgggagcagctgccgcggccgtggctgcgacgaggaagcccggggccgagcggggctctggtgctgggagaggctctccagccccgcggcggcggcgatgcctcctcggc

SEQ ID NO: 29149 - DNA, 1100 bp, Homo sapiens
  chr4:123747826-123748926
  hyper
cttgcgtgttgtggccgaaccgccgaactcagaggccggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacagtgagtgccgacccgctctctccgcctcatttccatttcgtgggttctcgcccgctctctcccctccagcctgcaccctcctcccggatcttcactgcgaccctagcgctccgtgtggtttctggccgcgcggccctcggcggtttcgggttcaccactcaccccctcctttccgggctgcggcgtaggcccgggtgtcccctgggctttggggtgtgccaatttgccctgtaaaccagtacccccggcccggagccgcggcgcgccggggcctcgcggactggctgtcttcccgcggacaacctgtcgcgtcggggatgcccgcggccccgccatgcagctctggccgcttctatctgctgcgtgctgtcccggggacaaagacaggaaggaccgcagcagaacgaaacggtctttac

SEQ ID NO: 29150 - DNA, 127 bp, Homo sapiens
  chr4:124426734-124426861
  hyper
gggcaattataactacggcaaaaaaaaaaaaaaaaaaaaaagagttcgcagggacgcagcgctgccgccgccgccgccgaggccgcgaccacggcccgagccggccaccgcgcgtcaaaggagccat

SEQ ID NO: 29151 - DNA, 51 bp, Homo sapiens
  chr4:126235891-126235942
  hyper
ttagcgcctccgcctcgctgtgctcccacaccagaccgcctacagccctcc

SEQ ID NO: 29152 - DNA, 30 bp, Homo sapiens
  chr4:126236943-126236973
  hyper
agcggccactgccggcgccctgttggaggg

SEQ ID NO: 29153 - DNA, 32 bp, Homo sapiens
  chr4:126237355-126237387
  hyper
atctctcttgcactccgcgttcaactggctac

SEQ ID NO: 29154 - DNA, 554 bp, Homo sapiens
  chr4:126237654-126238208
  hyper
tactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccg

SEQ ID NO: 29155 - DNA, 341 bp, Homo sapiens
  chr4:128544048-128544389
  hyper
tgtccctggccaaggcggcctcgctgtcctggaagggagggtgaagagctgcatcccgcactaggcggcgaaagagggcagcgccaagcggcggggtccggaggcgctcgacggctcgcgcccagcgccggagacgggctgtgtgttgggccagtggaagacaccggagaaacccagacgtggaagaccgggcagcctggacttcgcgagccctggtggggctggcggcccacagagcccccacctgccccgagctcccacagcgaggagtggccgcgccgcccgccagtgcgccgggctccgagaccggcaggggagcacgcgggcgaaggaggggccgc

SEQ ID NO: 29156 - DNA, 160 bp, Homo sapiens
  chr4:128544646-128544806
  hyper
gtcagtgcagggccccgggacgcggggcgagaccgtcctcttgccccggaaatgttggcgagggaggggccgcttttctttctggggtctttctggaagcatctgacttgggattcgccttagtgcggcgctggccgcgaagggccgttgggacctgcac

SEQ ID NO: 29157 - DNA, 227 bp, Homo sapiens
  chr4:134067790-134068017
  hyper
ggaagaagaccctaccgtcactccgccggtccctggctggcgccacaaagactagaagtcggagaggcgagacctctagggggcctgggctcagcgacgctggtgcggacacagacccctatgacccaagaaatcttgtagagcccccaaaaggcgagctctccaaagcaaaattctctggcctgccctatgctgatttcgccgctaggagacgcctgtaacccacg

SEQ ID NO: 29158 - DNA, 77 bp, Homo sapiens
  chr4:134068322-134068399
  hyper
atacgtacaaatgaacgcattagaaaattaccgtcattttttaaaaggctccaggattctgacgagtcagcttgaag

SEQ ID NO: 29159 - DNA, 75 bp, Homo sapiens
  chr4:134068702-134068777
  hyper
tgaaagagccaagtgcgggggccggggggacccggcgttgcggggagttggggcgcggaaatcagggcagtagac

SEQ ID NO: 29160 - DNA, 143 bp, Homo sapiens
  chr4:134068778-134068921
  hyper
tgcattcgcgggactctcagaagcacgtctcaggctactatcacgcccatggacactagccctccttaactccttgccaggaggaaatggcaacgtatctccaggtcggaaaacgactctacttttcccgcaggttgtggtgg

SEQ ID NO: 29161 - DNA, 127 bp, Homo sapiens
  chr4:134069769-134069896
  hyper
ctgcccgtctgtaagcgctgtcatccccacatcctttagcgtgaattcctccgctttttaggagtcacctccaccccctactccgtatgcttcgcgcctttcctcacggccccgtcagaccccctca

SEQ ID NO: 29162 - DNA, 150 bp, Homo sapiens
  chr4:134070219-134070369
  hyper
ccccagccagcgcctcgggacctgcggggctgttctcgctctcacactcacactcaccccggccgctcgggcgagagttctgtcccgccccgcccggctgccgcgtgacgtgtctgtttggcggccagtttggccaatcatcggcagctc

SEQ ID NO: 29163 - DNA, 68 bp, Homo sapiens
  chr4:134070370-134070438
  hyper
gtgggtggtgctcctgggcgattggttggcagaatgagggcgctgcgcaaaaacggagaagccgagcg

SEQ ID NO: 29164 - DNA, 1559 bp, Homo sapiens
  chr4:134071052-134072611
  hyper
gatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccgggg

SEQ ID NO: 29165 - DNA, 304 bp, Homo sapiens; identical to SEQ ID NO: 389
  chr4:134072676-134072980
  hyper

SEQ ID NO: 29166 - DNA, 349 bp, Homo sapiens
  chr4:134073292-134073641
  hyper
gcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactc

SEQ ID NO: 29167 - DNA, 126 bp, Homo sapiens
  chr4:134074030-134074156
  hyper
ttagcttatgtgtatcgttgtgggagcagagatgggcggtcaccttctcccactccttcgtgtgtaacctaactttcgcgttgttccaccctttcacatttattttcattccgtccccttggtact

SEQ ID NO: 29168 - DNA, 565 bp, Homo sapiens; identical to SEQ ID NO: 390
  chr4:140200592-140201157
  hyper

SEQ ID NO: 29169 - DNA, 361 bp, Homo sapiens
  chr4:140201192-140201553
  hyper
cgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggagacctttgtagtcctcaccatcctcccctaacccatctccagctctgttgctatccctgaggtctctagagctgaccgcggcatctcagaaaa

SEQ ID NO: 29170 - DNA, 629 bp, Homo sapiens
  chr4:140655870-140656499
  hyper
atttataaatctgtgcgtagggaagctttatttttctgaagtgttttcaagaacatgcatagtgtttgggtgagaggggccagccttgctggcggcgaaccaaagagcagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcgccccctcccctcgcagatggcttaatcagggctcccgcccgcccctccgcggcccccgccccgcgcgtctgggcgagcgctgcgaacgtggagccaggcagtcaagtgttactgcgtacagcaggtagcctggcaactgagagcacaataccgagcagatggtgttcgcacggcgtgatggacatcacacacgacagcctgagacaatccaggaattccctggtgactcgaggccctctttgcacaaaatgagttctctctccattgccgtgtatctctggggttatctgcccccctcctccgactgacactgaactggtt

SEQ ID NO: 29171 - DNA, 149 bp, Homo sapiens
  chr4:140656999-140657148
  hyper
gcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcgtgtgtgttagtgg

SEQ ID NO: 29172 - DNA, 47 bp, Homo sapiens; identical to SEQ ID NO: 7547
  chr4:141294349-141294396
  hyper

SEQ ID NO: 29173 - DNA, 218 bp, Homo sapiens
  chr4:141294633-141294851
  hyper
ggcaaaggtggatcccggtgctttgagattggacgactggggtgaggcgggcagctaatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttct

SEQ ID NO: 29174 - DNA, 208 bp, Homo sapiens
  chr4:141295066-141295274
  hyper
tttttctcctgttttcgttgtcaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcg

SEQ ID NO: 29175 - DNA, 394 bp, Homo sapiens
  chr4:141348031-141348425
  hyper
cccagccctttcgcccgccccccggcggcgcacaatgggctctgcgcgggtatcgagggagcggccaacagtccctggccccaccgccgtgaagtggggtcccttcgcttccacataggtggagactgagacagccgagcctattttgatctcgtttgggtttctgtaaggagcagtcagcagagtgagcagcgcccagacgcgccccgggccccctctacaaccattgggagagcgccccgggctcaagcgtggaacggggctgcaatggcaaccgctggaataacggcctcggctcccggtggctcctcaagcccgcaggggaggccggccgggctaggcacctagctgtccccgtgctcgtccgccccagcccgggcgcagcaggtggatg

SEQ ID NO: 29176 - DNA, 590 bp, Homo sapiens
  chr4:141418867-141419457
  hyper
gaaggaggaaagatgcggacagatgctggctgtgtaagagcagttcttggggtcagacagccatagtttcgagaaggaagaacaggagaggggaaaagcagtgcacagacggggtccttgaacctttgaggaaaagggagcggcgggtaccctgggccagatgcgttagcgcgcgtgcaggccggacgcggccctggaggaggaggtcggggcgcgggttacagcccagccgccgctgaccggggtaggcgcggcctcgggaaggcaccgacgcgggcctcccagtgccagcgcgggcggccgccgccagcttcccgcatcgcctccgcacccgccgaccctgccccgcctgcattcctgcagccccgaagcccccgcggcgggaaaggaggcgggaggagggcccgccgcttactggtttgagttatcctgtagatggagaagcaagagaagctgaacaacgcgacggcgaccagggtgatcagcaagttcacctgcttggtcctcatggccctggccaggctgcgggaggccggcgggtggaggcggcggataatgccagggacggggttgagcgcgcagagccccct

SEQ ID NO: 29177 - DNA, 266 bp, Homo sapiens
  chr4:141488816-141489082
  hyper
atatgaatgttttctcgccaatttgttatgaaaaccactcctctgtgtgttacactttttggaacagagcggagcccaaggcttttctgcccctcccaggaacgctcacggcttactttctttccctgcggtgaggaactcctggaccgtgtcgtagaggccgatcctgagagaggcggagctgatttgccgctgaagccccgcaggcagcccgctgtagagtttcatccgcccttctgtttttaccacagcggtgattgttccca

SEQ ID NO: 29178 - DNA, 749 bp, Homo sapiens
  chr4:142053505-142054254
  hyper
tggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgcc

SEQ ID NO: 29179 - DNA, 419 bp, Homo sapiens
  chr4:142054255-142054674
  hyper
agcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcggagtaagcggtccgtgtgtgtgtgtctgtatgtttgtgtgtgtgtgtgtgtgtgtgtataatgtgtgcgtgcaaggaggagc

SEQ ID NO: 29180 - DNA, 303 bp, Homo sapiens
  chr4:143766796-143767099
  hyper
aaaaaacaaggcaaccgggaccaccaacatcagtcaccctcactccccaccactgcctctattccttaaggacttcttcccaggccggcggcggcggcggcggcggcggcggcagcttgcgatcatcaggattggaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgc

SEQ ID NO: 29181 - DNA, 32 bp, Homo sapiens
  chr4:143767625-143767657
  hyper
ctcgcctaccagccccgcgcgcgccccagaga

SEQ ID NO: 29182 - DNA, 358 bp, Homo sapiens
  chr4:143767920-143768278
  hyper
cgtgtgctcacaccccgtaccccgacccctttctgcggcccctctgcccgctgggtcgcccacccagactgggctgtgggatcaccgctaccgcgacgaggggggacccgaggccgccacgctgctgcgggggcaggagaaaccacagagaaagaacccgcgggaggaagaaagcgccccagaccccggcctatggcagcgcagtccctagaccgagggtttttggaaggggcttgggatccctgctgtcactgcctgcgtctaggcatccattcacgcctgctggaccccagtctgcagccgcgctgggacccctgtctcttgcccctcctcccccttgccccgggcagaggtcggg

SEQ ID NO: 29183 - DNA, 42 bp, Homo sapiens
  chr4:144480322-144480364
  hyper
tagaatacagaaaggcgcaggcagtcacgtaggactaggccg

SEQ ID NO: 29184 - DNA, 30 bp, Homo sapiens
  chr4:144620978-144621008
  hyper
cacccgcggacccagcgtcttggccctcag

SEQ ID NO: 29185 - DNA, 142 bp, Homo sapiens
  chr4:144621298-144621440
  hyper
accaaaggcctgttacgcgtcaccagctccagctgggagaagaccaagtccaccgccagcgtgaagggcagcaccagagtgtgagtcggggcgtcgtagcgcagctgcagcagcacccgggcgcgtccggggctgtgggagc

SEQ ID NO: 29186 - DNA, 383 bp, Homo sapiens; identical to SEQ ID NO: 394
  chr4:144621514-144621897
  hyper

SEQ ID NO: 29187 - DNA, 250 bp, Homo sapiens
  chr4:144621981-144622231
  hyper
cggctgctgcaggtaacggcagcgggggaaggggctctgcccacttcctgctcagccccggtcgcaagtctctctctgctggcttctggggaccccagatacgcgcccagcgcggcgagacttagcgagggtgcagcgctgtcccctccgctcctgggcgcttcacccagcctaccttacacaccttctcgccgggagccgtggccgccgcactgctgcccgcgctgccagactccgaccagctgtctgg

SEQ ID NO: 29188 - DNA, 30 bp, Homo sapiens
  chr4:145567357-145567387
  hyper
tcatctagagcccagcgctggccctgcctc

SEQ ID NO: 29189 - DNA, 127 bp, Homo sapiens
  chr4:145567810-145567937
  hyper
gctgctctgggcagacgatgctgaagatgctctcctttaagctgctgctgctggccgtggctctgggcttctttgaaggagatgctaagtttggggaaagaaacgaagggagcggagcaaggaggag

SEQ ID NO: 29190 - DNA, 377 bp, Homo sapiens
  chr4:145568226-145568603
  hyper
ataacttttctatagcgctaacgtgattccgttgtgtgttcctctggggtaagcaagtagcatttcctcccccagagtccgcggtcgggatgctgtgcaaacttgcctatctctgaaaacagacgtttctgcggtacccgcaccctgggctgggtaaatattttaaaagaatcgcgatgaacagtgtgttttggatcgaatggggcattggctgcggtgaaactgtaaattaaggtggctgtggtttccggcttatttttctagggtaaaaagatttgtgctgttttctccacgtgctcggttagggagaggattgaatcgtaaaggatgttgaagcatggttggtttatgatccccagccccgtcagaggggggtg

SEQ ID NO: 29191 - DNA, 266 bp, Homo sapiens
  chr4:147558116-147558382
  hyper
gctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggcggctcctgaggacagcggtcccatcttgaaaccgctattccgcccggctgaggtcaggggtggacaggcggtcccctactctccaccgccgcttccgggagctgaccacc

SEQ ID NO: 29192 - DNA, 140 bp, Homo sapiens; identical to SEQ ID NO: 2466
  chr4:147558476-147558616
  hyper

SEQ ID NO: 29193 - DNA, 889 bp, Homo sapiens; identical to SEQ ID NO: 396
  chr4:147559190-147560079
  hyper

SEQ ID NO: 29194 - DNA, 286 bp, Homo sapiens; identical to SEQ ID NO: 397
  chr4:147560133-147560419
  hyper

SEQ ID NO: 29195 - DNA, 52 bp, Homo sapiens; identical to SEQ ID NO: 398
  chr4:147560459-147560511
  hyper

SEQ ID NO: 29196 - DNA, 231 bp, Homo sapiens
  chr4:147560915-147561146
  hyper
ttgtaggcgcggcgacggtgtcgagccctgggccggggcttccggagagagggcgtacaattccctgctgagcgtaatgtgtgccttctacttacaattgcagagcaatatattcggcgggctggatgagagtctgctggcccgcgccgaggctctggcagccgtggacatcgtctcccagagcaagagccaccaccaccatccaccccaccacagccccttcaaaccgga

SEQ ID NO: 29197 - DNA, 591 bp, Homo sapiens
  chr4:147561359-147561950
  hyper
cgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgc

SEQ ID NO: 29198 - DNA, 96 bp, Homo sapiens; identical to SEQ ID NO: 7563
  chr4:147561999-147562095
  hyper

SEQ ID NO: 29199 - DNA, 243 bp, Homo sapiens
  chr4:147568636-147568879
  hyper
ttttcaggaacaaatcgatgagatagggatgcgagagagggaagatgaaggcttttcccaatctaggtcacttctttgcggagaggccttctcagagctttgggtaagtgaagaggcgccttaagttcgcggtcccagctgctcaggctccgcagcctggaggcgggaaagggaacagtgagactgagaagcaggacgcggggacagcgatctcccagaagctttcctcgcttttggtggcta

SEQ ID NO: 29200 - DNA, 151 bp, Homo sapiens
  chr4:147569117-147569268
  hyper
ctcgctggaggagctcgcccggtccccgaggggcccccagagctggggaagcaggcgtctcgccaggcgctcagcaaggaacccgcaagaaagagaggcccgggcgcctcgcccccttgcattttactaatcacgtctatttaaattctag

SEQ ID NO: 29201 - DNA, 257 bp, Homo sapiens
  chr4:147569278-147569535
  hyper
cgcgctctcaccgggaaagctctggagaactggacccatcaattattctgaaaaaatccctgactacgtgaggcttccagccagcgggagggaggcggcgggaggaggtggagaacccagcccctacccctctcccctcctccccgcccctcccagcgcggcctcttgatatacactcatcttcagggttctggggccccagggagacttgtgcgcattttcagggttcgagcttttgtggacgaggaaggaaggtg

SEQ ID NO: 29202 - DNA, 30 bp, Homo sapiens
  chr4:147569897-147569927
  hyper
tgcttcccccacccccgcccagcttcaccc

SEQ ID NO: 29203 - DNA, 156 bp, Homo sapiens
  chr4:147576046-147576202
  hyper
gcggtgacagatgagcggctgggtcaggaaggagcccagttggtggaaatgacactctttccccgctccgggtcccctcccccaccccattcgcgttttctctctcggcctctcctccctcctcgccttgccctcaggcagccgaccggggacaca

SEQ ID NO: 29204 - DNA, 515 bp, Homo sapiens; identical to SEQ ID NO: 2470
  chr4:147576329-147576844
  hyper

SEQ ID NO: 29205 - DNA, 356 bp, Homo sapiens
  chr4:148402241-148402597
  hyper
cgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtcggtgcaagtctttcttatcggggactgggactggggcgggtgcggggatggcggagacgctgcctg

SEQ ID NO: 29206 - DNA, 46 bp, Homo sapiens
  chr4:149365169-149365215
  hyper
ggagtccccgccgagcgtcccaactttcccgcggggcccaccgtca

SEQ ID NO: 29207 - DNA, 139 bp, Homo sapiens
  chr4:150999450-150999589
  hyper
ggaagcctcctccagcgctgacagcctgtcggcggcggagggaggccagagcgcggatgcttgccagtgggccgggcctgaccgctgcgtgggaggcgggctgcattatttcccgctagggccgcgctccagggaagga

SEQ ID NO: 29208 - DNA, 57 bp, Homo sapiens
  chr4:151000206-151000263
  hyper
gagcactttgaggaacgggacaaaaggccgcggccggggtcgcggagaggggccccc

SEQ ID NO: 29209 - DNA, 202 bp, Homo sapiens
  chr4:154143837-154144039
  hyper
agagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggagaggagcgggt

SEQ ID NO: 29210 - DNA, 79 bp, Homo sapiens
  chr4:154144397-154144476
  hyper
ctcccaggccctgcccgcggagctctcccgggagtcgcggacctctgccgtcctcagtcacccgcgtcatgcaggatag

SEQ ID NO: 29211 - DNA, 195 bp, Homo sapiens
  chr4:154680759-154680954
  hyper
gagggactggcaccccgcacggtggcatcttccagaaggtcatgcgtccgtccccacgtctttccagggccggttctccccggtggggcccggggtcttggagaccagtctgtgcagcctgcccggcaccagcgtgagccccgggaccccggcctggcgtcccccacgcccgcgcccccgcgccagtacctgctc

SEQ ID NO: 29212 - DNA, 21 bp, Homo sapiens
  chr4:154681176-154681197
  hyper
gggagcctcccggcacgcccc

SEQ ID NO: 29213 - DNA, 139 bp, Homo sapiens
  chr4:154681198-154681337
  hyper
cctccgccccctgcacgctggccagcgtcctccccagcagcggcctcgaggtcccggtcgccagcaccccggttccttcagaacctcaggcctcccattcagccagccattgtcgccgataaagcgtcttgagccctac

SEQ ID NO: 29214 - DNA, 93 bp, Homo sapiens
  chr4:154709106-154709199
  hyper
aaacaccacttccaacgctctgcgcagctccagtgctagcatctttaacaataatcgtgtatctatttttttttaaaccgccgttcagttctt

SEQ ID NO: 29215 - DNA, 135 bp, Homo sapiens; identical to SEQ ID NO: 399
  chr4:154709476-154709611
  hyper

SEQ ID NO: 29216 - DNA, 70 bp, Homo sapiens; identical to SEQ ID NO: 400
  chr4:154709758-154709828
  hyper

SEQ ID NO: 29217 - DNA, 769 bp, Homo sapiens
  chr4:154709829-154710598
  hyper
atgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcgggctgcgggagtggggggcacgcagggcaccccgcgagcggcctcgcgaccaggtactggcgggaacgcgcctagccccgcgtgccgccggggccc

SEQ ID NO: 29218 - DNA, 19 bp, Homo sapiens
  chr4:154710599-154710618
  hyper
ggcttgttttgccccagtc

SEQ ID NO: 29219 - DNA, 186 bp, Homo sapiens
  chr4:154710728-154710914
  hyper
cgtgtgccctgtgatggagcccgggacctgcccgcccgaggccgcctcggcgaacttcgttttccctcgaatctccagccaccgttcagcagcctgtcggtgtgctccccaatgccgtaaaaaaatcagaattataaatatattcgtatgagcagaactttacatggaaaacgaaatactaataaa

SEQ ID NO: 29220 - DNA, 708 bp, Homo sapiens
  chr4:154712003-154712711
  hyper
agagctaataaagagcgtgagctctgagagatgctacgacttgggcctgggagtgggataagggccctctcgctttcacgcccccccaaccccccgccggccccggccaacccctaaatccccaacgccctccgctggggtcgcctcctccccgcagagccccttgttgggagttcaaggagcccgaagctggtctggctggtttgagccccgcgctgccgcacgcccggaagtggctggcggcccccgcgctccgcgcgccggctgcattgttttgggagccctcgctgcccggcttgccgccaggaggtgctgggagtcgcgcctgagtctccatccctgccgtgcgcagtgtccacctctggccagcttgtttgcccggcccgcggcgtcccctgcggcccatcgctgctcctcccggaacccacgccacttagtctggtcccgaccctgcactcgctgctgctgcctttcccacctcaagtcgctctccccactcccttctgcttttgggctaagaccggtccaattgatcactggggaacagggcaataacctcccgcggaggctgggacgcgggcacggagctctgcccatatgagcagcgcagggatgggacactgggtgcccatcccagcgcgcctccccagactggtccctgggatgctcacacgtggcgcggcaccgcggcggcgccttcacgaaccc

SEQ ID NO: 29221 - DNA, 257 bp, Homo sapiens
  chr4:154713532-154713789
  hyper
cctgtcgcgacttgtcgggtgtctccaaccgcgttgccgcctggctttcagccgtgcgctggccagccgggcgggtgacgtcacctctccccgggtccgtgcacccaggccttccctgctccgggtgagtattttttcatgggattcagccatctgggggcgccatttcccaaaacagagattgtccctttgaggttgcaagtcaggttcctttacgctgagatcccttacatttttacttttaggaaggttttttc

SEQ ID NO: 29222 - DNA, 220 bp, Homo sapiens
  chr4:154713790-154714010
  hyper
aggggtggggggatgacctcattccttcgcctttggccctccctctacccggccccacaacgaggacgcccctgcagctggctgggccgcttcctcttgccacgcggggggacctgtgcccgcggccgtgcacctccgtgtacgcttctgctcctcggaccccatcggttcagacgcggatttccgagaacgagaccagagtctgcgtctggagagcctt

SEQ ID NO: 29223 - DNA, 283 bp, Homo sapiens
  chr4:155254047-155254330
  hyper
cagcatttgtgtcatcggtgagagagactcactgacttccacttgatagaccaaatgttcgaaagtccaggatgggctgtgttcgcgtttctcgataacgactgtcagcaccagcagggctgcctgaggatgcacgccttggtcctcggccctgagagtcagcgtgagctcccgctgctcgcccgcgcccaggctgccgttgaggaacagcacccccagggctctgtcgatggcaaagacgcctggctgcgggctggcgatggagtaccggatgagtccgttc

SEQ ID NO: 29224 - DNA, 56 bp, Homo sapiens; identical to SEQ ID NO: 7579
  chr4:155411438-155411494
  hyper

SEQ ID NO: 29225 - DNA, 429 bp, Homo sapiens
  chr4:155412014-155412443
  hyper
gcgagtggtcattcacgtcgttgacgcgaatctccacctgcaccacagcgcccagcagcgtggcggcgacgaagctgtagtggtcccgccgctcgcggtccaggcgccgcgcagtgcggatgatgccggtgtccgggtgcacgtggaagtcgtccagcagcggggagtcatcggagtcctccgacagaaagaagccgctcccctcctgctgctgcgcggccggcagcccggcgcggatgtcacctaccagcgtgtccgggggaagcccctcatctacggaaagggtgaggttgaacaactgggcagaggagcccgaggccgcccacagccacacgtgcaccaagagccagagcagggagcgctgcgtcctggcgccgctgctgcctgaccgcccatggggtgtatctctcctcccggggagcagaagga

SEQ ID NO: 29226 - DNA, 185 bp, Homo sapiens
  chr4:155413374-155413559
  hyper
gcctgactcttggctcgcgctgagccaagagggtagaggttatcatcactttggggtgccaaacttgtgttctccatttggcgagagggactcccgtccgcagcggaaggacagatggagtcaaaggccgatgcatagctggggccaggatggctttaaaggggagaaggcggaacttggaaaag

SEQ ID NO: 29227 - DNA, 258 bp, Homo sapiens
  chr4:155548046-155548304
  hyper
ctgttttctgggctccggcccccagcccagcccagccgccgcaggagcgctcggccagtaggtgtctctgctcctcgggcggccttgagcagtgcctaacgttgagcgtgaggctcgtgctccgggtctcgcgggcggccgcctcgggcgtcgagtcccggagattggacagacaccagagcctggggaccgcggagtgaccgggtggggctggagggcggcgccgcgccttctggggagacgcggaggtatcaggta

SEQ ID NO: 29228 - DNA, 446 bp, Homo sapiens
  chr4:155663475-155663921
  hyper
atgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatggcccccttcgtcttccaggtaaaatgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagt

SEQ ID NO: 29229 - DNA, 110 bp, Homo sapiens; identical to SEQ ID NO: 7583
  chr4:155664194-155664304
  hyper

SEQ ID NO: 29230 - DNA, 90 bp, Homo sapiens
  chr4:155665385-155665475
  hyper
cgcagcacccctgcccggcgagcttaacttgcccagcccggcccctgccggagtggcaccggcacctctccaagacgccctcttccctgc

SEQ ID NO: 29231 - DNA, 57 bp, Homo sapiens
  chr4:155665721-155665778
  hyper
acagacgacatggggcgcacgcagaaggtggtctccaacaagcgtctcatcctgggc

SEQ ID NO: 29232 - DNA, 159 bp, Homo sapiens
  chr4:156129228-156129387
  hyper
cgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagccccta

SEQ ID NO: 29233 - DNA, 854 bp, Homo sapiens
  chr4:156129443-156130297
  hyper
cgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagtaagtgtaattcctaactctgatcacctcctgggaacaagaaaatccctagaggagcgctcggttcctatgaaga

SEQ ID NO: 29234 - DNA, 169 bp, Homo sapiens
  chr4:156297387-156297556
  hyper
cttcaaaataagtcacgtcttatttaaaaggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaa

SEQ ID NO: 29235 - DNA, 42 bp, Homo sapiens
  chr4:156297941-156297983
  hyper
cgcccgcagagccggtcctggaccgagcgaggaggaggggct

SEQ ID NO: 29236 - DNA, 30 bp, Homo sapiens
  chr4:156588105-156588135
  hyper
gatctcaccatggtgcgttttggctgctac

SEQ ID NO: 29237 - DNA, 227 bp, Homo sapiens
  chr4:156588456-156588683
  hyper
gcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtac

SEQ ID NO: 29238 - DNA, 355 bp, Homo sapiens
  chr4:156588684-156589039
  hyper
ctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggc

SEQ ID NO: 29239 - DNA, 69 bp, Homo sapiens
  chr4:156589040-156589109
  hyper
gtggcgggcttcagggcaacttcacccggccggctgcggcgtgggtaagaggcgcgtcctcctccacag

SEQ ID NO: 29240 - DNA, 45 bp, Homo sapiens
  chr4:156680338-156680383
  hyper
cggccggcctggcagcgagggaactggccgcgcagccggagcttg

SEQ ID NO: 29241 - DNA, 70 bp, Homo sapiens; identical to SEQ ID NO: 7591
  chr4:156680699-156680769
  hyper

SEQ ID NO: 29242 - DNA, 200 bp, Homo sapiens; identical to SEQ ID NO: 7592
  chr4:156680770-156680970
  hyper

SEQ ID NO: 29243 - DNA, 130 bp, Homo sapiens
  chr4:156681218-156681348
  hyper
cgagggcgagaaccgcggaaaggagcccctaggggtcaccacggcttcccgacccggcctgagcgtgggaacgcgctgccggcgctcccaggctcagcaggccgggcagctcccacgcgtgcagagcccc

SEQ ID NO: 29244 - DNA, 41 bp, Homo sapiens
  chr4:157892721-157892762
  hyper
gagcgcagttggccccgggttcggagcgccgcagcacggat

SEQ ID NO: 29245 - DNA, 49 bp, Homo sapiens
  chr4:157997406-157997455
  hyper
ctccacgatctcgcccggcgattgtgggcaggggcgcctccgggtaagt

SEQ ID NO: 29246 - DNA, 30 bp, Homo sapiens
  chr4:158141576-158141606
  hyper
tgggcgcgacagccccggagacccgaggtc

SEQ ID NO: 29247 - DNA, 30 bp, Homo sapiens
  chr4:158141957-158141987
  hyper
attcagccagtcctccggacttctggagcg

SEQ ID NO: 29248 - DNA, 201 bp, Homo sapiens
  chr4:158142822-158143023
  hyper
gctatttcctaggggcgccgatcaagaatacagtgcatttcgagtagggatggttcagttttccacttcggagttcagactgacaccccacatcgacaatttggaggtggcaaacagcttcgcagtcactaatgcttgtaagtaatgaatattcatgcctttcgggtgctgcacgcggaaggccagcgagtgtgagtgtgt

SEQ ID NO: 29249 - DNA, 97 bp, Homo sapiens; identical to SEQ ID NO: 7594
  chr4:158143369-158143466
  hyper

SEQ ID NO: 29250 - DNA, 2 bp, Homo sapiens
  chr4:158143609-158143611
  hyper
cg

SEQ ID NO: 29251 - DNA, 30 bp, Homo sapiens; identical to SEQ ID NO: 7595
  chr4:158144242-158144272
  hyper

SEQ ID NO: 29252 - DNA, 241 bp, Homo sapiens
  chr4:164252966-164253207
  hyper
gcttcgggtgtctatcggggcgcagcgccacactcgaagcgcccggtactgcggagcgcggctcgattgcagccgagaagcgcggaacccgcaagtgggggtgggcttgcgcgctggggtccgcgccgagggctactcccacctccgccagctcccagcccgacacctgccgcgggacccgtgcgacgctgggcgacgcgccaagcccacccttctccggctcatcccagccagttactcc

SEQ ID NO: 29253 - DNA, 208 bp, Homo sapiens
  chr4:164253208-164253416
  hyper
cgaaaactccggtgcggccagagccagcgcctccagccagctcaagacacgtaaggaaaatgagcgggtgtgggataggcgaactcgggcgccttcccagtgcctcggccttttaaagagaaccggggtaaaggaaaacttggatccccatccagaaattccccgggagcaggtggtgggaaagcccgaactccgcgtagggtaccct

SEQ ID NO: 29254 - DNA, 30 bp, Homo sapiens
  chr4:164253751-164253781
  hyper
gaagctaggaagagacgcctccttaaagcc

SEQ ID NO: 29255 - DNA, 183 bp, Homo sapiens
  chr4:164264670-164264853
  hyper
ataaaacctgagagtcgaagcttgttctcaggaatactaagaacttaggggcacagccatcctcacaccagtccaagacttctcagagttcactacacagggttgagggctggaccggcaaaactcgatttgcccatcaagttaacttggtcggcctgggacccgaggccagggtgaagggac

SEQ ID NO: 29256 - DNA, 250 bp, Homo sapiens
  chr4:164265192-164265442
  hyper
gggtaggcctgcaccgaggggccgtggcgggtccccgcgcgggctgcgagtctgcgcaggtccctgggagcccgcacccgtctctggtgccagggcgttgtcgggggtcccaagagagcggggtggggaaggtgaagggagcgcggctggaaaaatggggattagggtggcggaacaggcacttgtcaggagtgaagagacagcggagagggtactgggctgaattctttcgtgccgagcaggtccctcc

SEQ ID NO: 29257 - DNA, 297 bp, Homo sapiens
  chr4:164265443-164265740
  hyper
gttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggca

SEQ ID NO: 29258 - DNA, 567 bp, Homo sapiens
  chr4:165304457-165305024
  hyper
cagttgcagtgaacccgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccgg

SEQ ID NO: 29259 - DNA, 131 bp, Homo sapiens
  chr4:165305059-165305190
  hyper
cgtgcggccggcatcccggggcgcgggcattctcccatcctttgtcagttgcgggtggagcgctcctccccagctagcggacgagcagccgggtggcaggcagcccggctctggctcggctccccagtcct

SEQ ID NO: 29260 - DNA, 492 bp, Homo sapiens
  chr4:166299918-166300410
  hyper
aatattttttccatacgcagtgacgtgggtgggtcatgggtgtctcaatgacagtaacgttcccgaaccccggaccttagctgtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgt

SEQ ID NO: 29261 - DNA, 71 bp, Homo sapiens
  chr4:166793784-166793855
  hyper
atagcgccagcccatcggcaaggtctcagcgtttcctgctgctgcaatctgtaactcgattttggattttt

SEQ ID NO: 29262 - DNA, 466 bp, Homo sapiens; identical to SEQ ID NO: 7605
  chr4:166794697-166795163
  hyper

SEQ ID NO: 29263 - DNA, 32 bp, Homo sapiens
  chr4:166795606-166795638
  hyper
ccctctcccccagggcgcggtttcccagcgct

SEQ ID NO: 29264 - DNA, 159 bp, Homo sapiens
  chr4:166796117-166796276
  hyper
cggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcggaaggcacgttag

SEQ ID NO: 29265 - DNA, 14 bp, Homo sapiens
  chr4:168155110-168155124
  hyper
ggggatgtgggtgc

SEQ ID NO: 29266 - DNA, 383 bp, Homo sapiens; identical to SEQ ID NO: 7607
  chr4:168155125-168155508
  hyper

SEQ ID NO: 29267 - DNA, 72 bp, Homo sapiens
  chr4:168155795-168155867
  hyper
tccctccccgacctccgtttttttcctcttccacctcctcctatcccaccttcctctcgctggatcccagct

SEQ ID NO: 29268 - DNA, 443 bp, Homo sapiens
  chr4:170947424-170947867
  hyper
tcgccatggccagcccgacagcggccgctgcgccgcactctgcgccggacgcccggtagcgcctactgcgggcgagccgcctccgccggcgcctcacagcgttgcgagctgcgccgccggctgccgggagcgcggagcttcccacctacaggagcctgggccggccggggccgagcatgcccagtgcggctcgccgggcggcgcggaggcgcgggtgtagccgccgggttttcgcggcagccgcgggcgggggcagcggggcgggcggtgcggcgcgagccagtcggtgctgcggagcggccccgcggaggagccaccggaggctgtagttgccggggagtcccgcattcagtccgctcagcctctgggccgggcctcggcggcccccagagccccacacccgcaggcccagggcctccgcggcagcgcgggactctcactcc

SEQ ID NO: 29269 - DNA, 552 bp, Homo sapiens
  chr4:172733596-172734148
  hyper
aagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggct

SEQ ID NO: 29270 - DNA, 88 bp, Homo sapiens; identical to SEQ ID NO: 403
  chr4:172734188-172734276
  hyper

SEQ ID NO: 29271 - DNA, 115 bp, Homo sapiens; identical to SEQ ID NO: 404
  chr4:172734277-172734392
  hyper

SEQ ID NO: 29272 - DNA, 51 bp, Homo sapiens
  chr4:172734591-172734642
  hyper
ggggagtggggcgcgggcgaccgtgtgcagccgcggcgcatctccgccttc

SEQ ID NO: 29273 - DNA, 15 bp, Homo sapiens
  chr4:172734845-172734860
  hyper
gattgatgggcagag

SEQ ID NO: 29274 - DNA, 185 bp, Homo sapiens
  chr4:172735016-172735201
  hyper
cgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgc

SEQ ID NO: 29275 - DNA, 40 bp, Homo sapiens
  chr4:174429648-174429688
  hyper
cggacctctgcagtccgtcgcaggacgcccaaaccacagg

SEQ ID NO: 29276 - DNA, 321 bp, Homo sapiens
  chr4:174430233-174430554
  hyper
tattattccacttcacgagtactaaggaggagtccagaattggtggccgtcctccctcttgttttctcatgcaaataactcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccc

SEQ ID NO: 29277 - DNA, 357 bp, Homo sapiens
  chr4:174430793-174431150
  hyper
ggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttctctttctggccctcatttcccctgcttctcactttagttcactgctgttttaaaaattcatatgcgggctcatttaaaa

SEQ ID NO: 29278 - DNA, 498 bp, Homo sapiens
  chr4:174437937-174438435
  hyper
cgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaacct

SEQ ID NO: 29279 - DNA, 526 bp, Homo sapiens
  chr4:174439822-174440348
  hyper
gtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctattagcagccaggtagccctgcgggtcgaagatgctcagaggaggagtaaatgcagagaaaaaatagaggaaggaataaaaaaaaaaacaaaacaaaaacacgtaacatacacgcactcaaaaccaa

SEQ ID NO: 29280 - DNA, 113 bp, Homo sapiens
  chr4:174440647-174440760
  hyper
ccacgcacacagccacggcccctcgcgtcttcgcggcacgttaattaaatgcggaaaacagacagaggctgatgtcattgctctcacaagatcataaacgtaaaagagtcatc

SEQ ID NO: 29281 - DNA, 30 bp, Homo sapiens
  chr4:174443212-174443242
  hyper
ggaaggctttccaggcggaatgctccagcc

SEQ ID NO: 29282 - DNA, 522 bp, Homo sapiens
  chr4:174443551-174444073
  hyper
agatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtccggcccccggaaacgtgggattggtttcctctcccggagttctcccctcccccttctttctaaacatttaaaaaacacgtagtccgtctcccccaacccccattcccggtagacttaatcccaacagcaattcattgcac

SEQ ID NO: 29283 - DNA, 155 bp, Homo sapiens
  chr4:174448460-174448615
  hyper
cggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgc

SEQ ID NO: 29284 - DNA, 38 bp, Homo sapiens
  chr4:174449624-174449662
  hyper
gtactaggggagcagcgataacccggaggtaagatcac

SEQ ID NO: 29285 - DNA, 475 bp, Homo sapiens
  chr4:174449933-174450408
  hyper
tgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccacc

SEQ ID NO: 29286 - DNA, 318 bp, Homo sapiens
  chr4:174450409-174450727
  hyper
ggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctc

SEQ ID NO: 29287 - DNA, 569 bp, Homo sapiens
  chr4:174450751-174451320
  hyper
cgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcc

SEQ ID NO: 29288 - DNA, 445 bp, Homo sapiens
  chr4:174451728-174452173
  hyper
aagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattc

SEQ ID NO: 29289 - DNA, 61 bp, Homo sapiens
  chr4:174452696-174452757
  hyper
taaattagagggaggcgagggcctgcggcgccagcgcgggacagggcggcctggggctcgc

SEQ ID NO: 29290 - DNA, 190 bp, Homo sapiens
  chr4:174459185-174459375
  hyper
gcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggc

SEQ ID NO: 29291 - DNA, 124 bp, Homo sapiens
  chr4:174459527-174459651
  hyper
cggttccccacacccaggaggccggttctccgccgctcaggctgggagaggtcaccgctccgggcagggtggacccccagctccgtctcggaggacctttcgccggaggcgagcaggaaggggt

SEQ ID NO: 29292 - DNA, 144 bp, Homo sapiens
  chr4:174459923-174460067
  hyper
ttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttg

SEQ ID NO: 29293 - DNA, 116 bp, Homo sapiens
  chr4:175133085-175133201
  hyper
ttctctaagggctgccgcgggttccgcaaagactcactccagaatccccagctccctcgcgtcagcgaatgtcccgctggtccaggcagccttttcctgcgcggttcttcagttcc

SEQ ID NO: 29294 - DNA, 135 bp, Homo sapiens
  chr4:175134868-175135003
  hyper
cctctgggtccttaccgaaagggaaggtcccaaaggaccaccagcgcgctctcggaggctccaggactagacattggactcccacagcgcaacaccatagggactccggtgttcggttcccgtggccctctcctt

SEQ ID NO: 29295 - DNA, 457 bp, Homo sapiens
  chr4:175135253-175135710
  hyper
ctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgggtggtttcgcccccctcatccc

SEQ ID NO: 29296 - DNA, 131 bp, Homo sapiens
  chr4:175136030-175136161
  hyper
tgcctctaacttgaacggggcaggagaaatattggggtgatttggaagacggtgataagggaaagcacaaaataaggattggagggccgcagtgaggtcattagtgaagctgatgccggagataaaagctg

SEQ ID NO: 29297 - DNA, 30 bp, Homo sapiens; identical to SEQ ID NO: 7627
  chr4:175137723-175137753
  hyper

SEQ ID NO: 29298 - DNA, 1172 bp, Homo sapiens
  chr4:175138513-175139685
  hyper
acgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagccccagggccaggcaagcggccaagctgcgctctcgataaaggagccagaatggttccatctggttacaaacatatctttttattaaaaagcaatcagatcctgaagcgcttcccttgcggtttaccgctctccgcaggctgcttctccgaagccagcggtggtagcgcccactcggttgagcccacgcctccgccaggcagcgcctccgccaggcagacctcctgcgggacattttgtggccaggggggttcctgcccagggacctctaatagggtcggtggaagctaatttgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgccattcctctccagctcccgagccccactcccacccttgccgttgaaactgtgaaaaagccgccaaagtttgggcacccagcctggcagtcggaagacagtgagataaagaatgcgatagtaagtcctt

SEQ ID NO: 29299 - DNA, 30 bp, Homo sapiens
  chr4:175749823-175749853
  hyper
aacaagtggttgcaacgtaatgcacaggct

SEQ ID NO: 29300 - DNA, 416 bp, Homo sapiens
  chr4:175750264-175750680
  hyper
caaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccctttagtattcccttccgggaaaaggcacac

SEQ ID NO: 29301 - DNA, 15 bp, Homo sapiens
  chr4:176922653-176922668
  hyper
gttcttcctcccctc

SEQ ID NO: 29302 - DNA, 50 bp, Homo sapiens
  chr4:176922729-176922779
  hyper
cggaccctgcctggaaacttgagcgaagctgaactgcgccgaactccacc

SEQ ID NO: 29303 - DNA, 301 bp, Homo sapiens
  chr4:176922780-176923081
  hyper
tccagtgacccgagccagtgtggacgcccttttaatcacgctgtttacccaggtggaatttaggaagaatcagccttcagcctcaacctcaaaccttttgtgcaaatgggcacttcgtttggaaagggactagaaattgtccccagtctggccctgcaccagcaccttcctctgctcaaacctgtacaaagtggaagttttaggaagtttccatttctcgtgccccgtttcaacttgctccccaaagagaacatgaaaacgtgggaactcgggaggacagagatctccctgtaatcgcctc

SEQ ID NO: 29304 - DNA, 561 bp, Homo sapiens
  chr4:176923082-176923643
  hyper
ctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctcc

SEQ ID NO: 29305 - DNA, 124 bp, Homo sapiens; identical to SEQ ID NO: 2495
  chr4:176987050-176987174
  hyper

SEQ ID NO: 29306 - DNA, 5 bp, Homo sapiens
  chr4:176987175-176987180
  hyper
cccgc

SEQ ID NO: 29307 - DNA, 107 bp, Homo sapiens; identical to SEQ ID NO: 2497
  chr4:176987206-176987313
  hyper

SEQ ID NO: 29308 - DNA, 42 bp, Homo sapiens
  chr4:176987314-176987356
  hyper
agaggggctctgacctccctgtgatcgcggaccagggtaatg

SEQ ID NO: 29309 - DNA, 70 bp, Homo sapiens
  chr4:177713240-177713310
  hyper
ccccgcgcaggttctcgggtccgccgcagaccctaacgcaaactctcgggttctccgcaaaccctaacgc

SEQ ID NO: 29310 - DNA, 614 bp, Homo sapiens
  chr4:177713605-177714219
  hyper
cggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggc

SEQ ID NO: 29311 - DNA, 357 bp, Homo sapiens
  chr4:180979270-180979627
  hyper
cagcagagccactgccgccctggctcttgtaggtgggtctggagtgtcacgtaggcaccccaactcgcgccgggggccgtggtccgcagactcccacttcattgccccggaggcctgagcccgccccgcccggctgtggctgcacctttcccgagagtcggggcagcggcggctcgaaagtggaggcagcctaaccgcgtagcgctgaaaccaccattcacaaatgcaaacccctgtcttctgtggataaacggtggcggcgcgcgtccgagcgtccccgaggggctgtggggagcccccggggagagcaggaaaggaagcggggtggcggtggctaggaagcgactgagccttctc

SEQ ID NO: 29312 - DNA, 74 bp, Homo sapiens
  chr4:180980278-180980352
  hyper
gcgcctttggcgaggcggcggccgctcggccctgcgcccggccgcggcggcggcggctccgctcgccccgggag

SEQ ID NO: 29313 - DNA, 91 bp, Homo sapiens; identical to SEQ ID NO: 7642
  chr4:183062455-183062546
  hyper

SEQ ID NO: 29314 - DNA, 307 bp, Homo sapiens
  chr4:183063666-183063973
  hyper
gtttctggttctgcacggtagttaaaaatgcaagtggatttcctaacggccgagtacaggtacaggtggaggtcggcggaatcctctgctctgaagctgaaagtggagggtggcgcgaggcggctggcgcgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccgcactcactcggcagccccaagca

SEQ ID NO: 29315 - DNA, 876 bp, Homo sapiens
  chr4:183064617-183065493
  hyper
ttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacct

SEQ ID NO: 29316 - DNA, 297 bp, Homo sapiens
  chr4:183369261-183369558
  hyper
ttcagcccctggtaccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcc

SEQ ID NO: 29317 - DNA, 37 bp, Homo sapiens
  chr4:183369966-183370003
  hyper
ggcgagggggtgaggcggcggccgagccggggcgctg

SEQ ID NO: 29318 - DNA, 40 bp, Homo sapiens
  chr4:183727758-183727798
  hyper
aaaccgaagagaaggcgccgccgctcgccgctcgccactc

SEQ ID NO: 29319 - DNA, 67 bp, Homo sapiens
  chr4:184019249-184019316
  hyper
gaccctgaagcttggcgtccaggccccgccagcgctgcacccggcattgtcccgcctggggcaggcg

SEQ ID NO: 29320 - DNA, 30 bp, Homo sapiens
  chr4:184019532-184019562
  hyper
ggaagggactagagtcggggcgcgtccacg

SEQ ID NO: 29321 - DNA, 62 bp, Homo sapiens
  chr4:184020126-184020188
  hyper
ccccgcggggcagtgcgtccgagctggtgcggcgacgccggcagcggcggggttaagctcag

SEQ ID NO: 29322 - DNA, 156 bp, Homo sapiens
  chr4:184020571-184020727
  hyper
cggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttcta

SEQ ID NO: 29323 - DNA, 75 bp, Homo sapiens
  chr4:184021203-184021278
  hyper
aggccgtccttggcgcgggagcctgggctgcgagctcttggcgggggcgcccagactggccggaggtcccgagct

SEQ ID NO: 29324 - DNA, 216 bp, Homo sapiens
  chr4:184718199-184718415
  hyper
tcattaaccagtcagcgaatccacttgttccagcgagaggtgggaggtgggggcaggggtggagcgtggggaggagcgacactcgccgctccggaatccgtgccttccaagtgtcgccgttgcgtcccccgcaacccccgctttctgatctccctcgaggcccaacacccaaaggctcacccctaggccatccgcgctccccgaccacctccctca

SEQ ID NO: 29325 - DNA, 100 bp, Homo sapiens
  chr4:184718735-184718835
  hyper
ccctgccctgggggacggtcgcgctccccgctggtcttgcagccacgtcccggcggctgttcctgggagcggcgggaggcggcctcggtgagccaggtcg

SEQ ID NO: 29326 - DNA, 154 bp, Homo sapiens
  chr4:184719233-184719387
  hyper
cccgtcccttcccaccggatcgcgtccgtgccgtgcggtcgcgggtgccccgccctgccccagcccgccgcgggcaccgccgaggctcccctgggtgcccgcgtccctgccgggggaggagccgggggccctctgcgagcgtgggattggggaa

SEQ ID NO: 29327 - DNA, 100 bp, Homo sapiens
  chr4:184826238-184826338
  hyper
tttgaaaacccaaatcgaggagataaccgtttttgaatgaacggcagtgcaaagcgtggtcggggttagcagcaacgtggctgggcgcctttaactcggc

SEQ ID NO: 29328 - DNA, 74 bp, Homo sapiens
  chr4:184826583-184826657
  hyper
gcgtcttccaggctgcgtggacccggcgccccggcgtgtgcggttgtgggggagctcgccgtggcctcccctcc

SEQ ID NO: 29329 - DNA, 102 bp, Homo sapiens
  chr4:184827100-184827202
  hyper
acccagccatccacccgcgcgcacgcacagcgcccggagcctcggcaaggggaagattgacgaggcgctgcagtcgcggggacgacgcgggctcttcctgga

SEQ ID NO: 29330 - DNA, 56 bp, Homo sapiens
  chr4:184827574-184827630
  hyper
ctcccattgccttcacgctgcaagtctcggcgcccccaccccgcccgccccctccc

SEQ ID NO: 29331 - DNA, 70 bp, Homo sapiens
  chr4:185089642-185089712
  hyper
gctggaagctttgcacgggggtgaaagttacaggcagacactgcccgcggggctccggacagcaaggagc

SEQ ID NO: 29332 - DNA, 32 bp, Homo sapiens
  chr4:185937387-185937419
  hyper
gccccctcacctgcacgcgggtacttttagcc

SEQ ID NO: 29333 - DNA, 340 bp, Homo sapiens
  chr4:185937644-185937984
  hyper
taatctctttgtgtgcgagtgaatatcctgaaatcgacaacccctgagagggcactcgcggctggcagagcaacctgggagggtgcggatcgtgtccaatctggcgtgaagcagaaaggaaacatcgtgaggagactagaggcaggaccgagagggacaccctaggggtgcgaggtgcagaccgagccctcacatctcccaggccgcagcaggtgggccgatggcttccccgaggcctggcaccccaggcctggctctgcgccctgaggctcccaggtcccaccagctagaagagcgccgcctacccacccctgccaaggtctaacgaccccaagggggg

SEQ ID NO: 29334 - DNA, 516 bp, Homo sapiens
  chr4:185938230-185938746
  hyper
ggcagcaagtgtgagcgaggcccgtcctgggggaggtggcctctggccgcggggccaggttgccctcagaggcgcaggcggccaagagagttcccagccgccgccgcccccctccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattgatgcccaaagtgtctgcgctctcccgcccccaaacgttaagaaaagacgccagcgaaagggagacataaaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgtctccacttgggc

SEQ ID NO: 29335 - DNA, 212 bp, Homo sapiens; identical to SEQ ID NO: 7652
  chr4:185939694-185939906
  hyper

SEQ ID NO: 29336 - DNA, 166 bp, Homo sapiens
  chr4:185940294-185940460
  hyper
ctgcctggaggctggcggccacctccccaaaggcctgggtagggtggctggaaggggagcgcgccagcgcgggcgtcagaaggcagagctcacctggcccgagcgtggcgggccaggagtcccttcctagagcgaatctgagcagtgtgcgcggctggagaggcgg

SEQ ID NO: 29337 - DNA, 30 bp, Homo sapiens
  chr4:185941006-185941036
  hyper
ggttagggaatgggacgcctgggccaggcg

SEQ ID NO: 29338 - DNA, 701 bp, Homo sapiens
  chr4:185941560-185942261
  hyper
ttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggtt

SEQ ID NO: 29339 - DNA, 443 bp, Homo sapiens; identical to SEQ ID NO: 7656
  chr4:185942491-185942934
  hyper

SEQ ID NO: 29340 - DNA, 225 bp, Homo sapiens
  chr4:186048748-186048973
  hyper
ttgctgagttatgtccgggcgagatcggtgtccttcagggtgggaggctcagaaacccagcgcgcgagcctctgggcagtggtaagggcgggttgggagtcgggttcggcgagtccaaaggaggctcccgggctgcagaggccccggcaggctgtctccgccccacgagccccttctcctgcggtctcctggactgcggcgacgaagcgtcggggctggggctcc

SEQ ID NO: 29341 - DNA, 561 bp, Homo sapiens
  chr4:186049504-186050065
  hyper
ccccgcgccctccccttgcggagattcggcctggaaagctccgcggctctggccggcaccggtttccttcccgcctccccgcactcccacccccgctcctagttcagagcgctggtggcgttacccacagccgcggaatcccctttactgttcccggaggagctgcgaggtggaactggccgcgcggtgggggctttccccggccccgggacgagcactcagcgtcccctccccgcgacgctccctcggaatcccggggaagagcgcagcagaggcggggaggaggcgcgagcggaggggaccgacttccaccgcacctgggtgtcgccagccccgcctggccctcggcgccgggaccccgacgcaccccgcgcatagcgactggtggcctggtgggggactgcgcctgcgaggccttcttcgcgcagagatatcggggttctctgaaccccagaaatgggcctggcaggggaaggaagctgcaagaaaggagttaatctgcaggatgctcaattctttctatgacaaatcgcttcactccccgctcggcaggtcagagct

SEQ ID NO: 29342 - DNA, 214 bp, Homo sapiens
  chr4:186456012-186456226
  hyper
gctgaacttttcatccggacgagaaaaacgctcagatgcgcgccagctccagggaatgccggggggtgccagtccctcgcctctcccacccgggacccatcatttgttacggaagggcgatggggtgtgttttatttctgttatcacatataaaacatttaaaacctaaaggggaggaggcactcgagcctggcagcctcgccttccctgagcc

SEQ ID NO: 29343 - DNA, 34 bp, Homo sapiens
  chr4:186456784-186456818
  hyper
cgggagtgcgcagcccggccggctggggcagcct

SEQ ID NO: 29344 - DNA, 163 bp, Homo sapiens
  chr4:187026723-187026886
  hyper
gaaccctgttccttacgctgcctgacatcggcgaggagggggcctcggacggcgactccggggatggcgaagcgtgagtagcagcgtggtccgggcgcgtgtaccttttgccgggacccccgacccctccgcctgccgcactcaccttcgcaggtgcacttca

SEQ ID NO: 29345 - DNA, 31 bp, Homo sapiens
  chr5:53156-53187
  hyper
cttgttcgggaccgccgggtggagacaagga

SEQ ID NO: 29346 - DNA, 116 bp, Homo sapiens
  chr5:53500-53616
  hyper
cgagtccccttctcaggcaggctgtgggggttggggttgggcttcgcgagcccaagcggacgccgcaaagagaatgagaacctcggagcgctcggggcgggcgggcccagcccagg

SEQ ID NO: 29347 - DNA, 57 bp, Homo sapiens
  chr5:53842-53899
  hyper
acgtgaaggggacctcggtgcccggagctgctgcccaggtaaccgcgctgcgcccgg

SEQ ID NO: 29348 - DNA, 3 bp, Homo sapiens
  chr5:54002-54005
  hyper
cgc

SEQ ID NO: 29349 - DNA, 42 bp, Homo sapiens
  chr5:54390-54432
  hyper
ttgctttagcccccacgctcctgtgtgcgagaggggcctggt

SEQ ID NO: 29350 - DNA, 229 bp, Homo sapiens
  chr5:91895-92124
  hyper
tagaccaggggaaatcggggtcccgtccgggtacactggcagaactcaggggtcagatcctctgccctggagcattcagatttgtgcctctacgttatggaaaccaggggcccgtccgggtgcaacgtggcatccacaaaatggcaggtccccgagctccgggctccgagagaacaaaagcagaagccactgccgcccgcgctcggggaggagccgcccaggtgggcgc

SEQ ID NO: 29351 - DNA, 546 bp, Homo sapiens
  chr5:320788-321334
  hyper
cgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagc

SEQ ID NO: 29352 - DNA, 30 bp, Homo sapiens
  chr5:321585-321615
  hyper
cctggaggggctcagcgcgcgacccccgcc

SEQ ID NO: 29353 - DNA, 148 bp, Homo sapiens
  chr5:321900-322048
  hyper
gtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctca

SEQ ID NO: 29354 - DNA, 191 bp, Homo sapiens
  chr5:322061-322252
  hyper
cgtcgccaggcccggcggccccgggacggggcggacactctggggtgcggctggctggtctcacttaaaactcggacctcggagggaagccgcggcgcgtccacggttcgtggtcctcagcgtcccctcgagagtgttctgagccttcactccccgggcgttccgtgcgggccgcgctccctggggctggg

SEQ ID NO: 29355 - DNA, 138 bp, Homo sapiens
  chr5:322265-322403
  hyper
cggagcggggccccgctgtcgggccgagggcgccaggtccggggggcctcacccccgggaaaggcccatgttcaggcttggtttcagtagcacccagtagcgctgaagtcttattttgagcggccagaattcccagac

SEQ ID NO: 29356 - DNA, 30 bp, Homo sapiens
  chr5:344257-344287
  hyper
ggtgcccggagcccccggcgaggctcgtcc

SEQ ID NO: 29357 - DNA, 265 bp, Homo sapiens
  chr5:374088-374353
  hyper
ggggcgcgcccctgccgccgcacctacgcgcttctcggggaaaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggggcgaccccagc

SEQ ID NO: 29358 - DNA, 25 bp, Homo sapiens
  chr5:523778-523803
  hyper
ctgctgggtttcatgcgggtagcac

SEQ ID NO: 29359 - DNA, 1004 bp, Homo sapiens
  chr5:523856-524860
  hyper
cgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctggg

SEQ ID NO: 29360 - DNA, 32 bp, Homo sapiens
  chr5:926725-926757
  hyper
ccctcctgggcccctcgcgtcccccttccctg

SEQ ID NO: 29361 - DNA, 154 bp, Homo sapiens
  chr5:1155721-1155875
  hyper
gccggcccgccaggccgccgccgcccacctgcgcccctcgaggggaccggcacctgcgcgcacctaccgtagcggccgggctcgcggcagtagagcagaatgggaagcgggtcctcgtcaggcggctcgggcgcggctgcggggtccaggccgg

SEQ ID NO: 29362 - DNA, 55 bp, Homo sapiens
  chr5:1156350-1156405
  hyper
caaccctggcagcaacgctgcagcccgcggtctctggcgacgcccaccgagggcc

SEQ ID NO: 29363 - DNA, 886 bp, Homo sapiens
  chr5:1294557-1295443
  hyper
acgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggctgggagggcccggagggggctgggccggggacccgggaggggtcgggacggggcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggc

SEQ ID NO: 29364 - DNA, 95 bp, Homo sapiens
  chr5:1295604-1295699
  hyper
cgctggcctgatccggagacccagggctgcctccaggtccggacgcggggcgtcgggctccgggcaccacgaatgccggacgtgaaggggaggac

SEQ ID NO: 29365 - DNA, 66 bp, Homo sapiens
  chr5:1444697-1444763
  hyper
ggtgacaacctcaaccggcacgacccctccggtgggtaaaacacccgacgaaggggttccgcggcg

SEQ ID NO: 29366 - DNA, 405 bp, Homo sapiens
  chr5:1444851-1445256
  hyper
cgctcctgaacgcggggcctcagaggcgagttttgggtctacacagcaaaatgtggcccgttagaaagcgtccttcctcaccgcgcccagaacaagaagcggcgctgcctggcgagtcctcgcccggcctccccgccctgcccagagcaccagcgcgcagcccgcgcccgccaccacccccaacacagacaaagcccccgcgagatggagcggcggtgtacaaaacccactccgatcggatctgggatgcgccgcacccctagtagggttaagttccacgagaagaaaccaggacccccgagtcacagccatagacacccacgcgtcccctaagccggtgactgcaccaggtgcccacccggttctgagcctggagcggggccaggggcagccctgcaccctcct

SEQ ID NO: 29367 - DNA, 76 bp, Homo sapiens
  chr5:1445485-1445561
  hyper
gcacgcgagtcctggcgccgagagcgttccgcgaagcctcccctcccgctccgcagcgctgggcggtctcagcctc

SEQ ID NO: 29368 - DNA, 5 bp, Homo sapiens
  chr5:1445562-1445567
  hyper
gcctc

SEQ ID NO: 29369 - DNA, 192 bp, Homo sapiens
  chr5:1445568-1445760
  hyper
ggctcttatccagtagacagggtccgccccgccccgccctcccgccgacggggtcgccctcgcgtcctggctcctcctcctcacctccccgggccgcgcccccgcccccgcctcccggacgcagatggctgggagcaagcggcggccacggctccactgtcctgcgcgtcccggagcctcggacacggggtg

SEQ ID NO: 29370 - DNA, 261 bp, Homo sapiens
  chr5:1445840-1446101
  hyper
cgcccgcacccctgggggctgccccgggcacccgctatcttcggacgcccagggctggcggctcccagctggacggggagggagccgagcggctgcgcgcggggaactgctgggaccccgtcgggccgacccttccctccctccccatcaggggcccctacggtggccccgcgctctggggaccacgtccctcccaccccgccgctccacgctctgaccagcgggctcgggaccccgccgaggactctgcacgcttcccgg

SEQ ID NO: 29371 - DNA, 126 bp, Homo sapiens; identical to SEQ ID NO: 2502
  chr5:1446236-1446362
  hyper

SEQ ID NO: 29372 - DNA, 32 bp, Homo sapiens
  chr5:1446567-1446599
  hyper
ttccagcctgcagcccgcgctcagcagtgagg

SEQ ID NO: 29373 - DNA, 366 bp, Homo sapiens
  chr5:1667728-1668094
  hyper
cggggcgggggcgcgcgttctccctccgggcagcctcgtgggcggtagatgcagccaacgcgtccgtcaaagcggttcaggggcgctgggaagaggcggcggtgaccccgggacggcagtgggcccgaccgagcctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaactccgcgttcccacctccag

SEQ ID NO: 29374 - DNA, 467 bp, Homo sapiens
  chr5:1851534-1852001
  hyper
cgggctcctccggctgggagcgcacctgcgcagggagggtcctgtcccaccacacctggccccctggggaacagcgggtgagtgctgctgcaggaaggagcaggagagacgcactgctccccgctcctctctccgcttccctcctctcctcccacctcccccatctcctccgtcccctgtctccgcccctccttgtcctcaggaagccatatcccactctggtggagtggctcaggccgctgatgagggtgctcggggcagggctcttctctgagtgacgttggaggttttcacggtgaacacagaaaggggcactccgtccgagctgagcctcagggaccgtgaggcttgctcttggccctgctgctcatacagccctccgtgcctcgcttccctcccacagcaaggaaggatgacgggtgcggggtctgcacggtggcgcggggtggccgcgttgctcaggaggc

SEQ ID NO: 29375 - DNA, 1310 bp, Homo sapiens
  chr5:1874997-1876307
  hyper
ggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcc

SEQ ID NO: 29376 - DNA, 284 bp, Homo sapiens
  chr5:1876637-1876921
  hyper
cgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggggatggggaggggagcccggatttctgagcgtagccacggcttggccgggccccccgagccc

SEQ ID NO: 29377 - DNA, 14 bp, Homo sapiens
  chr5:1877089-1877103
  hyper
ggaaataggagagc

SEQ ID NO: 29378 - DNA, 38 bp, Homo sapiens
  chr5:1877194-1877232
  hyper
cgatgggctcccacgcccccccccgggacacggctctg

SEQ ID NO: 29379 - DNA, 211 bp, Homo sapiens
  chr5:1877818-1878029
  hyper
tggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagt

SEQ ID NO: 29380 - DNA, 354 bp, Homo sapiens; identical to SEQ ID NO: 2508
  chr5:1878223-1878577
  hyper

SEQ ID NO: 29381 - DNA, 215 bp, Homo sapiens
  chr5:1878830-1879045
  hyper
ggcggctctgcttccagcgggtcgaagtcgtccaagtcactaagctccagctccttctcctctttgcccacgggctctgcgggagagaatgcgtggccagtggagggagagggttggtaggtgaatcagaccccctgtccccgtccaccattatgaggcctgttcccgacgctacgaaaagcactcggggcctctcttcgcgtctcccatttcct

SEQ ID NO: 29382 - DNA, 135 bp, Homo sapiens
  chr5:1879527-1879662
  hyper
ttgggacccccaagacgtcctagaaccgcagagaaggcactgtgcctgcactccagggcctcagcccccagtgacaacctcccaacccacctgcgttcttggagctcttgaggggctcctcccgcgcctcctcct

SEQ ID NO: 29383 - DNA, 36 bp, Homo sapiens
  chr5:1879689-1879725
  hyper
cgtagggccgcttctcgtctgcgcacttgttccgcg

SEQ ID NO: 29384 - DNA, 503 bp, Homo sapiens; identical to SEQ ID NO: 2510
  chr5:1882419-1882922
  hyper

SEQ ID NO: 29385 - DNA, 83 bp, Homo sapiens
  chr5:1883131-1883214
  hyper
cgcgcagcccggcctggccgcagactcgccggtcactcgccggcggctcaggccgggaggggccaggacagtcccggccgcgc

SEQ ID NO: 29386 - DNA, 402 bp, Homo sapiens
  chr5:1883215-1883617
  hyper
gtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactg

SEQ ID NO: 29387 - DNA, 396 bp, Homo sapiens
  chr5:1883879-1884275
  hyper
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccat

SEQ ID NO: 29388 - DNA, 249 bp, Homo sapiens
  chr5:1884557-1884806
  hyper
atataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgt

SEQ ID NO: 29389 - DNA, 385 bp, Homo sapiens
  chr5:1885314-1885699
  hyper
ccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccagga

SEQ ID NO: 29390 - DNA, 42 bp, Homo sapiens
  chr5:1886035-1886077
  hyper
ggtactaaatacacccgtgagcaggtgggccagaagtcagcc

SEQ ID NO: 29391 - DNA, 463 bp, Homo sapiens
  chr5:1886379-1886842
  hyper
ggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcc

SEQ ID NO: 29392 - DNA, 149 bp, Homo sapiens; identical to SEQ ID NO: 419
  chr5:1886997-1887146
  hyper

SEQ ID NO: 29393 - DNA, 36 bp, Homo sapiens; identical to SEQ ID NO: 420
  chr5:1887546-1887582
  hyper

SEQ ID NO: 29394 - DNA, 370 bp, Homo sapiens
  chr5:1887655-1888025
  hyper
cgtttgggctgccccacccagggacgcttgggccgggcgcgaagagcccggaaatagccacccttgtcgtcggcccggtttccctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggt

SEQ ID NO: 29395 - DNA, 133 bp, Homo sapiens
  chr5:1930872-1931005
  hyper
gtggtgaccaaggcccggcgcagtggccccggagcgtggaggggcagctgctgggcggcctcccgggggagggtgacggcttcacccgccaacgctgcctccctcctgggattaggccggaggaatcttggat

SEQ ID NO: 29396 - DNA, 223 bp, Homo sapiens; identical to SEQ ID NO: 423
  chr5:1931064-1931287
  hyper

SEQ ID NO: 29397 - DNA, 133 bp, Homo sapiens; identical to SEQ ID NO: 424
  chr5:1931444-1931577
  hyper

SEQ ID NO: 29398 - DNA, 382 bp, Homo sapiens
  chr5:1931617-1931999
  hyper
cgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctg

SEQ ID NO: 29399 - DNA, 15 bp, Homo sapiens
  chr5:1952624-1952639
  hyper
tggggcctggcaggc

SEQ ID NO: 29400 - DNA, 138 bp, Homo sapiens
  chr5:1952723-1952861
  hyper
cggtgcagatcccaggagtttgtttaggagaagcggagccttgcctctggtgcttcctgtgaactacaatctgaatgacaatccggcagcccagagcctcccctggattccagggaagccgggaaaagctgcttcctg

SEQ ID NO: 29401 - DNA, 439 bp, Homo sapiens
  chr5:2038424-2038863
  hyper
tgcactgttgaaaagcggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagccaacaggtggcacaaacgcatttgacttgggcatcgatcgccgcgcccgcccggggccgcacctccgccgccagcgtccctccagcccggccccgatgccgcgcaggcgcagtgctcttctctccgcgggccgggccgggtcagggtcaggatctgacc

SEQ ID NO: 29402 - DNA, 15 bp, Homo sapiens
  chr5:2038947-2038962
  hyper
cgctggctccagcca

SEQ ID NO: 29403 - DNA, 314 bp, Homo sapiens
  chr5:2738816-2739130
  hyper
ctcaccacccccagccgcacgcttgggcctccctcctcctgtgcctccgggaccgtctccccacctgcgggaggccaggtgtgtggctccagagaccctccacctgaactacccgctcccagagccccagtcagggccgccagaggtcgcggagggtgaagccaatgggcctggacgccgaggccggggagaggaaggagcgaggtaatggctgtggctggagaccctcttctgactccccaggctgccgggtaggcctactgtgggatgggactcaggcgaccagacgtgctctccgtcgcctccatcccggc

SEQ ID NO: 29404 - DNA, 145 bp, Homo sapiens
  chr5:2739210-2739355
  hyper
cgaggggactcaacgcgctttgtagggcctgtgaaatccggcttgtcgcataagctccctgaagaagagaacaaacttcccagaccaggggcccgcggggagcggtgcagacaccgcggcaacccaccccgagcccgccggccct

SEQ ID NO: 29405 - DNA, 252 bp, Homo sapiens
  chr5:2739551-2739803
  hyper
cggtggaaaagcgctgggcaggccggcctggggctttcgagctctgccgccgagcgcagcagaaatacggtgtgcaggcaggacccgaaacaggagagaccggggggaccggggaggagaggaaggctggctgtggcaggaacccgggcgctcggcacctcccctggtcccgggggccctgaacccccgccgccgtcgccgccggaccccgcgatcgtcctgaacccgggccgggcgctttcggtttcccgg

SEQ ID NO: 29406 - DNA, 175 bp, Homo sapiens
  chr5:2739860-2740035
  hyper
cgggcctgaggctgagggccagggagcgaggcgagcacccggggccagccacggaggagtcccgaccaccacgggagcagggggactgggaggcaagaggtcgggggaggccggggtcagggcgggaggaacccgatgggtcccgctgcggcttcaggcgcggggtatagggtag

SEQ ID NO: 29407 - DNA, 58 bp, Homo sapiens
  chr5:2740243-2740301
  hyper
aaactcatgaacaggcggccgggtctggggccgccggggcagtcgtggcgtgcggggg

SEQ ID NO: 29408 - DNA, 235 bp, Homo sapiens; identical to SEQ ID NO: 7705
  chr5:2740430-2740665
  hyper

SEQ ID NO: 29409 - DNA, 43 bp, Homo sapiens; identical to SEQ ID NO: 2525
  chr5:2743617-2743660
  hyper

SEQ ID NO: 29410 - DNA, 46 bp, Homo sapiens; identical to SEQ ID NO: 2526
  chr5:2743698-2743744
  hyper

SEQ ID NO: 29411 - DNA, 62 bp, Homo sapiens
  chr5:2747745-2747807
  hyper
gcagttagtcagaaccgaccccacagcctgctggctgcgcagaccaccgtgcacccaccatc

SEQ ID NO: 29412 - DNA, 198 bp, Homo sapiens
  chr5:2748292-2748490
  hyper
ctttggcttccatctcgccctccgccctcactctgctaattctgggtcccaggagtggccccctggatcttcttcccggaccctccctcgggtctcccgggcgctccgcctccccggggctggctctccctcccctcccgggcgccgccggccgcgggccgcctacctttcttgggctcgtagccgccgcccggggac

SEQ ID NO: 29413 - DNA, 231 bp, Homo sapiens
  chr5:2748549-2748780
  hyper
cgcggtgtgcagggcctcgccgggggccgcggccgcagagttgtaccgcaggagaccctggccctgcagcgccgcgttcaagttcccgtagtttgtgtagttgccgtagaagggcgacgtgtagtagagggggcggcccagcagcggcgaggcagggtagggcgagcctcctggcggtgccccggttgaggccggcgcggcggccgcgggcagccccggtggcccgcagcc

SEQ ID NO: 29414 - DNA, 227 bp, Homo sapiens
  chr5:2749180-2749407
  hyper
gcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtc

SEQ ID NO: 29415 - DNA, 1 bp, Homo sapiens
  chr5:2750769-2750770
  hyper
c

SEQ ID NO: 29416 - DNA, 128 bp, Homo sapiens
  chr5:2751854-2751982
  hyper
gcgctcatctgcatattcgggggcccgcccctcccctgctccgcccgctgcagcctccgggccgcggccgggggaggggcagagagacgggagggaggcgggggagggcggaggcgacggaggcgggc

SEQ ID NO: 29417 - DNA, 322 bp, Homo sapiens
  chr5:2752120-2752442
  hyper
ggagccacgtcccctgcccggctccggccggctcccaccgtccccggccaccgtcttcgcccctgcccggcccccgccccttccagccactaccccgcccccacccccttctccaccctcacggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcc

SEQ ID NO: 29418 - DNA, 864 bp, Homo sapiens
  chr5:2752508-2753372
  hyper
cggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacact

SEQ ID NO: 29419 - DNA, 30 bp, Homo sapiens; identical to SEQ ID NO: 7713
  chr5:2754590-2754620
  hyper

SEQ ID NO: 29420 - DNA, 1283 bp, Homo sapiens
  chr5:2755320-2756603
  hyper
ggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggt

SEQ ID NO: 29421 - DNA, 909 bp, Homo sapiens
  chr5:2756673-2757582
  hyper
cggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagataggactcctcgctcgcaagaaacactggagaaaagaaaataattcctcgagtgtttttacaattattttaatccaaccagcgaggctctaaagagcgtttgtcttgaggccgtgttgaataccctttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggtt

SEQ ID NO: 29422 - DNA, 64 bp, Homo sapiens
  chr5:3122140-3122204
  hyper
catggctgcatcccacgtgggcgacacacagtgccccagcgccaggcagcggggacaatggtcc

SEQ ID NO: 29423 - DNA, 163 bp, Homo sapiens
  chr5:3197731-3197894
  hyper
tggctgcttgatttccgtagaaatcaatctaaagaacccgcggtcctgtggcgtgatttcctgggactgacttcctggagaggctactgcgggatgtgaggggctggcaggagcggccctccctggccttggccattgtctttccggagaggcattctgcccc

SEQ ID NO: 29424 - DNA, 24 bp, Homo sapiens
  chr5:3197991-3198015
  hyper
cgcccggcacgagctccgtgacga

SEQ ID NO: 29425 - DNA, 308 bp, Homo sapiens
  chr5:3590350-3590658
  hyper
gatgcaaacacaacacggagaggggatgtctcctgtctagagattccagggcagtttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcc

SEQ ID NO: 29426 - DNA, 100 bp, Homo sapiens
  chr5:3590803-3590903
  hyper
cgtttgccggtgtacccgcgcaggcagctacacctgtactgagagaatttacatcgccttgcttcgggatggcattgatttgggacgggtgaaatacaaa

SEQ ID NO: 29427 - DNA, 325 bp, Homo sapiens
  chr5:3591123-3591448
  hyper
ttacgtgtgtgcacacgcatgtaattcacttccttcgacactggggacggcgtcgtagcggcactccaggccaggccactgcggtccattcctctgccctgcgtttgtgggaaatacgggcccagtgccgcagctttagggcctgggtcgcccttggtccgcccgccgcgttcccgggtggtgtccccacgctgctgaggacctggttccgcgatgcttgccgcggggggcactccccgcagcctgcgaccgtcctgcgtccttcgcttctgggcgtttccttctggggtttccttggagcggctcgagtcgactcctcccgcct

SEQ ID NO: 29428 - DNA, 30 bp, Homo sapiens
  chr5:3591892-3591922
  hyper
gcggcaggtctgtgtcgcctggttctcggc

SEQ ID NO: 29429 - DNA, 233 bp, Homo sapiens
  chr5:3592642-3592875
  hyper
cgacccctagacctggttttgtcaggctcctcgtctttgtctctggcacagtgaccagggggcagccaccgggtgcggccagctccgccaggagcaacttccggagcagcggcagggcctgcctcagccaccccctttggaggcaggaaaagtggctgaggggccaacaaagtggctctctcctgcctcagaggtccagcgcctcacagctggggcgtcggtttcgaaggcca

SEQ ID NO: 29430 - DNA, 473 bp, Homo sapiens
  chr5:3594047-3594520
  hyper
gaggaggttgaagatcggaaatctgtcttagggttagaaggtgtctggtggtaggctggggaacaggaaaaagctgcagttaggggcttcccggatttgtgtcaccaagaatccactccccaccaaccctcggcgtccccacaaacccagcccggaatctatgtaaaagcaggaaaggaaccctggaggttgtaggcggatcctggagtgtggaggggcgaattgagcgcgggaagcagcatgactagcaagacaatctgactcagagcagggaaaaatcaagcccgatgtcggagctggttattagtaattactaccatcacgggcattattgttgctaattataggcgatgtctcagtgtctgtcctcaggcccggaaaaccggagcccctcctgatgctgctgaagtccctgggcctcgaggctccgtgaagagagggaagcgaggcagggggtgaagggaccgcctggc

SEQ ID NO: 29431 - DNA, 15 bp, Homo sapiens
  chr5:3594777-3594792
  hyper
cggagctctccagcc

SEQ ID NO: 29432 - DNA, 279 bp, Homo sapiens
  chr5:3595090-3595369
  hyper
acctggtggacaaaccgggcgtccaggccacaccgtcttcccccttcgcgggggcgcgggggatgtttccctccggctgccagggggctttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggc

SEQ ID NO: 29433 - DNA, 208 bp, Homo sapiens
  chr5:3595849-3596057
  hyper
ggcgagggcgggcgggaggcagggagggggcgggaggggagccaggggcggggcctgcgctcaaggggatgccaatcaaagcatcaacttcaaattgtgtctgaaagccccgccgccgagcggagggcggccgccgcagtcggcgcgcgattgcggatccgggcgcagccgggagccgggcgcctgcgagcaccgggcagaggagccg

SEQ ID NO: 29434 - DNA, 170 bp, Homo sapiens
  chr5:3596555-3596725
  hyper
cgggtcgcccgggagggagagactacgggtggacctggtccggaagaggaactagaaaggtccgggggcaggttcccggtggccgaggccgcggcccccggggacgcaagagggctgggaggccgggcgggtgacggctgggccatctcggcctgggaaagcggaaggcc

SEQ ID NO: 29435 - DNA, 108 bp, Homo sapiens
  chr5:3596824-3596932
  hyper
cggccagggcgcccgggcaggcccacggggttcctgcaggtcggcccggcgtagcgtagcaggacttcccttcctggccgcgggttccactcgcgcggcctctttagt

SEQ ID NO: 29436 - DNA, 53 bp, Homo sapiens
  chr5:3597411-3597464
  hyper
tcggtgcttaaacttcggacggctggtgaattgtgcggcgggcgcggggccct

SEQ ID NO: 29437 - DNA, 81 bp, Homo sapiens
  chr5:3599364-3599445
  hyper
ccctggggtgcaccccgccaccttcgcagcccacacggcgccggcttattacccctacggccagttccaatacggggaccc

SEQ ID NO: 29438 - DNA, 106 bp, Homo sapiens
  chr5:3599502-3599608
  hyper
cgagcaccgcaagaatccctaccccaccaagggcgagaagatcatgctggccatcatcaccaagatgaccctcacgcaggtctccacctggttcgccaacgcgcgc

SEQ ID NO: 29439 - DNA, 85 bp, Homo sapiens
  chr5:3600390-3600475
  hyper
cgtccacctgtcccctagctgggaatgcagaggcctggctaggtgtggtagcgtggggtgcagcatgagccgggagggtaccagg

SEQ ID NO: 29440 - DNA, 21 bp, Homo sapiens
  chr5:3600732-3600753
  hyper
cgtccccaggccagattcgcc

SEQ ID NO: 29441 - DNA, 137 bp, Homo sapiens
  chr5:3601025-3601162
  hyper
ggcgtcgcccggcgctgcgtcccccactcacagtgcccctgtcttcttgtctcgctgtgtttcccatgcagctctctggccccgcaggagggaacgccgcggatcctagcagccctcccgtccgcctgattaagggt

SEQ ID NO: 29442 - DNA, 459 bp, Homo sapiens; identical to SEQ ID NO: 7726
  chr5:3602804-3603263
  hyper

SEQ ID NO: 29443 - DNA, 167 bp, Homo sapiens
  chr5:3606268-3606435
  hyper
ttaataagtttctcacgaagaaggagtctgccttaggcccacggaagtcaccacgtggcctgggactgaggaggcttcaggagcgacctaaaatgttaggattgctctaaatgaggaggcagagaaagggcggccttgaacccgggagggagcaagggatggagctg

SEQ ID NO: 29444 - DNA, 191 bp, Homo sapiens
  chr5:3606711-3606902
  hyper
cgccctctccgcggctgctgttgggcttctgaagacgcagcgggtgtctctgatcccctaatccatttatccagagtcccgagcgcaatggctggtgcggggacacaacggcaggaggtggcgggggtggagggagaccgggcactcagctagcgccaccctcctcccgccccacccgagacgctgagcca

SEQ ID NO: 29445 - DNA, 45 bp, Homo sapiens
  chr5:3607103-3607148
  hyper
aggtcacccaggctgcggacgccctgatagcggggtgacagcctg

SEQ ID NO: 29446 - DNA, 247 bp, Homo sapiens; identical to SEQ ID NO: 7729
  chr5:5139753-5140000
  hyper

SEQ ID NO: 29447 - DNA, 425 bp, Homo sapiens
  chr5:5140031-5140456
  hyper
cgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgggcagctccatcttcccgcgtcctcctcctctggcgctgcccgctgtctcccgccttccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccgg

SEQ ID NO: 29448 - DNA, 231 bp, Homo sapiens; identical to SEQ ID NO: 7732
  chr5:5140527-5140758
  hyper

SEQ ID NO: 29449 - DNA, 24 bp, Homo sapiens
  chr5:5140849-5140873
  hyper
cggagcggccgggctggatggaaa

SEQ ID NO: 29450 - DNA, 844 bp, Homo sapiens; identical to SEQ ID NO: 427
  chr5:6448738-6449582
  hyper

SEQ ID NO: 29451 - DNA, 529 bp, Homo sapiens
  chr5:6583189-6583718
  hyper
cccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggctttgaagggcgccagttcccagccgcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtg

SEQ ID NO: 29452 - DNA, 321 bp, Homo sapiens
  chr5:6687127-6687448
  hyper
cgcttcctaataaaacggcattccaggttctagaaagcatttcggtaaaacaggctcagaaacaccagattcaagagaataaccattatatgtgaatacatttaaaaatagatcacacactctaacaactgaaatgtacagaaaagatgaaagtgcatccgttaacgtttaaatgcccatttctactgatggcattcatctgcacgctcgcacagcggagcagctaacctttaggacagcgcccggggcagagccagctcggagccagcgctgcacagctgtgaggggccggctttaggctcacaccgcctgtatctgaaa

SEQ ID NO: 29453 - DNA, 30 bp, Homo sapiens
  chr5:7394911-7394941
  hyper
gggccggaccacactcgaataggaggaaac

SEQ ID NO: 29454 - DNA, 131 bp, Homo sapiens
  chr5:7395263-7395394
  hyper
tatgacaggcttatacggcacctccaaagtgtgactgaagctgagcgtgcagggcgcaacggacgctgcccccgcgaggccgtggcgggggctcccagtgcagtcactgccgcttcacttccacatggtgc

SEQ ID NO: 29455 - DNA, 207 bp, Homo sapiens
  chr5:7395433-7395640
  hyper
cgccctcgcagggagccccggccctctcaagagggtggagaggatgggggagccctcaaccctgctacgctgaggggaagaagggctggacggcaaaccggtgcccaccgcggggaggcgggaagggtgggaaatcctctccagctccccaaaagagtgaaaaggagggagaccccgctgtcctctgacccgcgtactaaaggaggg

SEQ ID NO: 29456 - DNA, 134 bp, Homo sapiens
  chr5:7395952-7396086
  hyper
ctgagtgtgggaggccggcgggcgaggacgaccccgggccggggcgcagcgggagcccctcagttcgccactccccccaccgtacagcccccgccgtccccagcctgcagccgggccgtcgggtgggggccgac

SEQ ID NO: 29457 - DNA, 211 bp, Homo sapiens
  chr5:7396534-7396745
  hyper
gcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggcagcc

SEQ ID NO: 29458 - DNA, 16 bp, Homo sapiens
  chr5:7396962-7396978
  hyper
ggaataggtcttcccc

SEQ ID NO: 29459 - DNA, 56 bp, Homo sapiens
  chr5:7396979-7397035
  hyper
actcagccctgggcttcctgggcgagtcgctgtctcctgcccggttccactggcat

SEQ ID NO: 29460 - DNA, 30 bp, Homo sapiens
  chr5:7850282-7850312
  hyper
gctgacactggtagtcgcctgagctgtact

SEQ ID NO: 29461 - DNA, 100 bp, Homo sapiens
  chr5:7850518-7850618
  hyper
tgtgagctctgtccccgatccctagcggtgcagcccctcccagggcccctcctcgttgtgagctcctctctccagtccccggcggcgcatccctgccccc

SEQ ID NO: 29462 - DNA, 377 bp, Homo sapiens
  chr5:7850922-7851299
  hyper
gcccagccgcccagccgcccagccgcccagccttccggtctccgcgcccagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgca

SEQ ID NO: 29463 - DNA, 150 bp, Homo sapiens
  chr5:9544685-9544835
  hyper
ggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtaca

SEQ ID NO: 29464 - DNA, 43 bp, Homo sapiens
  chr5:9545077-9545120
  hyper
ctggtgaaaggggctcgcctagctgcagcgcacctggctggtg

SEQ ID NO: 29465 - DNA, 76 bp, Homo sapiens
  chr5:9545555-9545631
  hyper
ctgatggatcccacccgagatcggcaccacccaccagccgaccgctgcagtccccgggtcccggccagcggcgcgg

SEQ ID NO: 29466 - DNA, 124 bp, Homo sapiens
  chr5:9546564-9546688
  hyper
gacgtggctgcaccccggaggggggcgccggccgagacctgagacgtggcgctccctctctgccggcctcggcttcaggtacgtgcggttccctcggctaaatctggcccgggggatggggggc

SEQ ID NO: 29467 - DNA, 97 bp, Homo sapiens
  chr5:10307612-10307709
  hyper
gggaagttccttacccgtgcacgcggcaaagaccttctttgccatagtcagaacacacgcgggagttcagaggagcggggcccgggcttgtgtgggc

SEQ ID NO: 29468 - DNA, 602 bp, Homo sapiens
  chr5:10333530-10334132
  hyper
ctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcaggagtgcgctttccttctagg

SEQ ID NO: 29469 - DNA, 134 bp, Homo sapiens
  chr5:10442381-10442515
  hyper
ccggccgacgtgctgcggtggtccgcggggtaagcgcccttggcccggggagctgtccggtctacatgcccaagccagacgagcccagagagccctcctcccggaccaggggccttacgcggcactcagcgtcc

SEQ ID NO: 29470 - DNA, 30 bp, Homo sapiens
  chr5:10563541-10563571
  hyper
cccagtcgcagcctccgggggtgagtccgc

SEQ ID NO: 29471 - DNA, 70 bp, Homo sapiens
  chr5:10564589-10564659
  hyper
tggccgggaccgggccggagggcggcggggcgcgctgcatgaccccaccaccgccgtccccaccccgggg

SEQ ID NO: 29472 - DNA, 428 bp, Homo sapiens; identical to SEQ ID NO: 429
  chr5:10564800-10565228
  hyper

SEQ ID NO: 29473 - DNA, 1 bp, Homo sapiens
  chr5:10565262-10565263
  hyper
c

SEQ ID NO: 29474 - DNA, 456 bp, Homo sapiens
  chr5:10565264-10565720
  hyper
tgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagatt

SEQ ID NO: 29475 - DNA, 518 bp, Homo sapiens
  chr5:11385070-11385588
  hyper
gcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 29476 - DNA, 180 bp, Homo sapiens; identical to SEQ ID NO: 7749
  chr5:11903545-11903725
  hyper

SEQ ID NO: 29477 - DNA, 293 bp, Homo sapiens; identical to SEQ ID NO: 7750
  chr5:11903821-11904114
  hyper

SEQ ID NO: 29478 - DNA, 59 bp, Homo sapiens; identical to SEQ ID NO: 7751
  chr5:11904115-11904174
  hyper

SEQ ID NO: 29479 - DNA, 185 bp, Homo sapiens
  chr5:11904195-11904380
  hyper
cgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcc

SEQ ID NO: 29480 - DNA, 290 bp, Homo sapiens
  chr5:11904455-11904745
  hyper
cggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaa

SEQ ID NO: 29481 - DNA, 30 bp, Homo sapiens; identical to SEQ ID NO: 7754
  chr5:11904962-11904992
  hyper

SEQ ID NO: 29482 - DNA, 30 bp, Homo sapiens
  chr5:14142742-14142772
  hyper
ggcctccccagaccccgtcatcttccccat

SEQ ID NO: 29483 - DNA, 30 bp, Homo sapiens
  chr5:15499838-15499868
  hyper
ctgtcttccattttccgccccagtctccaa

SEQ ID NO: 29484 - DNA, 119 bp, Homo sapiens
  chr5:15500570-15500689
  hyper
ggccccgcctggagccaccgggggtgccaggaggggacgcagcaccccctcccactggagtgcggggacctctccaggccggaggtcggccccggagcttgggggggatgtgcagctaa

SEQ ID NO: 29485 - DNA, 98 bp, Homo sapiens
  chr5:15500735-15500833
  hyper
cgccgcagctatggagtgtcccgggagacggcgggcatgacggctacaggatgggcgcgaacaatggcaaacagtacggcagtgagggtgagtgggcc

SEQ ID NO: 29486 - DNA, 460 bp, Homo sapiens
  chr5:15500834-15501294
  hyper
cccgtcctcagactcccggatcgcgtccctcctcccctttccctcgccctcccgactgggaagggaggttctcgcccgcggccgtgacgcaccccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctct

SEQ ID NO: 29487 - DNA, 93 bp, Homo sapiens
  chr5:16179060-16179153
  hyper
taggcgtgcgctgtccgtggtgctgaaagcttgaccggcgcgagctggagccgccaccggctgcctcggggtctcgccgggccttacctgctc

SEQ ID NO: 29488 - DNA, 141 bp, Homo sapiens
  chr5:16179266-16179407
  hyper
cgggctggtctccggcgccccgccgctcgcgctcgccgcccgcgccggcctcagactccccggggccgcctttcgctgctgccgcctccgggaggcgcctcggaccttccccggagtcgccggccgccgccacttcctggc

SEQ ID NO: 29489 - DNA, 100 bp, Homo sapiens
  chr5:16179554-16179654
  hyper
cggggaccggggccggctctcccggcggcggcgtcggcggcggcggcgggggaggttgcgggggaggctcggcgtccccgctctccgccccgcgacaccg

SEQ ID NO: 29490 - DNA, 139 bp, Homo sapiens; identical to SEQ ID NO: 2540
  chr5:16180182-16180321
  hyper

SEQ ID NO: 29491 - DNA, 399 bp, Homo sapiens
  chr5:16180371-16180770
  hyper
cgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgttgccgcatgaggaagcaaatgacaccgccccttaccctggaaaagtggctgcagccttccccggatcttagttttactcaccccgaagtcaatttctc

SEQ ID NO: 29492 - DNA, 30 bp, Homo sapiens
  chr5:16934552-16934582
  hyper
gaactcactgtagcccgagggtcctttacc

SEQ ID NO: 29493 - DNA, 159 bp, Homo sapiens
  chr5:16935883-16936042
  hyper
ggagcgcacttacctcggtgaagaagttatccattgttccagcgcagtcccggactcgccgagtgccgctccgactcgcggaagtcagcgccgccgcgggtccggggaaaccatgcgtgtcacggcgccactcccgaggacgcgcgcccgcggggctcc

SEQ ID NO: 29494 - DNA, 37 bp, Homo sapiens
  chr5:16936738-16936775
  hyper
catgtttagcagacccgggaaccggctcaacacggat

SEQ ID NO: 29495 - DNA, 333 bp, Homo sapiens
  chr5:17216805-17217138
  hyper
gcatcctccgaggggcgacgtctctcgccccaccagctggacctcggcgaccgcgcctcccccgaagctgcagccttcggggctgagccccgcgggtgcgggtgcaggtgcggagccgcccaaggtgcgcaactcgtttgcagcggcgcagcccagacgcgcctgcagctggggctcaccccaacctcgctgccagccgaggtagcggaatcgtagtcgacgtcgggagcgggctggactggggtctgagaagggtagctggtgccagggggtgtcattcatcacctcgaggcagctccctaagtctgagcgagagcccgagcacttcttatc

SEQ ID NO: 29496 - DNA, 184 bp, Homo sapiens
  chr5:17217681-17217865
  hyper
gaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccc

SEQ ID NO: 29497 - DNA, 943 bp, Homo sapiens
  chr5:17217991-17218934
  hyper
cgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctggggggagggggctgtcggggagaggagctgcgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaac

SEQ ID NO: 29498 - DNA, 234 bp, Homo sapiens
  chr5:17218985-17219219
  hyper
cgtccccagagacatttccgccttgaaacgaactcggtggacagcccttgcccatgtaattctcactctgctgaaattagcacagcacacatgggtgcattttttaggaccttgtacaggttgacaacacctctgtctcccccgcggccactcgcactgtggggcgggctaaaacccaacactagcgtcgaaatggccttctgctatagggttgtggaccgaccccccaccccc

SEQ ID NO: 29499 - DNA, 152 bp, Homo sapiens
  chr5:22853104-22853256
  hyper
gcatgcaccctgaagcgatcacacacacgcggtgcaatcccaatcaaaaacggaagccttacctgatggcagaaaaggcagctgcaggagcagcagcaccgacggccgcagcagggtgccaacagctcagccttgcgcggaaggtgagaccc

SEQ ID NO: 29500 - DNA, 30 bp, Homo sapiens
  chr5:22853539-22853569
  hyper
caaaacaaaacacagcgtgcctttgacaca

SEQ ID NO: 29501 - DNA, 185 bp, Homo sapiens
  chr5:31193883-31194068
  hyper
ccgcgacagcaagaacggcagagccggcgaccgcggcggcggcggcggcggaggcaggagcagcctgggcgggtcgcagggtctccgcgggcgcaggaaggcgagcagaggtgggttcgggctccgttggctatgcatacatctccctttttttttttttaattctgtagcgttgatagaagcca

SEQ ID NO: 29502 - DNA, 15 bp, Homo sapiens
  chr5:31194276-31194291
  hyper
gggggcaccgggaag

SEQ ID NO: 29503 - DNA, 102 bp, Homo sapiens
  chr5:31194311-31194413
  hyper
cgctgcctttctctacgccggcagaggctgccaggggagctctggcatttgcaaagttggctggtcaattaccaaagggcgctggtgcgtgcaggtcccgcc

SEQ ID NO: 29504 - DNA, 291 bp, Homo sapiens
  chr5:31639641-31639932
  hyper
gtttagctacaaatccgggtgcgggaatcccagccctggcagggcggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaagacagggccgggacctcctgctcgggcgcgcatcccgggtccccatccctgggccgtcttctggtcccttcctccgacaggagtggagg

SEQ ID NO: 29505 - DNA, 35 bp, Homo sapiens
  chr5:31854940-31854975
  hyper
tgagcaggggagtggcgagccgagtttaggattgc

SEQ ID NO: 29506 - DNA, 270 bp, Homo sapiens; identical to SEQ ID NO: 7769
  chr5:31855221-31855491
  hyper

SEQ ID NO: 29507 - DNA, 589 bp, Homo sapiens
  chr5:32710192-32710781
  hyper
agttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctg

SEQ ID NO: 29508 - DNA, 327 bp, Homo sapiens
  chr5:32711102-32711429
  hyper
gggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggc

SEQ ID NO: 29509 - DNA, 49 bp, Homo sapiens; identical to SEQ ID NO: 7773
  chr5:32711430-32711479
  hyper

SEQ ID NO: 29510 - DNA, 117 bp, Homo sapiens
  chr5:32711753-32711870
  hyper
tctattttgttaaagcgcccaagggggcgcagggaccttggagagaagagtggggaggaaagaggaagggtgggtggggggcagagggcgagtcggcggcggcgagggcaagctctt

SEQ ID NO: 29511 - DNA, 25 bp, Homo sapiens
  chr5:32712077-32712102
  hyper
ttgttttcactcacccgggtgcggc

SEQ ID NO: 29512 - DNA, 563 bp, Homo sapiens; identical to SEQ ID NO: 2546
  chr5:32712289-32712852
  hyper

SEQ ID NO: 29513 - DNA, 502 bp, Homo sapiens
  chr5:33892054-33892556
  hyper
gggtgcatggtcaggcgcgagaaggcagcgactgcaaagctgcccgcgatctccctgtgcttttttaagcagaaaggagctagacacctttttcccctccctcctcctaaaaggggagtgattcagctgacagtgtccgctttcggcggggtgtggaatgggccagagcgggagggcgcagcccaccccggtccccacccctccgcctcccgcatgccccgcggcctcgcagcccgcccgctcggtgcatcttcctcccggactcccacccccgcgctcctccggccccgccccgaacgccaggcccagctggccgagccggccaaataggggagacccgggagagccgccctgggaggcactggaggaagctgcgagtgagaggcccccaggccagccccccggcgtgcttaaatacaagctcaaaatgaggagaacagagttgaggcagaggggggccccactccctccatccttccgcgctcagcgctgccccctcccc

SEQ ID NO: 29514 - DNA, 24 bp, Homo sapiens
  chr5:33936208-33936232
  hyper
cccctcgcggcgccccgggattac

SEQ ID NO: 29515 - DNA, 129 bp, Homo sapiens
  chr5:33936233-33936362
  hyper
catgctccttggggcccgccgccttggccgtgcaagtgccaccgtaactggtgagagccgctggcaacccacccggagttgacaaccgcggagagacgcagacacccactgacctccaggaagctgagc

SEQ ID NO: 29516 - DNA, 327 bp, Homo sapiens
  chr5:33936363-33936690
  hyper
tggtggatggaactctacgatctctttctctccaaggacggaaacctcatccaagcagtcccagaggaaacggataaaggtatttgaaagggagcgagcggccccaaatcgcacaattgagcggctgggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgcc

SEQ ID NO: 29517 - DNA, 37 bp, Homo sapiens
  chr5:34655873-34655910
  hyper
ccaattggttcagtccggagaacgtgagcacattcta

SEQ ID NO: 29518 - DNA, 30 bp, Homo sapiens
  chr5:34656932-34656962
  hyper
atgaatgagcagacccggagatgcaccctg

SEQ ID NO: 29519 - DNA, 41 bp, Homo sapiens
  chr5:35230049-35230090
  hyper
tgcctttgacaaaggcgaatgcgagccgagtgcagtttgta

SEQ ID NO: 29520 - DNA, 30 bp, Homo sapiens
  chr5:36607079-36607109
  hyper
aggatcaaggttgagcggatctgcttaaaa

SEQ ID NO: 29521 - DNA, 133 bp, Homo sapiens; identical to SEQ ID NO: 7780
  chr5:36690192-36690325
  hyper

SEQ ID NO: 29522 - DNA, 30 bp, Homo sapiens
  chr5:37371493-37371523
  hyper
aggtgggagctaggtcgtgtgtctggccta

SEQ ID NO: 29523 - DNA, 122 bp, Homo sapiens
  chr5:37834615-37834737
  hyper
cgcaccccttgcccacgggtcggtaggccacacagccatcaggctggcttggggtacgtgcggggctggctgcgggtgggggtgcgagggggtccgccggcggcccccccgcggggagggaa

SEQ ID NO: 29524 - DNA, 2308 bp, Homo sapiens
  chr5:37836649-37838957
  hyper
agctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaacactgagcaagagtcgagcgcgttctaacatctccgcagcaggggccggaagagttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacaggagaaaaaggggtcattaaaataataacctcaatggcctagtggagtctcaagaatacgttcgagacagaga

SEQ ID NO: 29525 - DNA, 499 bp, Homo sapiens
  chr5:37839237-37839736
  hyper
cgacggcggtgggttcgaagatgacccaagccctgaatcgttctgtgacttgacggaagagcacctggccgagtcggggaaggaaactgcccctcttgggcattccgggtccaggcgcatctggggctccacagatctttgcccacgtggaaaaggcaacatgcccctccgaaaggccggcctctctccggttctacttttctctctcctcgcatagcttaggttccctctagtctttccactttctactctcaccgtttgctctggggtccagacgcacccctctgactagggcgcccttcagccggccgcacccacccgcgacgcaggcaccacccgctccctgctccccggcccgctccctcacttacctcggatcgggtctccgcagaccctaggttggacattaactccaggtgccccaagtcccagccaggagacccatccgggctgatggctggagcgcggagccccgcccaacaggtcaggggcaagagtt

SEQ ID NO: 29526 - DNA, 268 bp, Homo sapiens; identical to SEQ ID NO: 2549
  chr5:37839807-37840075
  hyper

SEQ ID NO: 29527 - DNA, 144 bp, Homo sapiens; identical to SEQ ID NO: 2550
  chr5:37840076-37840220
  hyper

SEQ ID NO: 29528 - DNA, 96 bp, Homo sapiens; identical to SEQ ID NO: 2551
  chr5:37840267-37840363
  hyper

SEQ ID NO: 29529 - DNA, 210 bp, Homo sapiens
  chr5:37840529-37840739
  hyper
ggtgcagggcagcgccgggctttcctcgcgcctgtcgaaggccggccttcccgctcgggtgtctcgccctctcgcttctccgcagggcaggaggcagtggcgagaaaaggagctgccggccggagttctagcaccgagaaggagaggtgcggagcggccgggtgagggaagccgagtatttgccaggggacgctgcgagtggggatgaat

SEQ ID NO: 29530 - DNA, 97 bp, Homo sapiens
  chr5:38257444-38257541
  hyper
tgtgaagagccaggacgcccaccgagtcctggcagcgttgcaaggtggggagggggcgggcgcggtcctgtcgctagtgactgcagatttcctctgc

SEQ ID NO: 29531 - DNA, 367 bp, Homo sapiens
  chr5:38257542-38257909
  hyper
gggcacttcctacggcctttgatctttccccaggaactgccgagggccgcgtttgcctctaagtttattccctcttggtttatttattgtatctgctttctcttctcgctggtttggaggtcagaacgccagtatgcaacgggacttgtgtcccaggcagggtctcccctctccaggcactaccgcgaaatctggcaaaaggtacattttactgagtcctagggcagcaaattcagcggcggagaaagagtctttctccattcaggagacaacccaggaagcccgatcccgggatcagaggccaggaccccgccccggccccctgccccaggcccagctgggcgccgcccaggggcttttctcggtc

SEQ ID NO: 29532 - DNA, 15 bp, Homo sapiens
  chr5:38257944-38257959
  hyper
cgccaggcttaactt

SEQ ID NO: 29533 - DNA, 496 bp, Homo sapiens; identical to SEQ ID NO: 7793
  chr5:38258174-38258670
  hyper

SEQ ID NO: 29534 - DNA, 287 bp, Homo sapiens
  chr5:38258671-38258958
  hyper
ccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggtaat

SEQ ID NO: 29535 - DNA, 111 bp, Homo sapiens
  chr5:38556250-38556361
  hyper
agggtgacccaagggcgcgcggagagcggcgggacccggagcggcgctctccggggtcactcccctaggacgctccgcagagctgggagcgctgccccaccccgcccgggc

SEQ ID NO: 29536 - DNA, 24 bp, Homo sapiens
  chr5:38556411-38556435
  hyper
cgcccacccgcccccaggactcac

SEQ ID NO: 29537 - DNA, 238 bp, Homo sapiens
  chr5:38556436-38556674
  hyper
gtacgctcccgcgccgctatcttgccatcccctgccgccggctctgtagcctcggccgccgccccggggctgcccagatcccacagccgcccgggggcaggagccgccaaggagggggccgggcacaatgcgccgccgcctccgcagccgccgtctcgcctcccctgtgtcggcgcgaggctgcttgaggcggccacgggcgaagggcggcccgctgcgctccgcgaaccccgcgggc

SEQ ID NO: 29538 - DNA, 134 bp, Homo sapiens
  chr5:38556773-38556907
  hyper
cgccgctcggctgggggcgcagcgggcccggccccgcccctgacccgcccctgcccccggccccggccccgccccaacccgcgcgcccccgccgatccccggccgcgcgcccgcgcgcgcgggtgctccaagga

SEQ ID NO: 29539 - DNA, 51 bp, Homo sapiens
  chr5:38557292-38557343
  hyper
tggggctcccctgcccgagatggccagcgggcgcgccgagagtatcctgga

SEQ ID NO: 29540 - DNA, 38 bp, Homo sapiens
  chr5:38845834-38845872
  hyper
cggagcctcggccgccgagttttcggtttccaagtttc

SEQ ID NO: 29541 - DNA, 560 bp, Homo sapiens
  chr5:39425003-39425563
  hyper
gccggccgggagcttcggagccgcgcggccactcccggcgagagatatggttctaatcagatgctggcagctgaggactccccaggaatgtgccaggatgtttttgctgcctgggcttggtaactccccctcaacgtgtctgcagagtcttccaaacttaactgtttattaactcgcgctgcagcggcgcagaggaccccgctcccctgagctccgcgagccccaccagctgggggcgatcgcagggacccagcgacgggaggggaaatgtgttcggggagaagtcaaaagccccagaccgacgcgggcggggggcgggtgcaaataaggacaggaaagggaagctctggaggaaaggggtgggatccaccgagcttcgtttcacagatccgttccctggattgccactgcgagtgatgtggcacacggagtcatcctaaccaacccgttggggccctttgaacaaaggactgcctttactcctgacttttctgacaagggacaacggttcctgcgcagatctgcagtttctaaagttgatcgcgcgattggatttgctc

SEQ ID NO: 29542 - DNA, 70 bp, Homo sapiens
  chr5:40680557-40680627
  hyper
tgccaccgctgctgccgctacaggtgagatggcgttgggctgacgttggggtcaacgggtagagaacgca

SEQ ID NO: 29543 - DNA, 78 bp, Homo sapiens
  chr5:40681150-40681228
  hyper
gcccagtgaccatcccggcggtgatgttcatcttcggggtggtgggcaacctggtggccatcgtggtgctgtgcaagt

SEQ ID NO: 29544 - DNA, 579 bp, Homo sapiens
  chr5:40681261-40681840
  hyper
cgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgc

SEQ ID NO: 29545 - DNA, 14 bp, Homo sapiens
  chr5:40682069-40682083
  hyper
gcctttaggtcggg

SEQ ID NO: 29546 - DNA, 34 bp, Homo sapiens
  chr5:41510835-41510869
  hyper
agcttttgttcctgacgtccgtgctcagctctct

SEQ ID NO: 29547 - DNA, 38 bp, Homo sapiens
  chr5:42423455-42423493
  hyper
tgctttcatttggaacgggcaggcggagaggaaggaag

SEQ ID NO: 29548 - DNA, 30 bp, Homo sapiens
  chr5:42423828-42423858
  hyper
agctgccaagcagggcgcagccatgggaag

SEQ ID NO: 29549 - DNA, 487 bp, Homo sapiens; identical to SEQ ID NO: 7800
  chr5:42424672-42425159
  hyper

SEQ ID NO: 29550 - DNA, 88 bp, Homo sapiens
  chr5:42950080-42950168
  hyper
cataagaagcggagtcgccagacagaacccgggacctggcagcagcaagtctgagaccgagatcggctccccgcgtcctgagcatgca

SEQ ID NO: 29551 - DNA, 274 bp, Homo sapiens
  chr5:42951038-42951312
  hyper
attgtgactattccacgacttgaacaaggggtagaaatcgcaggcaccgcgaaatagaaacttcctaggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccagg

SEQ ID NO: 29552 - DNA, 693 bp, Homo sapiens; identical to SEQ ID NO: 433
  chr5:42951419-42952112
  hyper

SEQ ID NO: 29553 - DNA, 457 bp, Homo sapiens; identical to SEQ ID NO: 434
  chr5:42991785-42992242
  hyper

SEQ ID NO: 29554 - DNA, 180 bp, Homo sapiens; identical to SEQ ID NO: 435
  chr5:42992375-42992555
  hyper

SEQ ID NO: 29555 - DNA, 42 bp, Homo sapiens; identical to SEQ ID NO: 436
  chr5:42992556-42992598
  hyper

SEQ ID NO: 29556 - DNA, 243 bp, Homo sapiens
  chr5:42992782-42993025
  hyper
cgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttcttttcc

SEQ ID NO: 29557 - DNA, 240 bp, Homo sapiens
  chr5:42993325-42993565
  hyper
tacgatttctatcccctggttcaagtcggggaatagccaaaatgtgatttctcaacccaagcaagtacccacttaggacaaacaccagcctagccctggcggcgatttctaggtcgtaggaagtcgatgtttcgccacagaaaggctgagtgaccctgtgactcatttcccagcaactccgggtttcctgtagcctaatcataacaaacgcagagttagccctgcctcaagtttcttttt

SEQ ID NO: 29558 - DNA, 280 bp, Homo sapiens
  chr5:42993865-42994145
  hyper
aagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagcaatttccg

SEQ ID NO: 29559 - DNA, 53 bp, Homo sapiens
  chr5:42994670-42994723
  hyper
gctctgcttctaatgcggagctggcggttttgcagcaacgcttttgccagtag

SEQ ID NO: 29560 - DNA, 679 bp, Homo sapiens; identical to SEQ ID NO: 7809
  chr5:43007818-43008497
  hyper

SEQ ID NO: 29561 - DNA, 199 bp, Homo sapiens; identical to SEQ ID NO: 7810
  chr5:43008737-43008936
  hyper

SEQ ID NO: 29562 - DNA, 224 bp, Homo sapiens; identical to SEQ ID NO: 2563
  chr5:43017953-43018177
  hyper

SEQ ID NO: 29563 - DNA, 384 bp, Homo sapiens
  chr5:43018326-43018710
  hyper
cgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcgccgatctgagggcttcggagtaccggccgggcgcggtggctcacgcctgtaatcccagc

SEQ ID NO: 29564 - DNA, 337 bp, Homo sapiens
  chr5:43019010-43019347
  hyper
atgcgattttttttaggtttaccgatgatcagtttagcagtgcctgggagctcttataccaagtttgttttcgcaatattgagtcccaccttagctaagcttgtgtgtattttaaactcccatggaagtcaggaaatgtccgcaaacgcgatttctggttaccaagctccgtttggcaatagcaagtcctgccgaacgcgactttttcctcttgtggaccaagtctgaatagaccagctactgcgatttttaagtcgtagtaaaaaaggtttaaccgtgactgcttttttttgttggtgttgtttgtttttgtttttgttttcgtaggaaatgtaga

SEQ ID NO: 29565 - DNA, 237 bp, Homo sapiens
  chr5:43019650-43019887
  hyper
ccggggagccgagctcggtctcagtctccctgctgtcaggtgccaggttgtgtctggtggctctccttcgtatgcggagctgatggttttgcatcagcgcttttgccagtagagccgactagcgttttctcagttacggcaccgttcttagcgcccagtgtgacgtttcccattcgccaggtccttatgttctctgtgctgtcactttcttggttctcgcaccgctagtatctgcta

SEQ ID NO: 29566 - DNA, 166 bp, Homo sapiens
  chr5:43040862-43041028
  hyper
acacaattactagtgcgaacagcggctcggtgcaatcaccgttctgcacggcaaaacggggttcaggaagttcctaggagatactagcggttgtaggagcgaaaaagtgacagcactgagaacctaaggaccccgcgaacgggaaatgtcacgttgggtgcagcaa

SEQ ID NO: 29567 - DNA, 32 bp, Homo sapiens
  chr5:43043256-43043288
  hyper
atggtggggggcacccgcgaaattgtgaaacc

SEQ ID NO: 29568 - DNA, 267 bp, Homo sapiens
  chr5:43191854-43192121
  hyper
aacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatcacccccctccccgagcgactgcactgggtg

SEQ ID NO: 29569 - DNA, 682 bp, Homo sapiens
  chr5:43192458-43193140
  hyper
gcgcgcctagcctggcgccgtgcagcgaagcccaagagctggcctcgccacgaaggtaagcgaggggctgggggactcgccgccagcacccccaccccgccacccttcctctgctaggctgcagacctgggtggctgaggaggaggcgcctctcctccccgcgacccaaggaagaaaggaagccctgccacggggtgtctgcgaagtggggtcagaagaaggttaggcgctttctggggcgtacccccacacctgcccaggccgatccgcaagcgagaggagggggcattagagccagggcgagagcgtgctcgcgcgtgtgtgcccgtgtcatgtgtggtgcccgtgtcatgtgcggcgcccatgtctatgtgcgcgcgtgtgtgcacccatgtctctgtatggtgtggacactcgtgtctgcgtgcgcgtccacacgtgagccgaggagcgcagcttagcgcctagcgttgcgcacagcgggtgcgctggaccagagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttctt

SEQ ID NO: 29570 - DNA, 261 bp, Homo sapiens; identical to SEQ ID NO: 7818
  chr5:43396969-43397230
  hyper

SEQ ID NO: 29571 - DNA, 160 bp, Homo sapiens
  chr5:43397305-43397465
  hyper
gcacgcctggacccgggggagccggctggggcgcccaggaccaggcctagcctaccgcgggctgcccttcacagagctgcaggagaaaacgttgtattgtgcacgcattccctaacccttactagtttttttttttttaattgatcggccagcttttgat

SEQ ID NO: 29572 - DNA, 369 bp, Homo sapiens
  chr5:44388243-44388612
  hyper
gggatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagagg

SEQ ID NO: 29573 - DNA, 65 bp, Homo sapiens
  chr5:44388856-44388921
  hyper
ggcaaggagagagctcgaggtggtggctgctggttagctccctctgggcgcggatctggccagaa

SEQ ID NO: 29574 - DNA, 174 bp, Homo sapiens
  chr5:44389326-44389500
  hyper
aggcagctgcccagtcgccgttgttttcttccctctcttcctttctgtttttagtggtgcctgccgatttgaaggctgccgaaagtcactttttgttttgggggacggcggctggtgttttgtatggccctatctcccacccccttcctttggaaagtccgcttgtaaacaggt

SEQ ID NO: 29575 - DNA, 561 bp, Homo sapiens
  chr5:44389793-44390354
  hyper
tagctctgtctaattcgctgctaaagcgtcctatgcttgcagcgcgggccacggcgctgacggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcaggttataaactggtcagaacgagcacagaaaaggaagacataattagtgtcctttcctcctctgctgccagcttccaaggaggtctcctctttaatgaatcactgatttctcgcttccgttgctgaagtaaaaagttcacactttggccctctctgccttttaagctcagggagatttatcgtcacccttaaaagttgcctctctcggcgcaaatgaaatcagggacccaaataaccgatttctaattgct

SEQ ID NO: 29576 - DNA, 97 bp, Homo sapiens
  chr5:45695143-45695240
  hyper
tttggtgagacctcacgtcagggactatccaagtgcaaattgcccttcttttgcctgccggccgctgtttctgagtaaacacagcgaggataaccag

SEQ ID NO: 29577 - DNA, 295 bp, Homo sapiens; identical to SEQ ID NO: 7824
  chr5:45695313-45695608
  hyper

SEQ ID NO: 29578 - DNA, 24 bp, Homo sapiens
  chr5:45695648-45695672
  hyper
cgccggcagcgccaccccccgccc

SEQ ID NO: 29579 - DNA, 28 bp, Homo sapiens
  chr5:45695936-45695964
  hyper
gcccctcggcgtcttcgaagccccccgc

SEQ ID NO: 29580 - DNA, 142 bp, Homo sapiens
  chr5:45696313-45696455
  hyper
tcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgcc

SEQ ID NO: 29581 - DNA, 9 bp, Homo sapiens
  chr5:45696456-45696465
  hyper
gagctaggc

SEQ ID NO: 29582 - DNA, 57 bp, Homo sapiens
  chr5:45696466-45696523
  hyper
aggctcagctcggctcagccctcgcgccccagcgcctcccctcggctgccctctgtt

SEQ ID NO: 29583 - DNA, 386 bp, Homo sapiens; identical to SEQ ID NO: 7826
  chr5:49736592-49736978
  hyper

SEQ ID NO: 29584 - DNA, 201 bp, Homo sapiens
  chr5:49737098-49737299
  hyper
cgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccggctgcagcctctccggcctccgccctctcggctctagcaggtc

SEQ ID NO: 29585 - DNA, 157 bp, Homo sapiens; identical to SEQ ID NO: 440
  chr5:50263484-50263641
  hyper

SEQ ID NO: 29586 - DNA, 111 bp, Homo sapiens
  chr5:50264180-50264291
  hyper
ttgcttatctgtattcgaggggttagtctccatcctaggattgtccctttcaaaaaaaattttttggatgcatctgttttcactttgcactttcaacgggctggagcagac

SEQ ID NO: 29587 - DNA, 350 bp, Homo sapiens
  chr5:50264500-50264850
  hyper
gaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcacaagagaccaagagatccggagtcaggctgtg

SEQ ID NO: 29588 - DNA, 96 bp, Homo sapiens
  chr5:50265070-50265166
  hyper
tatcagtgaaagcatcggagggactcggattgaacgcggcagctccggaactggacaacagctgcgtggtgcagccaatcccggggcctgtgggaa

SEQ ID NO: 29589 - DNA, 482 bp, Homo sapiens
  chr5:50265190-50265672
  hyper
cgggcgagagcaaggagcctcccggccacacagccacaggcgctgcggaacccagcccggactctccccggctggagtgtgcgaagggcttcccgcccaggggcccagggtggtcttagtgaaaaagggatggcgctgcagcactgaccacgttgccctggtttctccatttctccttcccaagtctctgcctctgtttccccatgacccggaggacgcgcctacggaagagacgtctggtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccacca

SEQ ID NO: 29590 - DNA, 160 bp, Homo sapiens; identical to SEQ ID NO: 7831
  chr5:50265720-50265880
  hyper

SEQ ID NO: 29591 - DNA, 48 bp, Homo sapiens
  chr5:50675007-50675055
  hyper
gagaatacaaatttccgtcctcgcttggccgaacgcctccctgcaatc

SEQ ID NO: 29592 - DNA, 32 bp, Homo sapiens
  chr5:50678159-50678191
  hyper
aaatccctccctactcgcgcccttagactaat

SEQ ID NO: 29593 - DNA, 286 bp, Homo sapiens
  chr5:50683270-50683556
  hyper
ctgtacttctctccccgctctgggccgcctccgctcccccctcccccgcacaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgc

SEQ ID NO: 29594 - DNA, 143 bp, Homo sapiens
  chr5:50685653-50685796
  hyper
cgggcctcagtccccgtgtgatccgggtctggtttcaaaacaagcggtgcaaggacaagaagcgaagcatcatgatgaagcaactccagcagcagcagcccaatgacaaaactgtgagtggctctggggccgggcagggaatg

SEQ ID NO: 29595 - DNA, 229 bp, Homo sapiens; identical to SEQ ID NO: 7833
  chr5:50685846-50686075
  hyper

SEQ ID NO: 29596 - DNA, 63 bp, Homo sapiens
  chr5:50694717-50694780
  hyper
ttctacccccaggtgcgttgcccacgtccagcgggcagggcagcgcagcgcctgtctgcactc

SEQ ID NO: 29597 - DNA, 190 bp, Homo sapiens
  chr5:50695051-50695241
  hyper
aatcagccgaagaggcgctccccggcccactccgctcggctcgcccgggtccggagccaccgctcgacgcagacggcacaacaaacagcacctgaggctttatagctcgctttattgtttaatggagaatgcggcataacattcatttgtcttcttggttccgcgacctggccgctttgcagccacagac

SEQ ID NO: 29598 - DNA, 113 bp, Homo sapiens
  chr5:50695350-50695463
  hyper
cgccctcaggcccctggagaggtacccagctgcagcccctttcttgcttccaaagcccggaggcggaagggtggagggacagtgaaagaaagcttaggcgaggtgtctttgac

SEQ ID NO: 29599 - DNA, 343 bp, Homo sapiens
  chr5:52776466-52776809
  hyper
aatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccagggtaagcgagtggggatgcgctggggaggcttggctgaggacaggggggtcgacttttctgtggtctccacttggtctgttctgagcaacgctgctctcggaag

SEQ ID NO: 29600 - DNA, 30 bp, Homo sapiens
  chr5:52778616-52778646
  hyper
ccgccgggtctccttcgctagccacctcgc

SEQ ID NO: 29601 - DNA, 297 bp, Homo sapiens
  chr5:54179796-54180093
  hyper
cagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcgggggcagggccggggcggggagagccattt

SEQ ID NO: 29602 - DNA, 44 bp, Homo sapiens
  chr5:54472206-54472250
  hyper
tattcaactaatttccgagcagtgcaaaccggagagctccccat

SEQ ID NO: 29603 - DNA, 30 bp, Homo sapiens
  chr5:54472512-54472542
  hyper
tgagggaaagcgccacgccagtgggggctg

SEQ ID NO: 29604 - DNA, 347 bp, Homo sapiens; identical to SEQ ID NO: 441
  chr5:54516334-54516681
  hyper

SEQ ID NO: 29605 - DNA, 131 bp, Homo sapiens
  chr5:54516831-54516962
  hyper
cgccccacttacatccagcaccgaggccaggtgccgggttcggctggcgagttccttcagctgcacgttccgctccttgagcgaggcgatctcctcctgtttctgggtcaatgtcacgtgcagctgcagga

SEQ ID NO: 29606 - DNA, 156 bp, Homo sapiens; identical to SEQ ID NO: 443
  chr5:54519133-54519289
  hyper

SEQ ID NO: 29607 - DNA, 43 bp, Homo sapiens
  chr5:54519598-54519641
  hyper
aaagcttctgttctgcgcacagccagtgcggcctccattgctc

SEQ ID NO: 29608 - DNA, 314 bp, Homo sapiens; identical to SEQ ID NO: 7839
  chr5:54527322-54527636
  hyper

SEQ ID NO: 29609 - DNA, 648 bp, Homo sapiens
  chr5:57877892-57878540
  hyper
gcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaa

SEQ ID NO: 29610 - DNA, 16 bp, Homo sapiens
  chr5:57878937-57878953
  hyper
gtgcagagtgtggagc

SEQ ID NO: 29611 - DNA, 236 bp, Homo sapiens
  chr5:57878954-57879190
  hyper
tggagcgccgggactgtgcacgcttgaccggaagcccagaccagtgcggtcctagccagagagaaaggacatttgccaacaatgagacacgaagcgcccatgcaggtgggtccataaagaaagagtggcctcgggaggaattgaaagagatgcttttccccttgctccgcgcacaagcagttcaacgtaaggaaaggtctaggcggtcacccgcggagatgcggctctgtgacatg

SEQ ID NO: 29612 - DNA, 204 bp, Homo sapiens
  chr5:58335149-58335353
  hyper
ggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttct

SEQ ID NO: 29613 - DNA, 305 bp, Homo sapiens
  chr5:58335572-58335877
  hyper
tccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcc

SEQ ID NO: 29614 - DNA, 30 bp, Homo sapiens
  chr5:59188418-59188448
  hyper
tacttctccacctgacgaagagaaatgcga

SEQ ID NO: 29615 - DNA, 93 bp, Homo sapiens
  chr5:59188965-59189058
  hyper
gaatgggggagggggcgctctccactcaccgcctgagtccctggaacgaggagggccaggacatcctggatttcttcaggccgggccggtggc

SEQ ID NO: 29616 - DNA, 310 bp, Homo sapiens; identical to SEQ ID NO: 7844
  chr5:59189188-59189498
  hyper

SEQ ID NO: 29617 - DNA, 199 bp, Homo sapiens
  chr5:59189830-59190029
  hyper
aagcagcagcaacggcggcggcggcagtggtagccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctcca

SEQ ID NO: 29618 - DNA, 128 bp, Homo sapiens
  chr5:63255115-63255243
  hyper
caatcccaagagttccgcggcatcttgcgccactggctaaggcaaaaacctcaggtgtctacccgcgcttcagggcgccccagagcgtaggcggaggaacccagatcctgtaagtcagcagccgggag

SEQ ID NO: 29619 - DNA, 30 bp, Homo sapiens
  chr5:63257323-63257353
  hyper
taagataattggccacgttctgcagggagc

SEQ ID NO: 29620 - DNA, 113 bp, Homo sapiens
  chr5:63257737-63257850
  hyper
gctctcgcagtccagcgcgttcagaagctccagctgggaaactggagttggcctgaaagcagctccaggatctcccggcggcggagaggtggctggaacgtctgtctgtcgct

SEQ ID NO: 29621 - DNA, 171 bp, Homo sapiens
  chr5:63461448-63461619
  hyper
cggttccgtctggcccgcggcgcttgtctgcctgcgcggggtcaaagcccggcgccgcccacgcgcggctcgggtgggaacccgcagacgtggggcgagcagggccgctggctgtggcgggcgagcgccggggcgccacgtccgaggccgcggggtcggggctgcaggcac

SEQ ID NO: 29622 - DNA, 205 bp, Homo sapiens
  chr5:63461914-63462119
  hyper
ctgggctagggttgccgctggcctggccgcctctcgcccggcgggcctcaggtgacgcggccgcggcttaactttcgcacctgaggctctcggagcggcctcggggcgcgcccacctggaggttggaattacacagggtcgaaaaagctgagtcctggaggcgaggcgctgtaggtgtggcggaggaggccggggaaggtggggt

SEQ ID NO: 29623 - DNA, 464 bp, Homo sapiens
  chr5:63801808-63802272
  hyper
caacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagc

SEQ ID NO: 29624 - DNA, 32 bp, Homo sapiens; identical to SEQ ID NO: 2574
  chr5:63802273-63802305
  hyper

SEQ ID NO: 29625 - DNA, 206 bp, Homo sapiens
  chr5:63802339-63802545
  hyper
cgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggag

SEQ ID NO: 29626 - DNA, 78 bp, Homo sapiens; identical to SEQ ID NO: 7850
  chr5:63986450-63986528
  hyper

SEQ ID NO: 29627 - DNA, 393 bp, Homo sapiens
  chr5:63986569-63986962
  hyper
cgacctcaagtactgctgcagcgagccgggcagctacttcccctacaagcacagctacatgtggagcctcaggtgggctgagagcccgcgcgtgcggcggctggccgagcccggggctagggaggcgacaagcggagccacgccagggccagggaggttcccccgcgtccccgctatccgccctaggttaggtccctacggaaggacgcggagcctctgagggcgggtgagggcagggagagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgct

SEQ ID NO: 29628 - DNA, 30 bp, Homo sapiens
  chr5:65891802-65891832
  hyper
gccctccttcttgtccgttttcttgattcc

SEQ ID NO: 29629 - DNA, 56 bp, Homo sapiens
  chr5:65893398-65893454
  hyper
gagaagaggactccccgcgctccctcggtggcgctggcgtgcgcgcctgcagctcc

SEQ ID NO: 29630 - DNA, 291 bp, Homo sapiens
  chr5:67583945-67584236
  hyper
ctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctccttt

SEQ ID NO: 29631 - DNA, 303 bp, Homo sapiens
  chr5:71014676-71014979
  hyper
gcaaggcagggctggcgaggtggatgttgcagctgtcaccactgctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatctgtgcgcagagcctcgttcccaggcgcctggaacccggcgggcattgacgtcaagcgccggcggag

SEQ ID NO: 29632 - DNA, 531 bp, Homo sapiens
  chr5:71015031-71015562
  hyper
cgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctgggacagcgtccgctaagtttccacc

SEQ ID NO: 29633 - DNA, 40 bp, Homo sapiens
  chr5:71015825-71015865
  hyper
caagagaaagtacaccgccttgaatcgtacacacagtctt

SEQ ID NO: 29634 - DNA, 30 bp, Homo sapiens
  chr5:71402862-71402892
  hyper
ggtgtaggttgagagcgtcttcccccttca

SEQ ID NO: 29635 - DNA, 531 bp, Homo sapiens
  chr5:71403122-71403653
  hyper
gtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagagacgcgcgctgggagacgcgcaaacacgaccccacccagggcgcgacggtcactgcgctcctcccgcgcgccccgcacccatgcctct

SEQ ID NO: 29636 - DNA, 53 bp, Homo sapiens
  chr5:71403996-71404049
  hyper
gattcatcctcaccacggctacctcagcccctgagaaacgccttttctgattt

SEQ ID NO: 29637 - DNA, 77 bp, Homo sapiens
  chr5:71404665-71404742
  hyper
tccctttatccctggcgtcccggccctcccctcgctcctgacagaggtcgccgggtccctccgcagccccagcccgc

SEQ ID NO: 29638 - DNA, 112 bp, Homo sapiens
  chr5:71404743-71404855
  hyper
ctctattctcctggggtggtgctgaagcgtttctccgggagacaccggttggtgggcgtggtgcagtccgcactgcggtctctacggcagcccgaggcggacaaagggcgtt

SEQ ID NO: 29639 - DNA, 19 bp, Homo sapiens
  chr5:72415904-72415923
  hyper
tggccaaggccaaggcggc

SEQ ID NO: 29640 - DNA, 143 bp, Homo sapiens
  chr5:72416022-72416165
  hyper
cgcgcccctatagaactgggcctcaggcctcgagggggagcgggcctcggcgggcggggcgcacagttccgccagccggcgggggcatctcaactcgccggccccgccaggtgtgcgggccaggcagccgtggaaggtgccca

SEQ ID NO: 29641 - DNA, 207 bp, Homo sapiens
  chr5:72497943-72498150
  hyper
ggacaaaggaggaaacgctagcggggccccagagccctctccaatgggacccaaagggacacatcccggcacagaccctccccactctaaggcagagcctttcgcagggcctatcacagggcggagggagggagggagggcggcaggaggactgctggcctgaaactctgctttcacaaagaggttacacttcgaagttagacctca

SEQ ID NO: 29642 - DNA, 97 bp, Homo sapiens
  chr5:72512278-72512375
  hyper
agcgctggaagtggccgcaagggacgcgagggagagcagagctgtgaatcagccggaaagtcactccaactccagggaattccgctccgggaagaaa

SEQ ID NO: 29643 - DNA, 29 bp, Homo sapiens
  chr5:72526037-72526066
  hyper
gctactgctagccctcgccccagactgtc

SEQ ID NO: 29644 - DNA, 20 bp, Homo sapiens
  chr5:72526395-72526415
  hyper
gtgggcccaatgctccgggc

SEQ ID NO: 29645 - DNA, 179 bp, Homo sapiens
  chr5:72526491-72526670
  hyper
cgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagttagggggctgcgctagcagggacat

SEQ ID NO: 29646 - DNA, 114 bp, Homo sapiens
  chr5:72528189-72528303
  hyper
cggccgcccttaggagaccagtgatcatcccagccacctccctgcccagccccgggccgaactggaaaactcttaactttgggctttatttaaaacactcgggtttcgaaagcc

SEQ ID NO: 29647 - DNA, 30 bp, Homo sapiens
  chr5:72528599-72528629
  hyper
cgctgggcttcgggccgccgcccagagaca

SEQ ID NO: 29648 - DNA, 728 bp, Homo sapiens
  chr5:72529098-72529826
  hyper
ccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggggctgaagagatcacacgcggcggggtgtggaacttcgaggggtgtcacggccagggctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccgg

SEQ ID NO: 29649 - DNA, 446 bp, Homo sapiens
  chr5:72529889-72530335
  hyper
cggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgtttttgtaggtgctcctgctgctgggcactttggtaccccttcccttccccgcccctccccgccccttcacacac

SEQ ID NO: 29650 - DNA, 59 bp, Homo sapiens
  chr5:72530577-72530636
  hyper
ttccacccccacccccgcggaatgacagaaagagttgggaggaccgtggggatgtagat

SEQ ID NO: 29651 - DNA, 61 bp, Homo sapiens
  chr5:72594776-72594837
  hyper
aaaaggcaccgggcacggaggtttaatgtgaagcatgtgagcggggctcagtttacaggta

SEQ ID NO: 29652 - DNA, 150 bp, Homo sapiens
  chr5:72594867-72595017
  hyper
cggcctcgaggatttcggggggtttgcgccgccgaggaaaccctacccggacgaggcgagcagcctggtggccctggcggccgcgagctcccggctgccaccgctaggcgcccccgcccggcccgccggcgctccgagggcaaacccggg

SEQ ID NO: 29653 - DNA, 676 bp, Homo sapiens
  chr5:72595046-72595722
  hyper
cgcccaaggaaagggcttcccagtcaccctgcggcgacgcttctccctcccgggaatgacaccttcgctcgctttcacacagccaagccgttggagaggcagaaacagtgggtcccgagcccgcaggagaagttcccatcccgcccctctagccctcgggcgttggcagtggagtaacaaagacgctgccgcgccgttgaccccgaagaagctctgatgaaaaggagggcgggccgcgggataggagtttctacaattagttttttctgcctttacgttcccaagaagaagccgaggaagtagaaaggagagagatctgggaaaggcaagatccagaaatcaggagccattatgtttctcattttggagaaaaactgtaaaacagctcggcctcttgtccaccttgccccgaaggcaagtctggatatgaaaagaaaaaggcgggcaacggaggagatttatttttcattttaactttcctctcccaggcttcctcaccccctgcccccttcgattcctaggaggggcggccccagccctcggagccgattctcggcgctgcgctaggacatcagaggcgatacaggttcgatgttaaatgaaccttcaggccgccggacaatggcgcagacctcacacgggggcaccgcgccttcccccagccgtgctcggctcc

SEQ ID NO: 29654 - DNA, 15 bp, Homo sapiens
  chr5:72595773-72595788
  hyper
cgaaccaatgggcag

SEQ ID NO: 29655 - DNA, 30 bp, Homo sapiens; identical to SEQ ID NO: 7871
  chr5:72596861-72596891
  hyper

SEQ ID NO: 29656 - DNA, 72 bp, Homo sapiens; identical to SEQ ID NO: 7872
  chr5:72598030-72598102
  hyper

SEQ ID NO: 29657 - DNA, 383 bp, Homo sapiens; identical to SEQ ID NO: 449
  chr5:72599059-72599442
  hyper

SEQ ID NO: 29658 - DNA, 396 bp, Homo sapiens
  chr5:72599462-72599858
  hyper
cgcgcaccctagggagatgcgcggcgtccgcgcgggtcagcgccccagtaccactccccagtgtactccccaggtacacgcttcccttgcgcggcgagtttcaactcaggtcagaacggagctgagcggtgggcggagtggagaaaggtcccggaaattggccaagagggggcggtttcgaggtagtgccttcgaagtgttgtccagaccagcagggagggtcgcctccacctgcggggcctcctccagctccacaaggtagccccgtagggacttgcagatctgccagacctagcagtgagaccactgctcccactgaatggcgccgcctgcgggctggcccaagctctatgcaccggctttatctcattttctcctcaccgttaataactggca

SEQ ID NO: 29659 - DNA, 30 bp, Homo sapiens; identical to SEQ ID NO: 7875
  chr5:72608427-72608457
  hyper

SEQ ID NO: 29660 - DNA, 52 bp, Homo sapiens
  chr5:72677774-72677826
  hyper
gggccagccaggtgcctcccggctggtgcgagaccccgggcctgctgggagg

SEQ ID NO: 29661 - DNA, 32 bp, Homo sapiens
  chr5:72677997-72678029
  hyper
cgaagggtccgggtcaccgcgctcccggacgc

SEQ ID NO: 29662 - DNA, 39 bp, Homo sapiens
  chr5:72715309-72715348
  hyper
gtttgtttggattgccgggccggcgcgggagcggccggg

SEQ ID NO: 29663 - DNA, 106 bp, Homo sapiens
  chr5:72715590-72715696
  hyper
cggcccgggggagggcgaggcccggctgcctgcgctcgcgttcccaggccctcggaaccgcgcgccctcgaggccgagcgagccccgccgcgccgagcctcccggg

SEQ ID NO: 29664 - DNA, 15 bp, Homo sapiens
  chr5:72715730-72715745
  hyper
cgcagtactgctctc

SEQ ID NO: 29665 - DNA, 78 bp, Homo sapiens
  chr5:72716058-72716136
  hyper
atgtcccctaaagcacgggaagcttcgtgttttatgtttgggctgaatgaaaagaggaacgcacgctctttcctgccc

SEQ ID NO: 29666 - DNA, 30 bp, Homo sapiens
  chr5:72731806-72731836
  hyper
aaggagggaactaggcgccttttttccact

SEQ ID NO: 29667 - DNA, 41 bp, Homo sapiens
  chr5:72732869-72732910
  hyper
cggctgttgggtgatgtgcccgaggtttctctgcccttctc

SEQ ID NO: 29668 - DNA, 111 bp, Homo sapiens
  chr5:72733012-72733123
  hyper
gctcgccacagccggcgggaggcggggaagggagcagcccgggtggcttggagaacactgaacctttaattgggctataaatcagacaggggagtgcggtggagtttatgc

SEQ ID NO: 29669 - DNA, 30 bp, Homo sapiens; identical to SEQ ID NO: 7879
  chr5:72733558-72733588
  hyper

SEQ ID NO: 29670 - DNA, 218 bp, Homo sapiens
  chr5:72740121-72740339
  hyper
cccgcgctcctggctcgcccatccagggtccacggctcactcgtccctcgcctgccccgcggcccacacctctcgcagctcatacctcacccgccccgcggccctgcttcccccagtctcatcctctcgggagcaggcccgcagggtctgcaaggccaagaacggaaccccaaacgcagagggtggggaggtgagcggcaggacgcaaaactcggaat

SEQ ID NO: 29671 - DNA, 232 bp, Homo sapiens; identical to SEQ ID NO: 7881
  chr5:72742850-72743082
  hyper

SEQ ID NO: 29672 - DNA, 1092 bp, Homo sapiens
  chr5:72743389-72744481
  hyper
cgggggcggcgggggcgcgggcgggaagagcgcggcggcggctgccgggtcgcccgcgccccctgcggctcccgcgccgcgcagcagcagagactcggcggccgcggcgttgggtgggagcagcggctgccgcttgaagcgcttcctccggcgcaggaagctgccgttgtcgaacatgtcggcggactccgggtccagcgtccagtagttgcccttgcccgggttgccgggctcgcgggggatcttgacgaagcagtcgttgagcgagaggttgtggcggatgctgttctgccaggcggggaacttctcccggtagtaggggaagcggccgctgatgaactcacagatctcgctcagcgtcagccgcttcttggggctctgcaggatggccatagtgatgagcgcgatatacgagtagggcggcttcaccagcgggttcttggcgccgctacccgcgctcccgccgccgcccgcgccgccgccgccgccgcccccaccggctcctgcccccgccgccggggccgggcccgggggcgccggggagcccccagcaggcggggccagcaggatgtcatcgtcgtcctcctcctcctccagatcctccagctcgtcctccccggcgtacgagcgccgccgccgccgccgctgcgcggggacagccagccggggcccgccaccgccgccctcgtcgtcgtcctcctcttcctcgtcttcttcgtcctcgccctcccccaccacgtcgatgtctgtttcctcggcgaggccagaggcatcggacatctcagtgctcagggtcatagctgtggcgcggcggcggcggggcggcgcatgggggcgccgggctccgggctccctctgcgccccagcccgggtcccgggcggcaggcccggccggggggcgccacgctgggggcgctgcgactgcggctgccggagctgcgccggggctgccgggtggcggcggagtctcgcgcgccgactttataactcctgcgccgccgcggtagccgcgcggatgctgcgctccctgggctccgctcgcgcccggcccgggcggaggacttgaccttctcctctcggagcagcttttgc

SEQ ID NO: 29673 - DNA, 485 bp, Homo sapiens
  chr5:72744697-72745182
  hyper
gaaatcagcccttctcgggagagaaaattcacccgtaggagggaggcagcagctgagaagagtggggaggagaggggacctcactatttcttgccaaagaggctgatgcccgaattacgcggctgtctgcaccgagggccgctgcacgagttagacttcccagcctcctcaattagtcctccaccctaacctcagaagcacacccgcgacactctggtttgacccctcgacagcctgtaggagccttccagccgggggataaccaccccatcctctgaggtggcccctgggggacgctctggggtcggttgggggtgtccagcccctccagatcgggcgagcggccccccattggatctgatgcgaagccccccaatttaagcacgataataattgtttattgaccctttaacccattctcttcggttttactccaaagacgtttgttttccgccatctgttaataaaaacgctgtgagactggc

SEQ ID NO: 29674 - DNA, 4 bp, Homo sapiens
  chr5:72746680-72746684
  hyper
attc

SEQ ID NO: 29675 - DNA, 161 bp, Homo sapiens
  chr5:72746992-72747153
  hyper
agtcgcgaaattccccgagcgcggaaactcaagcgattcacgtcttgcgcgacccccttgtctcccccatcgtcccctaccccgggcctccttctctacagcgctcccagctttcggccccagctggtaactctcccccggctccccgcccccaagctggt

SEQ ID NO: 29676 - DNA, 34 bp, Homo sapiens
  chr5:72747486-72747520
  hyper
ggctttttccccccacgagcggtttgggccctcc

SEQ ID NO: 29677 - DNA, 67 bp, Homo sapiens
  chr5:74161713-74161780
  hyper
cacacaaaatggtggcgccgaggcggaggccggcgcacctgggggcgccacacgccctacgggatcc

SEQ ID NO: 29678 - DNA, 87 bp, Homo sapiens
  chr5:74162506-74162593
  hyper
atataaaaatagatgcggttaagccgcgggggctgcaacgctgattttgcgtattcctttaatgccgaccttcgcaggattctgttc

SEQ ID NO: 29679 - DNA, 30 bp, Homo sapiens
  chr5:74348254-74348284
  hyper
tagcaccgtttcctacgtgaagactgcaaa

SEQ ID NO: 29680 - DNA, 57 bp, Homo sapiens
  chr5:74349876-74349933
  hyper
acgaggagtgtcccacgcagccgcgagaaatattatcagcagcgtgggaaggtggag

SEQ ID NO: 29681 - DNA, 364 bp, Homo sapiens
  chr5:75377933-75378297
  hyper
ccaccacaggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 29682 - DNA, 30 bp, Homo sapiens
  chr5:75378559-75378589
  hyper
gtagacttaacccagcgaagttttcttctg

SEQ ID NO: 29683 - DNA, 689 bp, Homo sapiens
  chr5:75379005-75379694
  hyper
gagcaccgcgagtggcgcgcgggtcccgcctcccccgcgcgccgtgactccctgcgcaccgctggtactctcgccacgccgccgcccggcactgcagcaccagggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggggaagcgagccggagcggcgcccgcactgaggcggctgcagtgctgacaccactcagggcaagggtgtccgacggctggagcggtgagtgggggaggtgaagcgggcatccgcggggagactttcccccgctgctggatttctcttcccgactggtggccgggcgctgcagcctggggaagtttttgcagcctttcggaagcgcaactttgccccgcctgcccccggggaagcggctgcaggtgcccgctgctttgtaggcgcctttgttggagagggaccaggaaagtaggggtaaaatagatgcagtgaccccagggttcgctagggtaggtctggggactgggtcgcactttatctgggattcccagaggaggtgggtgggcagcagcggggatgcaggggccgcatctgcagcgaccgccacgctcttttttgctt

SEQ ID NO: 29684 - DNA, 807 bp, Homo sapiens
  chr5:75380067-75380874
  hyper
caggcgaagcagacccgaggctgtgaagctcagaggggagagggaccaatcgcagtaaataagctaccgaggtaatcttagatggcgatgagggcagcaaaagccatcagccgaccctctgaccctttctcttagtgggcttttccccttccgcctgggttctagaactgggaagacttttctccagagcgtcgcggggagcgccccgggctgggcccacggggactgcggaatacggggatgaacttggcttggggcagccagcaccccacggcagatgaacaatcgggagcagatctgtgggcgtgcggggaccttaggcggcgcgcgggggcggggggaggggctgagccacgggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcggagagcggcgacccggcggggcagaggggggcgggaggactgcggcggcgcggggcggcgaggaaagccccgcacggcctgggctggcgggcaggcggctccgcagtgcgccgcagtgccgggaaggagccgcagctaccgggcgctccccgggggaccgaggagatgaggcgtcttttaaggctcatgagagccttaaggagatgagaccgggatgccgtgatggtctcctctcccgctgaacctaatcc

SEQ ID NO: 29685 - DNA, 48 bp, Homo sapiens
  chr5:75699645-75699693
  hyper
ctccgcatacccaaacggggtgcgcgggcagtgcggggattgcgctct

SEQ ID NO: 29686 - DNA, 30 bp, Homo sapiens
  chr5:75700119-75700149
  hyper
gccaggggctgccctcggaaataggttgct

SEQ ID NO: 29687 - DNA, 148 bp, Homo sapiens
  chr5:76011206-76011354
  hyper
aagggaagagctccgcgaggccgcgcgggggggaagcgggagaagccgctcttcctattccactcgcagtctgcgtgtgggggaaacgagtgcccggcgtatgaaacgcctaacttcgcgaaataaagagagacgtataaaagttcaa

SEQ ID NO: 29688 - DNA, 30 bp, Homo sapiens
  chr5:76115162-76115192
  hyper
atccgggcaggtgtgcgaaggctgttctgc

SEQ ID NO: 29689 - DNA, 114 bp, Homo sapiens
  chr5:76115495-76115609
  hyper
gctttttgccaactccggagacttcctccgctggccccgcggggccggtggggttagcgagctgattgcgcagggcagggcggagtgggtgggaacccgcggcccgggagcctt

SEQ ID NO: 29690 - DNA, 357 bp, Homo sapiens
  chr5:76249314-76249671
  hyper
ccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggagg

SEQ ID NO: 29691 - DNA, 212 bp, Homo sapiens; identical to SEQ ID NO: 452
  chr5:76249695-76249907
  hyper

SEQ ID NO: 29692 - DNA, 206 bp, Homo sapiens
  chr5:76249944-76250150
  hyper
cgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtggcacttcttagacacttcgctggtgcccgagt

SEQ ID NO: 29693 - DNA, 39 bp, Homo sapiens
  chr5:76250409-76250448
  hyper
cttggttagaaggcccgccccacacgtctcacatctgag

SEQ ID NO: 29694 - DNA, 394 bp, Homo sapiens
  chr5:76476379-76476773
  hyper
gcacaagcccagagccggcttcagggccccctttcagacacccaggtgctagggtggctttttttcttttcttttcgcccttagtccctgcgtgtcctagtgccaactacctccttcctttccaggcgggaagcacctcgagcgtctagtgtaaccgtcaggtttattattcccaataataattgaccacagacagccgccgttcgcgtccacctggcgcttctcagcaggagctggacctgtttctccgtcgggccggctcctcgggctgctgttgcgcctggtgttttccacgcttccccggcgcgggacggtggggcccctgcattcctcctcgtgcttccagtggctgcaaagctgcctccccttctgagtagtgagtcgccggcagccc

SEQ ID NO: 29695 - DNA, 30 bp, Homo sapiens
  chr5:76506145-76506175
  hyper
gccgagccgcgggcacgctctgccctgtcg

SEQ ID NO: 29696 - DNA, 253 bp, Homo sapiens
  chr5:76506506-76506759
  hyper
gtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgc

SEQ ID NO: 29697 - DNA, 442 bp, Homo sapiens
  chr5:76506760-76507202
  hyper
cccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgtccgccccgtcggcggggctcgcacgggtagggggctccggcggagttgggtgaccgtgaggcggttggtttggaga

SEQ ID NO: 29698 - DNA, 345 bp, Homo sapiens; identical to SEQ ID NO: 454
  chr5:76923679-76924024
  hyper

SEQ ID NO: 29699 - DNA, 214 bp, Homo sapiens; identical to SEQ ID NO: 455
  chr5:76924086-76924300
  hyper

SEQ ID NO: 29700 - DNA, 64 bp, Homo sapiens
  chr5:76924416-76924480
  hyper
cgaagggcccacgcgttccaactggcgcgaatataaccattcccaagaccggcccctcccctcc

SEQ ID NO: 29701 - DNA, 167 bp, Homo sapiens
  chr5:76924754-76924921
  hyper
ttcattcttagaaagcgcttctgttctctgggtttggatttgaccagcacatgcagaaagagctgattgtgtttctctgtacaaagttgcagggttgtagatgtccgagtgcccccatcggctgccagcaggtggccgaggggcacgagggacgacaggaccaccac

SEQ ID NO: 29702 - DNA, 978 bp, Homo sapiens
  chr5:76925454-76926432
  hyper
gtgacctaggtgcaccgtgtctgtgcgcgcgcgtgtgtagcgtctgagcgtgagcgagagtgcgagtgtgtgtgtttctgcccacaaaccagtccattggtgtctgatttcagatcctgagtcgactccctggtacgtaaaatggcgggaaggatactttttgccgggcgcgggaggagggtcgcgaagtgtggggaaagaggggaccggaggggaggcggcgggcgaggggggtcgtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaatcaggcggaggggaggcctcgcgggctggggcttggggtgagcccgagcgagtggaggagagaggcgaggacgaaacgagacggggcgaaggccggggcgggacggggcagggcgccggggtccgggtgcgcgccggaagggcctcggggcggcccccggggcggtgctgggggcggagcgggccggggcgcggctgcattaagtgaagctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcgg

SEQ ID NO: 29703 - DNA, 128 bp, Homo sapiens
  chr5:76926728-76926856
  hyper
gggaggaacaagtgccgtaggcccgacaagcccccatacccagccggagactgtggctccccaccaactcctggcaactggcgccccctgcacccaccaagcgcggagtcctgcgctcctaagagctc

SEQ ID NO: 29704 - DNA, 294 bp, Homo sapiens
  chr5:76928157-76928451
  hyper
aatctggtcatctggcgtttactgtgcctaaatataaatgatgtaggacaagcccaggtactgagtttcctcttagaatttggccaacgcaatttgaccacgatatccgtggaaaaaaacgttgtgcatccgttaatctaacctatttagtgtttactctgcaagctaaagtatcaggggtatggacatacctgccctcggtctcggtgagccagcaatgttcagcggtgtgttcatgcccaggcaagcgtagacgcactctacgcttaccagtgtgaacggtgttgcagtcta

SEQ ID NO: 29705 - DNA, 262 bp, Homo sapiens; identical to SEQ ID NO: 2590
  chr5:76928678-76928940
  hyper

SEQ ID NO: 29706 - DNA, 984 bp, Homo sapiens; identical to SEQ ID NO: 2591
  chr5:76932282-76933266
  hyper

SEQ ID NO: 29707 - DNA, 55 bp, Homo sapiens
  chr5:76933464-76933519
  hyper
cgcttcggcagcctgacgaactgtacctccggccctcagccgattccctcttact

SEQ ID NO: 29708 - DNA, 614 bp, Homo sapiens
  chr5:76934040-76934654
  hyper
cctaacaaattatcacggggtatatcgcctttcgaaaaaaaaaaaaaggcgggggaggggggaagagaaaaataagaaaaacaaaaagtaacaacattccccaactcctttcttggatctacatattccatagatttttttttaaaggcgatgttaaatcaaattaaactttaatgcagcacaattacttttaaagaaattagtccatttaggtcgcattaaggtaaaataaggaacaaattgacaatttcctgccccggcttctcctggctgcccgggcgagaggcgcgcactcacctagcctggcgtccaggaggtcggcatgagacagcatcgcgcaccgctccagggcgaaagctgttcccccccaaattttagcggctttaagttatttaaaatagatataagctataagctatacgatatagatatatatagatcacctaaatgaaagaaaattcggtttgtggttaaaaagggggcttcttgcattataatgtcctttagagagacggggaggtgcttaacagttgaatgaacccgtgagcagctcggcgaggggaccaatcaggagggcagcctgcaaatgtcagcgcccggagagtcccccactc

SEQ ID NO: 29709 - DNA, 344 bp, Homo sapiens
  chr5:76934676-76935020
  hyper
cgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcctctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcg

SEQ ID NO: 29710 - DNA, 23 bp, Homo sapiens
  chr5:76936016-76936039
  hyper
ggctgagagcagatgcgagagga

SEQ ID NO: 29711 - DNA, 622 bp, Homo sapiens
  chr5:76936099-76936721
  hyper
agggaccgagcaaggagacaaaggaggcggcaaagcgaactctcgggcagttttgtttcctccttccctcctgcagcccgttcgcctcctctcctgcacacacacgtgcgcgcgcacacatatgcacacacgtgtgaatgcagggtattggccacaccagtttcttctgagctgcggagaccgcttcccgggaagctccgggccggactgggtttcagcggctgctgcagctgctaccaacgcggcctatgtgggactgggcgccggggtcgtggactcaggctcgcggcgtgtctgggagccgctagggtttttggcaagcggccgcagcccttctgagaaacgctttgcctgggaggagaattccgagacctaaagcaaacaaagtctccccaataaaagctttctttgcccccaaacaaaacctcaaatctagaagctagagcgctgggagcgcacagcaaaaggaggccagacagcagcccagggaggggcggcgtgagctcaggacggtgactcgggagtacgcaccggcccgcgcacgtccagggactcgcaggaggtttctgcccacctgggtggggcttgcagggtgtccacaccggaacgcagggtcagaagt

SEQ ID NO: 29712 - DNA, 7 bp, Homo sapiens
  chr5:76937416-76937423
  hyper
tccctct

SEQ ID NO: 29713 - DNA, 280 bp, Homo sapiens
  chr5:76939533-76939813
  hyper
ttgtgtgtgcttgtgcgagcagtgcgtgttccttgcctgttcactcacacggagggggcatgccaggcgctgcggaggggcagaaacctgccccaaagagtctcatttcctatcccacccagaagcctttcgcaatacacgagctcgacatatacacttttttcttttctgcagtaaacagtttcccacacattcgagtttgcaaacttcaaccagacagtccacccgcctgacttttcgtgggtgcaagggccggtcccttgctcgttttttctcccat

SEQ ID NO: 29714 - DNA, 54 bp, Homo sapiens
  chr5:76940355-76940409
  hyper
cgctcgcccactccccgctcgctccccgcccggctcctacgtcccaatcctttt

SEQ ID NO: 29715 - DNA, 641 bp, Homo sapiens
  chr5:76940857-76941498
  hyper
ccctcgtcccctccccgcaacccgagtgcggctaattccgggcgtctatattcactcaattagagaaatctacagagaagatcgatcttccatctgcagacatgccagcttaacaaattagattcttgtttcgtgcaggtgatttggtgacagttggggaattagaagtaataagttgttgtgtttgagcccgggcccccgccccccgcccgcgcccctccccgcccgggggcccctcggccgcgcccgccgcccgggcaccccctaccgcaccccccagccggcccgcgccgccgccgccgtcgccgcatcccccgccgtaattagtgctgctgccctccatgtgggctcgattaaaccgtgatttagccgaaagaaatataattatggctgcaaataaaataatcagcattgaagagcgatttccttaatgagatggagcggttgcacgtcacggagtaaaggggtctcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccaggggg

SEQ ID NO: 29716 - DNA, 389 bp, Homo sapiens; identical to SEQ ID NO: 7912
  chr5:76941512-76941901
  hyper

SEQ ID NO: 29717 - DNA, 184 bp, Homo sapiens
  chr5:77140527-77140711
  hyper
gctgagccattttcccgcgaggcccccagcggcgcgggggctgtggggaggtggtgtgggagtacggtcgctgctgcgcggcgtggggagaactggagcggctgcccggacgcccccgccctggtcccgggtactttctcggcctggctgcagccgcgtggatgtctctcgaagcctccaccct

SEQ ID NO: 29718 - DNA, 124 bp, Homo sapiens
  chr5:77147526-77147650
  hyper
gtgtgcgtgtgtgcacgcgcgagaagtgcgtgtgtaggcgcgtgtgcaagtgcgcgcgcgtgtgtttacacttccagaagtcaaatcctttctaggactcccccttgcttcacccggaagtgtt

SEQ ID NO: 29719 - DNA, 260 bp, Homo sapiens; identical to SEQ ID NO: 461
  chr5:77147872-77148132
  hyper

SEQ ID NO: 29720 - DNA, 280 bp, Homo sapiens; identical to SEQ ID NO: 462
  chr5:77148393-77148673
  hyper

SEQ ID NO: 29721 - DNA, 367 bp, Homo sapiens; identical to SEQ ID NO: 463
  chr5:77268367-77268734
  hyper

SEQ ID NO: 29722 - DNA, 503 bp, Homo sapiens
  chr5:77268735-77269238
  hyper
gcccccggggaccgcgagcaacaaaagcccggcccgcagcccctgctcctcgccttccttttcaattctcccctgatctcaggtggaattaggaggattaaagcagcaagtaaatgaggcgagtgtgcaaaatgactcctttctgaaccaaacggcatgctccgtgctggggaaatgagatgcacatttaaatctcatccatccaccgcctgcggccaccgccatgtacctgcctacttagcccaagggttaattaattgaggcttcaatgcactattgcaagagcattattgcatttgatactctacatctgtgatttaaaactctttcagtcccttgtcagcaagggagggtttttaactaggaaattagcattcagataagggaacgctctatttgcttctgaaaggaaggaaatattaaggatgctggtgcacaaaccgggctgtcatatcctgtcccatcctggagggagcgcgagggcccggctcctctgggagtgg

SEQ ID NO: 29723 - DNA, 71 bp, Homo sapiens
  chr5:77269263-77269334
  hyper
cgccagcaccaggggcgggctggagggggaccggcgatcagggaaaccttactcctcgcaggcttcaacct

SEQ ID NO: 29724 - DNA, 114 bp, Homo sapiens
  chr5:78407604-78407718
  hyper
taaagaggcaggctgcggactcggagcagctcggggctgcgcagcgggaaggctcgcctagtcggtccgcatccgtgtcgaccacctgtctggacaccacgaagatgccacccg

SEQ ID NO: 29725 - DNA, 94 bp, Homo sapiens
  chr5:78408181-78408275
  hyper
gatatcccgtccccacggagcccctccgcatctgtgtccgaggccgccgcgagcgccctctgcacccggcgcgcccagaacagggaggagtgca

SEQ ID NO: 29726 - DNA, 45 bp, Homo sapiens
  chr5:78408297-78408342
  hyper
cgcctggatctgcaccgcgggtgtcggggccgcctccccgccggg

SEQ ID NO: 29727 - DNA, 16 bp, Homo sapiens
  chr5:79330913-79330929
  hyper
ctttctctccagcccc

SEQ ID NO: 29728 - DNA, 205 bp, Homo sapiens
  chr5:79330930-79331135
  hyper
actgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggcc

SEQ ID NO: 29729 - DNA, 108 bp, Homo sapiens; identical to SEQ ID NO: 7923
  chr5:79331229-79331337
  hyper

SEQ ID NO: 29730 - DNA, 3 bp, Homo sapiens
  chr5:79331476-79331479
  hyper
cgc

SEQ ID NO: 29731 - DNA, 610 bp, Homo sapiens
  chr5:79864835-79865445
  hyper
ctggcagcgtctccacggtccccgccgacccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 29732 - DNA, 140 bp, Homo sapiens
  chr5:79865522-79865662
  hyper
cgcatcctcctcgacaccccgcggccgggcagccctcgccggttcccgccgctcggcgaggctgagaaggaggcggaacccgcatccccgcggagtccaagccccagcggccgcaaaactggaaccgagaaccagtggga

SEQ ID NO: 29733 - DNA, 361 bp, Homo sapiens
  chr5:79866099-79866460
  hyper
gcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctccccattgagggaagcacgcacccctacgtcacgggctttggctcct

SEQ ID NO: 29734 - DNA, 300 bp, Homo sapiens; identical to SEQ ID NO: 7928
  chr5:80255775-80256075
  hyper

SEQ ID NO: 29735 - DNA, 58 bp, Homo sapiens; identical to SEQ ID NO: 7929
  chr5:80256312-80256370
  hyper

SEQ ID NO: 29736 - DNA, 138 bp, Homo sapiens
  chr5:80256428-80256566
  hyper
cgtggggaaagggggcgcccttcgccggccgggacctgagcggtcgcgccctcgagggagccagctgggccatggccgcgaggcaggggtgagaccggcggccacccgtgagccctccgcacccgcaccatgcagaag

SEQ ID NO: 29737 - DNA, 59 bp, Homo sapiens
  chr5:80256887-80256946
  hyper
cgcactcccttgccgtcctaatccggggatcaggggtcgggggtcgtgaaagagtgcgg

SEQ ID NO: 29738 - DNA, 122 bp, Homo sapiens
  chr5:80689673-80689795
  hyper
ccctatccctggctgcgcagggttcagctctccgcaagtaccttcctcgccttcctaccccccccagcccccagccgccgccgctcccgcagccccggtcccgcgcctccccgcagccccgg

SEQ ID NO: 29739 - DNA, 275 bp, Homo sapiens
  chr5:80689879-80690154
  hyper
cgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaa

SEQ ID NO: 29740 - DNA, 30 bp, Homo sapiens; identical to SEQ ID NO: 7933
  chr5:81075100-81075130
  hyper

SEQ ID NO: 29741 - DNA, 639 bp, Homo sapiens
  chr5:82767171-82767810
  hyper
ccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattt

SEQ ID NO: 29742 - DNA, 1152 bp, Homo sapiens
  chr5:82768217-82769369
  hyper
ttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccac

SEQ ID NO: 29743 - DNA, 293 bp, Homo sapiens
  chr5:82769910-82770203
  hyper
accacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttag

SEQ ID NO: 29744 - DNA, 112 bp, Homo sapiens
  chr5:83017828-83017940
  hyper
ggctgttggagcagccgggaggagggagcggggctggccctgggactgaggacaagcaaacaagctcgaggggcccgcggccagggtggaggcgagacgcaggccgtccccg

SEQ ID NO: 29745 - DNA, 236 bp, Homo sapiens
  chr5:83678989-83679225
  hyper
gaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgcaggggacctggaagtcgcctaaactactcc

SEQ ID NO: 29746 - DNA, 56 bp, Homo sapiens
  chr5:83679587-83679643
  hyper
ggccaaaacgcccagcgccgggtctgggtttgcgaacggctcagcccaggccctgc

SEQ ID NO: 29747 - DNA, 725 bp, Homo sapiens
  chr5:83679644-83680369
  hyper
ccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgacta

SEQ ID NO: 29748 - DNA, 131 bp, Homo sapiens
  chr5:87436611-87436742
  hyper
tcctgttccaggagccgacagggaacagcccacctggagcaggtcttgggccaccactcgccccgccccccgtctctactcctcactcgctctccccgctcctattaagcagccaacgctgggtgatctcc

SEQ ID NO: 29749 - DNA, 30 bp, Homo sapiens
  chr5:87955350-87955380
  hyper
aaacagtaatcagaccgaaagtagttgagg

SEQ ID NO: 29750 - DNA, 63 bp, Homo sapiens; identical to SEQ ID NO: 466
  chr5:87955602-87955665
  hyper

SEQ ID NO: 29751 - DNA, 101 bp, Homo sapiens
  chr5:87955839-87955940
  hyper
cgcagagccggacctgtgccgggcgagttggatttagcccagttagagttaagatggtatcattagctgcgcacagcgtgacttcccgctaatcctctctg

SEQ ID NO: 29752 - DNA, 505 bp, Homo sapiens
  chr5:87956158-87956663
  hyper
gcccagagtggcaagcgctcaccaacgccggccaccgagcaaaacttccccgcccccgccccccacccagcttccccgcagggagaccctttccgttagcagcttttcactaagttaataacggtgtgtgtgtggtggtggcggggaggggggatttgggggttacacaatatctatatcaatgatattgatcacgtccagggaagaagcctgggcaaaactagagacaccgagtgtcagcaaaagaaagcttcttaaccacaagttgcgtgccgcctgaggaaggtgccctgtggcagggggtggccgctgggagatgcctgcctctaaccgacgtccaggcgtgactaaacctcgacgccacccccattcacaagctcaactcagggattcccaagcaaccgcagaccggaggtggcgcagaggcagtgaccgaggtcgctgattaggggccgagaggctggcaaataataattttaaaaaaaaaaaaaaccggaatagcctt

SEQ ID NO: 29753 - DNA, 521 bp, Homo sapiens
  chr5:87956679-87957200
  hyper
cgtgccaggcaaaggacagtctgacgacccgcccctgccgagccccgcagcgcggcgccggtgtccagcagcctccaaggcgccgagcgcgggcacgggaacttgagctagcgcaaacttgggcggcctcccagcctgctacccgggccgcagcgcgcccccggcctcccagtcgcgcgccaacccgggagcgcgcgcgccggcgcaccagctccatcagctagaggagcccgtctcccgggaaacaccaatcagacgcccgctttcaggcgagggccgcgagccgcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaacc

SEQ ID NO: 29754 - DNA, 221 bp, Homo sapiens
  chr5:87962639-87962860
  hyper
tctttcattctcacacgctccccggcgatcttgaaggagtttttactttcggttatctagctttatgaagaccaatacactcatacagctagataaccaaagataacaactcgcttcccacacaggcctctgtcttcctcttgccagactccaggtcctgatcctttctggcagtaccgaagagtggtcgtccaggatacttgccgcgcttaagattcctc

SEQ ID NO: 29755 - DNA, 55 bp, Homo sapiens
  chr5:87963456-87963511
  hyper
aattgtggaccagcccggcaaggtcaaaggttcgagaccgcgggagaccaaggta

SEQ ID NO: 29756 - DNA, 326 bp, Homo sapiens
  chr5:87967773-87968099
  hyper
aagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagct

SEQ ID NO: 29757 - DNA, 11 bp, Homo sapiens
  chr5:87968675-87968686
  hyper
gcaccggctag

SEQ ID NO: 29758 - DNA, 148 bp, Homo sapiens
  chr5:87968772-87968920
  hyper
cgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaa

SEQ ID NO: 29759 - DNA, 73 bp, Homo sapiens; identical to SEQ ID NO: 472
  chr5:87970041-87970114
  hyper

SEQ ID NO: 29760 - DNA, 803 bp, Homo sapiens
  chr5:87970115-87970918
  hyper
ggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggctacagaatggc

SEQ ID NO: 29761 - DNA, 387 bp, Homo sapiens
  chr5:87971517-87971904
  hyper
agggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacatacatcaaggaaattagggcattaaaaaaatatgcaaatcctgcgcgaagaggagcgggtgcattcctgg

SEQ ID NO: 29762 - DNA, 18 bp, Homo sapiens
  chr5:87972106-87972124
  hyper
gcataatcagggctccgc

SEQ ID NO: 29763 - DNA, 434 bp, Homo sapiens
  chr5:87974084-87974518
  hyper
aatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagc

SEQ ID NO: 29764 - DNA, 30 bp, Homo sapiens
  chr5:87976608-87976638
  hyper
acacacaggcacacacgcatgcccattttt

SEQ ID NO: 29765 - DNA, 100 bp, Homo sapiens; identical to SEQ ID NO: 7953
  chr5:87979725-87979825
  hyper

SEQ ID NO: 29766 - DNA, 100 bp, Homo sapiens; identical to SEQ ID NO: 7954
  chr5:87979885-87979985
  hyper

SEQ ID NO: 29767 - DNA, 156 bp, Homo sapiens
  chr5:87980430-87980586
  hyper
ggaccctgacaggtacggactccgcgggaccccagtgtgcttacctcgagcgaggccctggcaaatggtggcccagaagcatcaagtttcctctcccagccgttgtgccagatttcccctcctgccttctgctcctctccgccagctcgtttctct

SEQ ID NO: 29768 - DNA, 636 bp, Homo sapiens
  chr5:87980646-87981282
  hyper
tttagaggcaaaagcttgcttattcagaggagagagggagggggagagggagaaaggaggcgggagggaggagagacgggggagagagaagtaaaagggggatggaggatgaagaggaggtggagaatcagaaggtagtgcgggcgttgttagagaaggaggaggaagaggaggaggaggaggagggatgggaggggtagggtggagtaaccaaagatgggctgggatgggacggcgaggaataaattgctccccacccagctgcggtgcgacgcccccagcgtcccaggggagccggtgcgtcagctcacggctggccaaggcggggccgtacaaaagctagcgccgcgggacccccttcatgggcttctaccctagcagaccgagcgctggaggccgctccacgcgcgagctcgaaccacggagggctctcagctcggacaagcgtcgctgtctaagagctccaagctccacggaactttgattttatgcccgggagcccggtcatccacttctgcatctcagacaagcgccggaggctcgtgcagcttcctcgcgtcctcttcctggacgcggggcgcccaccttagtcatagcccctggtcccggcactgctcacgccgtcggtttccccac

SEQ ID NO: 29769 - DNA, 30 bp, Homo sapiens
  chr5:87983365-87983395
  hyper
taggttctatggtgccggcactgaggagtg

SEQ ID NO: 29770 - DNA, 30 bp, Homo sapiens
  chr5:87984984-87985014
  hyper
gccgccattccgcttcgtcttttcctgcaa

SEQ ID NO: 29771 - DNA, 179 bp, Homo sapiens
  chr5:87985348-87985527
  hyper
aataatttgggactgcgataaaaaaaaaatagccgcagtttcgaagtcccagagctttatcaggaagcattggacgcccctttctcctccagactggggcgggcttccagggatgccccctccgaccccgtcaccagcggaggactcatctgccgcggggctgccggaagctctcactc

SEQ ID NO: 29772 - DNA, 122 bp, Homo sapiens
  chr5:87985922-87986044
  hyper
acccttttgtcagaacgcgaattaatgtttccaagattttttctcaaaagaattaagagctctagaggcgcctcttccactcactagggcaccatgtcaaagggactcgtcatggcgattta

SEQ ID NO: 29773 - DNA, 63 bp, Homo sapiens
  chr5:87986310-87986373
  hyper
cacccccctagctcccgcgttaaaatcaccagagtcaattcccggcgtcggtctccacagtca

SEQ ID NO: 29774 - DNA, 108 bp, Homo sapiens
  chr5:87988193-87988301
  hyper
aggactggggttccacgcctggagcgcagttaccttgttgcgcccgcatgtgcctcgggaagtgcatctgcgaccctaggtcggggaccaccgcgttagtgagggaca

SEQ ID NO: 29775 - DNA, 135 bp, Homo sapiens
  chr5:87988516-87988651
  hyper
gtctcgcagtaggctcgggtcacaggagggagggggtaggggttcagctccgccgaaagagttagctaccgtcccctcctttctcggccggagacgttaagagttcccggtgaatgacaccgtccagggtcagaa

SEQ ID NO: 29776 - DNA, 134 bp, Homo sapiens
  chr5:87990318-87990452
  hyper
gaacccgaaaagcctcgcgttttttctcttgtgttttcctcacttttctttttctcaaactgcaaaattttagtgcctgaatggcgaatggggaaaaggactggccggagagtgaggcacggaagggaggtctg

SEQ ID NO: 29777 - DNA, 30 bp, Homo sapiens
  chr5:87991432-87991462
  hyper
cgagtaataatctcccggcctcagtttcca

SEQ ID NO: 29778 - DNA, 121 bp, Homo sapiens
  chr5:88179851-88179972
  hyper
caattctttattgcacgaaatgaagacaacacggcgagctgcggctccctgctcctctcgcggcgcctctgcggaggacgctcggagagaacctagtctcccgctgcggcgcgctcgcttg

SEQ ID NO: 29779 - DNA, 76 bp, Homo sapiens
  chr5:88180270-88180346
  hyper
aatgttagtaatgtacgaaataataaaataattaccagtatttgagatctcgacttcatcgcggggccatgaactt

SEQ ID NO: 29780 - DNA, 534 bp, Homo sapiens
  chr5:88184853-88185387
  hyper
taaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgc

SEQ ID NO: 29781 - DNA, 613 bp, Homo sapiens
  chr5:88185388-88186001
  hyper
acgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttg

SEQ ID NO: 29782 - DNA, 446 bp, Homo sapiens
  chr5:89854523-89854969
  hyper
cctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcatagctgcccgcgtcggttctgtccaaggctgcggttttgcagggagcgttaggttcctgca

SEQ ID NO: 29783 - DNA, 29 bp, Homo sapiens
  chr5:92915099-92915128
  hyper
cgctagggtcacgccgggtcccaggggcc

SEQ ID NO: 29784 - DNA, 57 bp, Homo sapiens
  chr5:92915510-92915567
  hyper
tcggctgctaggctgcgaatcccggtgctctctcgccgccgccgcaggttgtctgct

SEQ ID NO: 29785 - DNA, 328 bp, Homo sapiens
  chr5:92915837-92916165
  hyper
ctccgcccgggcatccgtttcccgcctaggagagagagggaatagcgggtgggggtgggagcagcctgttttgaatgtggattgctgctcgcctggcacgatcctcccctccaaggaggcgcggcggccgcgatcctcgccttagcgctacggcgagacagaggccgagcgagggcaactcccgagcaggccccgaagaaagttctcctcgtcccgccctggctgcctagactctgctctcggcctgcggaggccgtgcgagccaagactgcctcccggccctgcccgttaccaaccccaagttcaagagaaacgacaaccattatgt

SEQ ID NO: 29786 - DNA, 24 bp, Homo sapiens
  chr5:92940177-92940201
  hyper
ggggtgggccggggccggctgcga

SEQ ID NO: 29787 - DNA, 52 bp, Homo sapiens
  chr5:94620527-94620579
  hyper
ggggtgggctggagccgtaaccgaatcccggccgcggcgcctgcaaagtttt

SEQ ID NO: 29788 - DNA, 277 bp, Homo sapiens
  chr5:94620857-94621134
  hyper
cctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcgctccctgggtcca

SEQ ID NO: 29789 - DNA, 1656 bp, Homo sapiens
  chr5:94955586-94957242
  hyper
ctgctgtgctttacacgtaaatagagaatggatgaggttctcagcgcccaggggtccgcggcttccgcgagggtagcgtcgggggccgctgcagagattggaagagtacccgccgggaatgggagggaagacgcggggaaggtggagaataggaatcatgtgtgttcctcgagtgtacaacccacatttgagtgacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccg

SEQ ID NO: 29790 - DNA, 53 bp, Homo sapiens
  chr5:95067679-95067732
  hyper
cagcttgttgctgaacgcggccagcacggtcgcgcgtccggtgttcaccgagt

SEQ ID NO: 29791 - DNA, 30 bp, Homo sapiens
  chr5:95768245-95768275
  hyper
agttccctgaacaagcgtggagggattttt

SEQ ID NO: 29792 - DNA, 59 bp, Homo sapiens; identical to SEQ ID NO: 2617
  chr5:95769034-95769093
  hyper

SEQ ID NO: 29793 - DNA, 811 bp, Homo sapiens
  chr5:100236202-100237013
  hyper
tcacaagcttttccacgaacctttcatcctggagaaaaaggaaagtgctcagggagcctagctgccctcgcattgttcctggcagctccaactccttgcacagtcttggtctctcaggagaccaaggcagtcaggacgctacagggcacgggtgtaagcgcgacgttcgcggccagccctctgccttgccccactgtaattgcgggttttgattaagaaggaggagccagttgccgactgagctttgaaagtgactttgggtggggggtgggggtggggtgggggtggaaggaggggagggaccaaaagagcctgagtcctgcaataaaggtttccccctatcttctcactcattctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgag

SEQ ID NO: 29794 - DNA, 150 bp, Homo sapiens
  chr5:100237567-100237717
  hyper
acacatacacacacacgcaagggctgttttctttgttttaatcaatgtcagagaaaaatataaactgggcaggcatctctgctggtgtgtagtttctgatagaggacgcctccaaaccggaacagggaggatttccgaaacaggactttg

SEQ ID NO: 29795 - DNA, 115 bp, Homo sapiens
  chr5:100238283-100238398
  hyper
tgacttctcctttggcgagagagcacccagggccaacacaactgtcaccacaaccacacagagcaagttgaactcatactgggaacagcttagagaagcacgcacatctcaacaa

SEQ ID NO: 29796 - DNA, 296 bp, Homo sapiens
  chr5:100238681-100238977
  hyper
ggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttc

SEQ ID NO: 29797 - DNA, 44 bp, Homo sapiens; identical to SEQ ID NO: 2619
  chr5:100238978-100239022
  hyper

SEQ ID NO: 29798 - DNA, 97 bp, Homo sapiens; identical to SEQ ID NO: 2620
  chr5:100239023-100239120
  hyper

SEQ ID NO: 29799 - DNA, 9 bp, Homo sapiens
  chr5:100239134-100239143
  hyper
cgcgcacat

SEQ ID NO: 29800 - DNA, 521 bp, Homo sapiens
  chr5:100239203-100239724
  hyper
acacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 29801 - DNA, 30 bp, Homo sapiens
  chr5:100240068-100240098
  hyper
tgttggctggtaggtcgggaggcacctcta

SEQ ID NO: 29802 - DNA, 44 bp, Homo sapiens
  chr5:101631539-101631583
  hyper
ctcccccggctggctcgccgtgcccacctcgctctccactggcc

SEQ ID NO: 29803 - DNA, 30 bp, Homo sapiens
  chr5:101632034-101632064
  hyper
acaggcaggtgacagcgcccccgtgcggga

SEQ ID NO: 29804 - DNA, 141 bp, Homo sapiens; identical to SEQ ID NO: 7974
  chr5:107005171-107005312
  hyper

SEQ ID NO: 29805 - DNA, 83 bp, Homo sapiens
  chr5:107005635-107005718
  hyper
aaaacctaaagcttccgcttcccagcccccctcacttcccccagcccgtgcgctctctctgcgcgcaccgggaaaagagaagg

SEQ ID NO: 29806 - DNA, 104 bp, Homo sapiens
  chr5:107005983-107006087
  hyper
ggtacctggcctttccgcggcggcttaacaaagaggggcgcgacgcgagcgcttcccgccgacgcctcaagccatcagcgcccgggcgacgcaggctccgaggg

SEQ ID NO: 29807 - DNA, 155 bp, Homo sapiens
  chr5:107006762-107006917
  hyper
gttgcgcgccgcagccgcggggagacatacaccggcccgccgggcccggctcagcgtcggcgcagcaggctacgcacggctccgccaccgcccggggccctcgcactgcgccacgcttcgctccaagttactttggcggccggtgggaaactgca

SEQ ID NO: 29808 - DNA, 34 bp, Homo sapiens
  chr5:107007264-107007298
  hyper
gcctcggggatttctcgcgcgtgctttccttggc

SEQ ID NO: 29809 - DNA, 554 bp, Homo sapiens
  chr5:110408656-110409210
  hyper
ctttctccagggagacgccaggcattttggagagggagtatcctgctacgtgcagaactccgagaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagcc

SEQ ID NO: 29810 - DNA, 174 bp, Homo sapiens
  chr5:110559554-110559728
  hyper
taggtgggagggactcgccacggagacgcgctcaaggagggatgagttgcgccaccaccacctaggtccctctctcgctatccggcggggccgcccggacccaggtgctgccagggtacgcctggcgcccgccatcccagagcagcgtcccgctgcgcacggtctccctccagc

SEQ ID NO: 29811 - DNA, 80 bp, Homo sapiens
  chr5:110560039-110560119
  hyper
ggcggcggcggtgggcgtgtgcgcgcgtgaaggacgccgcctctctctcgctcctgcgttcgcaggcggcggctggcggc

SEQ ID NO: 29812 - DNA, 414 bp, Homo sapiens
  chr5:110560138-110560552
  hyper
cggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggtaaggcgcgggctccggctggggaagcccgcggcgtgcactgggggttgtccctctcgcagcgacggctcggagggtgcgggagcctgccttcgtgcccttcgatttctccctacctagttagtgtcttgagagagagctaaccttcattcaggtgcggctcgagtccttcccaccccaccagagcgcctaggccggtgcagctgtagg

SEQ ID NO: 29813 - DNA, 58 bp, Homo sapiens
  chr5:111754705-111754763
  hyper
attcttccggaacagcgcagaaacagcccatgtcggttgtggtcgtctccagccagga

SEQ ID NO: 29814 - DNA, 30 bp, Homo sapiens
  chr5:112629248-112629278
  hyper
tttgagggatgtgcccgaagcatccctaaa

SEQ ID NO: 29815 - DNA, 248 bp, Homo sapiens; identical to SEQ ID NO: 476
  chr5:112629488-112629736
  hyper

SEQ ID NO: 29816 - DNA, 119 bp, Homo sapiens
  chr5:112630330-112630449
  hyper
ggcagcggcggagcccgcgcggggaccctcccgcgcgcacccagcgccccgttccggggcagtgccaccctgggcgccgcctcgccactcctacggtgcctcgccgccccccattacca

SEQ ID NO: 29817 - DNA, 34 bp, Homo sapiens; identical to SEQ ID NO: 7978
  chr5:112824097-112824131
  hyper

SEQ ID NO: 29818 - DNA, 30 bp, Homo sapiens
  chr5:113391377-113391407
  hyper
ctctgcagctccccccggttaacacccgaa

SEQ ID NO: 29819 - DNA, 64 bp, Homo sapiens
  chr5:113391710-113391774
  hyper
cccgcctgcaggactcgctcctgccagccaaggactcaagaaggagggagtccccagtcccggc

SEQ ID NO: 29820 - DNA, 243 bp, Homo sapiens
  chr5:113391775-113392018
  hyper
gggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagccgggggcgctctcccgggccgcaagcaggcacggaatttgacgcccgagaggcagatggt

SEQ ID NO: 29821 - DNA, 315 bp, Homo sapiens
  chr5:113696418-113696733
  hyper
aataaataatgataccgaactccaacaaaactccagcactgtccgtgggcagcgactattcagcccaagctatcattcttaatttccctgccaggctgcgactaccggggtgaatcagcccgcgccaggcccctttcccacccgccgctgcagttaggacttggcaaagatgctcgatatttgcgtatttgtgaccggtctttgctttgtgtctgcgctgcaggtgaggaggaggaagagaagcagaagagcagctggaggccggcggtggctgagcagcccccacacctttgagcgagccgcctgcctctccac

SEQ ID NO: 29822 - DNA, 277 bp, Homo sapiens
  chr5:113696955-113697232
  hyper
ccacccacccccggccggggtgccgaggcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcgggcagccggcagcccactctc

SEQ ID NO: 29823 - DNA, 265 bp, Homo sapiens
  chr5:113697471-113697736
  hyper
agcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctaccggagccggcatggg

SEQ ID NO: 29824 - DNA, 140 bp, Homo sapiens
  chr5:113698000-113698140
  hyper
ccagcagccggccagcggcggcagcagcccatgcctccggtgcaacagctgcgcctcctccggtgccccggcggcgggggcgggagataacctgtccctgctgctccgcacctcctcgcccggcggcgccttccggaccc

SEQ ID NO: 29825 - DNA, 13 bp, Homo sapiens
  chr5:113698141-113698154
  hyper
cacctcctcgccg

SEQ ID NO: 29826 - DNA, 198 bp, Homo sapiens
  chr5:113698386-113698584
  hyper
accaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccg

SEQ ID NO: 29827 - DNA, 175 bp, Homo sapiens
  chr5:113698669-113698844
  hyper
cgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccgg

SEQ ID NO: 29828 - DNA, 166 bp, Homo sapiens
  chr5:113698951-113699117
  hyper
cgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtc

SEQ ID NO: 29829 - DNA, 156 bp, Homo sapiens; identical to SEQ ID NO: 7987
  chr5:113699401-113699557
  hyper

SEQ ID NO: 29830 - DNA, 571 bp, Homo sapiens; identical to SEQ ID NO: 2623
  chr5:114515009-114515580
  hyper

SEQ ID NO: 29831 - DNA, 61 bp, Homo sapiens; identical to SEQ ID NO: 2624
  chr5:114515610-114515671
  hyper

SEQ ID NO: 29832 - DNA, 216 bp, Homo sapiens
  chr5:114515900-114516116
  hyper
tgaaatgaaggccatcgagggctcccgggcagcctcgcccggcttgctaggatccgggtgcagcggtcggggctgcgcgatctaacggaacaaacgagggcggcggcggcggcagcagaggccgtgaaaccctcaccaggcggagccgggcgcgcggaggccccgcctcctcgggggtcgcggcagcggttcggaccgcagcggagacaaacaaac

SEQ ID NO: 29833 - DNA, 195 bp, Homo sapiens
  chr5:115151163-115151358
  hyper
gggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcagg

SEQ ID NO: 29834 - DNA, 736 bp, Homo sapiens; identical to SEQ ID NO: 478
  chr5:115151649-115152385
  hyper

SEQ ID NO: 29835 - DNA, 61 bp, Homo sapiens; identical to SEQ ID NO: 479
  chr5:115152616-115152677
  hyper

SEQ ID NO: 29836 - DNA, 47 bp, Homo sapiens; identical to SEQ ID NO: 2628
  chr5:115297186-115297233
  hyper

SEQ ID NO: 29837 - DNA, 101 bp, Homo sapiens
  chr5:115297449-115297550
  hyper
taagaaaaaccatcccgccaggccccttcttgtggtaacgcggtcctaaccctgctctgccccacaaccccatttcacccgggagacgcagacgccaggct

SEQ ID NO: 29838 - DNA, 58 bp, Homo sapiens
  chr5:115297928-115297986
  hyper
tcatccaaatatccacgtttaaggtgtccggattcgtttggcttgaccaccccctccc

SEQ ID NO: 29839 - DNA, 378 bp, Homo sapiens
  chr5:115298204-115298582
  hyper
cgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccc

SEQ ID NO: 29840 - DNA, 321 bp, Homo sapiens
  chr5:115298781-115299102
  hyper
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgc

SEQ ID NO: 29841 - DNA, 30 bp, Homo sapiens
  chr5:115908915-115908945
  hyper
gacacagtgaggagtcggaacagagcccta

SEQ ID NO: 29842 - DNA, 42 bp, Homo sapiens
  chr5:115911133-115911175
  hyper
cacagctattaattacgcacatacacacgttaataaagcatg

SEQ ID NO: 29843 - DNA, 30 bp, Homo sapiens; identical to SEQ ID NO: 7998
  chr5:115911931-115911961
  hyper

SEQ ID NO: 29844 - DNA, 74 bp, Homo sapiens
  chr5:119799931-119800005
  hyper
gggaggaggcgcaggcgcgctgctcgcccgtctgcagccccgagccgagcgccgcgtctcgggagttgatggca

SEQ ID NO: 29845 - DNA, 57 bp, Homo sapiens
  chr5:119800264-119800321
  hyper
acagatcaagatcatcgtggaggatttggaattagtcctgggcgacctgaaggacgt

SEQ ID NO: 29846 - DNA, 960 bp, Homo sapiens
  chr5:119800546-119801506
  hyper
aactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtggctgcagcgggaaaaggggtggggcgtagtctaggtcca

SEQ ID NO: 29847 - DNA, 505 bp, Homo sapiens
  chr5:121412800-121413305
  hyper
gactgcagagtggagcggaggacagcaagagaactggggacgcccgggactgcaaagcaatgtgaaaaggaagcaggaggggccagacgcgcggtttgcactggattccagggctgccactgcaggcgcgtgggggagggatcggatctgcgaggaccggggcccgccgcgcccaggcagccacgtcgagaagccacatagctggggaccaggtgcacgggtgcttccagcggacttgggggtacttaccgtactggaagtagccagtgccgtatccgggccggtacctgcccccaggtctgggcctttcataagtatcgtagtagttgtaataagggttgtcgtcagagtacttgtaggggttgtaagggtcgtcgcccaccatgccgtccacgcggctgggcggccgcaggttactgagcgcaggaacttctcccggcgctgtctggttctccgcgcgcgaggcgccagcttcgcgggctctagatgtcgagtagccagcttg

SEQ ID NO: 29848 - DNA, 225 bp, Homo sapiens
  chr5:121413586-121413811
  hyper
ggggctgctgttggccggcggcgggaggggcgcagtgcactagcgcgcagagctgcaaaggcccgagcaggagcacggtccaggcgaagcgcatcactccttttgccagattgaccccgctcgaggaggacgtggctcacagaaaataaaaacggggctcaaatcacgtgagggaaggagaaatcttcaaccaaggaggcgagcggagcacgggtatctcagtct

SEQ ID NO: 29849 - DNA, 159 bp, Homo sapiens
  chr5:121647435-121647594
  hyper
gctggggaaaagcaacggcagtcgaggtaaaaagagcgaaaggtaaagaaagagcaggttcgtggacaggagccggcgggcaggccgggggatccctggtgaggaagcggcgagggaggggcgtgggccgagccgggggcgccgcggggagggtcgctg

SEQ ID NO: 29850 - DNA, 494 bp, Homo sapiens
  chr5:121647801-121648295
  hyper
ggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggtgagtccaggtcccaagcggacgccgcggggaggcgggaggcgggcagccagcggctcagcctttccaagtttgcaccaggcgaccccggcgggtgtcgccccgtgctccccaagccccgggacccctttgtgccgcgagtctcggctgctccgggcagcagaggcgcctctgcagaaagggtttgagggggaggtctctatagtaacagtaacagtggtggcggcagcggctgctttactggggaaagggggaaacaacccccgcctcggtttccaaaggattgttcttttcatttgcccgcctcatgtggttc

SEQ ID NO: 29851 - DNA, 201 bp, Homo sapiens
  chr5:121648762-121648963
  hyper
cgctactgcttgcagcgaagaaagtcttaggaaacaaaaaggcaacagcattgttgctcattttcaatggacggctaggaggggggaaacgtgttgttttttcctgtgggaacgttgctttccttgggaaagttaattaaggaagcattactgtcggtgccccttttcacttgctggaggcaggatcggattcctcttggc

SEQ ID NO: 29852 - DNA, 75 bp, Homo sapiens
  chr5:122422240-122422315
  hyper
gggtccagcttacgccgctgcgcgcccttgtgcgcaccgggtgaggatgccgagctctgcgggcatcccggaagc

SEQ ID NO: 29853 - DNA, 218 bp, Homo sapiens
  chr5:122422616-122422834
  hyper
ttcttccctggaccccgcagcgaggggaaccaaatctctcccatgatagcccctctggcgtcagtctggaccgagtggctacaggttggactagggtaggcagaagatgcacttggcaccttaccgaacggtatttgaatccgtctccattactcattaatggcgtgaccttaggcaacccatctaaactttccgaacctcagcggtccccatctaca

SEQ ID NO: 29854 - DNA, 48 bp, Homo sapiens; identical to SEQ ID NO: 2630
  chr5:122423328-122423376
  hyper

SEQ ID NO: 29855 - DNA, 187 bp, Homo sapiens
  chr5:122423874-122424061
  hyper
ggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcggcagccgcaggcagctgaccgcaaacagcctcgc

SEQ ID NO: 29856 - DNA, 252 bp, Homo sapiens
  chr5:122424436-122424688
  hyper
caggaaaaactgagccgggcaaaagcgcaaacccggtcctggcggcgcgggcttgctccagcgcggacaccacagcgtgtgcggagatgcattcccgttgccgcatttccactgctttcaagatcagggcactgagctgggacccagaaaagacatatcatgggcagaaagagacaacaggctagcggcagacgtcacgccaaaaaaacaggggatgggagggcggaggagtttgtgcgggaaaggcgctct

SEQ ID NO: 29857 - DNA, 421 bp, Homo sapiens
  chr5:122424911-122425332
  hyper
acccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacg

SEQ ID NO: 29858 - DNA, 79 bp, Homo sapiens; identical to SEQ ID NO: 8010
  chr5:122425562-122425641
  hyper

SEQ ID NO: 29859 - DNA, 192 bp, Homo sapiens
  chr5:122425701-122425893
  hyper
cgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcg

SEQ ID NO: 29860 - DNA, 304 bp, Homo sapiens
  chr5:122426110-122426414
  hyper
caaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggt

SEQ ID NO: 29861 - DNA, 53 bp, Homo sapiens
  chr5:122426796-122426849
  hyper
cgggccgcggggttgtgggggaaccggcgggagctgttcgctggccaggcctc

SEQ ID NO: 29862 - DNA, 117 bp, Homo sapiens
  chr5:122430742-122430859
  hyper
tcccaggagctgggccgccccgcagggtcgagactgaaatcaattggctccccttccggcggccaggcaaacctgcctcgcctctggatctgcttctagacccgctcccggggcttg

SEQ ID NO: 29863 - DNA, 322 bp, Homo sapiens
  chr5:122431064-122431386
  hyper
atctagcctatagctcgagaaggcagtggggggaccgcaggctggagccccgggggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggctt

SEQ ID NO: 29864 - DNA, 75 bp, Homo sapiens
  chr5:122434453-122434528
  hyper
gctattcctttcttccggcgtctagggagagcgtgcacaccaaaccctccagaacagcaccccggtcccccaccc

SEQ ID NO: 29865 - DNA, 112 bp, Homo sapiens
  chr5:122434605-122434717
  hyper
cgcccttggagtcctggggctgcggctcctgctctaccgggctgcaggcttgctctgccccgtcccgtggcgtttgggaggcagtcgaggaagcctccgagtctctgggtcg

SEQ ID NO: 29866 - DNA, 401 bp, Homo sapiens
  chr5:124083481-124083882
  hyper
ttatctccaatttgtcggctttcccaaggggccagggacggggacgcctgggggagggagaagggtatctccgagctacttggattttagggacccccacttcatgtattaaacaaagaaaaaccttttgcttgctccccagcctggtcctgtaataaatacaccattgttactatttgtgggtttgtttgggttgggtggggcttttattttttctcttaatggtatttttgttgcttgcttttttaaggagatggcgaatggtaattataaccattacatgtaatgagtgactattcccttgtttaatattaaattatcgggcactgggatctgacaggagacagaaatcggcttgttctgcccttgcccccattttcctggatcgctttgggaggggg

SEQ ID NO: 29867 - DNA, 59 bp, Homo sapiens
  chr5:124084195-124084254
  hyper
tatagagacacaccacgcaaccgtacttacggtctgtattggatcgagttgaccttttc

SEQ ID NO: 29868 - DNA, 112 bp, Homo sapiens
  chr5:124084771-124084883
  hyper
ggcaaaaaaatggtgcgcccctttcaattactacatcattcacataaaacacttatttattaaaacaaatctcaaacaggctgcgaggagaggatgtcggtaaatacaagtt

SEQ ID NO: 29869 - DNA, 334 bp, Homo sapiens
  chr5:125930586-125930920
  hyper
ctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagcccgggactcgggatgagcccaag

SEQ ID NO: 29870 - DNA, 97 bp, Homo sapiens
  chr5:126366983-126367080
  hyper
cggaacctgtgagaccgtcgctctgggcgggctgccgtgcggggtggcatcctctgcggtgacttctgctgtcttttgggtccgccaggattccaaa

SEQ ID NO: 29871 - DNA, 96 bp, Homo sapiens; identical to SEQ ID NO: 8019
  chr5:126626514-126626610
  hyper

SEQ ID NO: 29872 - DNA, 30 bp, Homo sapiens
  chr5:127537200-127537230
  hyper
ggcccgcggctcccccgtgtggcctgagta

SEQ ID NO: 29873 - DNA, 311 bp, Homo sapiens
  chr5:127872869-127873180
  hyper
gaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggc

SEQ ID NO: 29874 - DNA, 254 bp, Homo sapiens
  chr5:127873552-127873806
  hyper
gagcggtacacgttgcataaccggcctaaagccccgagcgactccaggaccgtcagcgggcgggggaggaaattacaaaagccctggcgtaaaatttcaaaaaatgtgaacctcaaaagaaaaaagggcctgcacgcagagctcggcggattcccgtgcgctccgaagacggatattggaaagctgcaaaagtcaccagaaagaaacaggcaagcaaacaaaagtcgcccccagaagaagaggagggttccctc

SEQ ID NO: 29875 - DNA, 497 bp, Homo sapiens
  chr5:127873981-127874478
  hyper
cggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggc

SEQ ID NO: 29876 - DNA, 253 bp, Homo sapiens
  chr5:127874705-127874958
  hyper
cgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccgtgcaggggtgtgc

SEQ ID NO: 29877 - DNA, 40 bp, Homo sapiens; identical to SEQ ID NO: 8024
  chr5:128300655-128300695
  hyper

SEQ ID NO: 29878 - DNA, 82 bp, Homo sapiens; identical to SEQ ID NO: 8025
  chr5:128300712-128300794
  hyper

SEQ ID NO: 29879 - DNA, 246 bp, Homo sapiens
  chr5:128301033-128301279
  hyper
tcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatc

SEQ ID NO: 29880 - DNA, 408 bp, Homo sapiens
  chr5:128795689-128796097
  hyper
cagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaacc

SEQ ID NO: 29881 - DNA, 423 bp, Homo sapiens
  chr5:128796098-128796521
  hyper
cgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtcttt

SEQ ID NO: 29882 - DNA, 734 bp, Homo sapiens
  chr5:128796736-128797470
  hyper
ttgtgctactggaaccgcggcactttaagccccgcacttctgtctgccccgcccgcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 29883 - DNA, 137 bp, Homo sapiens
  chr5:129240373-129240510
  hyper
gcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgccc

SEQ ID NO: 29884 - DNA, 65 bp, Homo sapiens
  chr5:129240766-129240831
  hyper
atctccaggggccaccgctgcccgaggcagcacccgggatcaccagttttcgaagcagcccctgg

SEQ ID NO: 29885 - DNA, 81 bp, Homo sapiens
  chr5:129241413-129241494
  hyper
gcttctctgccagcacgtgcttcgggctcccacaggccctggcccgccctccccaccccttgcatccgcccacaattcgta

SEQ ID NO: 29886 - DNA, 30 bp, Homo sapiens
  chr5:129241724-129241754
  hyper
ttcaggaagggaagacggaggatgctagct

SEQ ID NO: 29887 - DNA, 360 bp, Homo sapiens
  chr5:131346877-131347237
  hyper
gggcctaatctgatccgcggatggtccttgccatcagggaagggggacgcaagaactcggcgggggtttgtggtggggtcgcagagagcaagccctatatctccctccgcagacccaggtgctccccaaacccggcccggagcccgcgagaactgggggcggagggtgtacttaggcggccctggggaccttgacgggacagctcagcagcaggggatgggggctcggcggccgcggagatgtaacacctccacctcgggcgaagacctcatagcctgcgggagatgggagtccgggacgcggacaggacgggcacttacctacgaatagccagagggagccccccgacacgaggaagaa

SEQ ID NO: 29888 - DNA, 39 bp, Homo sapiens
  chr5:131347702-131347741
  hyper
acgcgaccctgcccccgcgcgactcgcagcctgggtttt

SEQ ID NO: 29889 - DNA, 123 bp, Homo sapiens
  chr5:131593289-131593412
  hyper
gggcgggggctgggccgagtggggacaggggcgggcgggccgggggcgggcgcggcgtccaggcggcggcggcggctgcggcggcggcggctcctcctcagagtccggctcaggctccggctg

SEQ ID NO: 29890 - DNA, 15 bp, Homo sapiens
  chr5:131593472-131593487
  hyper
cgcctggtgggcggc

SEQ ID NO: 29891 - DNA, 263 bp, Homo sapiens
  chr5:131992030-131992293
  hyper
agcttccagactggccggtctgcgcgcccacccctgcctcccggaccggccaccgccggaggccgcggaggagggcccggccgcgcagatcccgcttatcgggcccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgg

SEQ ID NO: 29892 - DNA, 246 bp, Homo sapiens
  chr5:132083083-132083329
  hyper
cctccccacctcccccggcggcgccccaggctgcagtgttccgggagctgggttataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctc

SEQ ID NO: 29893 - DNA, 90 bp, Homo sapiens
  chr5:132947087-132947177
  hyper
agccccaaagactagcgtcagctcgtccccaaactcgaggcgacaggcgccgaaagcagagtgctgtgcctgcctcgtccaggtccctcc

SEQ ID NO: 29894 - DNA, 1064 bp, Homo sapiens
  chr5:132947465-132948529
  hyper
ccctttgggctgcagcgaggagacgcaagtttccccgcaaagccgcggggaggaggtgctgagaatgcctgcccggcgccccaacccggagccaagggcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 29895 - DNA, 155 bp, Homo sapiens
  chr5:133449703-133449858
  hyper
gctcttggctgtgttcgcggctcggagccgtcgcctgactgaggggcccgtcacagatgtgtgatgtataagctctgcacgcaacaggagctcaataaatgtgcgaaggggggtatacttatgttcgcactgtatgcaggcggcctagaaggaag

SEQ ID NO: 29896 - DNA, 127 bp, Homo sapiens
  chr5:134367108-134367235
  hyper
tcttcttggctgggtcgtctgcgccgccgcagcccgtgcctcccgcaccactgtcctcgggccccttgggttccccgccgcgctccttctctgcagtaggcaggacggggagcgggtcacctgggct

SEQ ID NO: 29897 - DNA, 1060 bp, Homo sapiens
  chr5:134374791-134375851
  hyper
cgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggtttt

SEQ ID NO: 29898 - DNA, 38 bp, Homo sapiens
  chr5:134376287-134376325
  hyper
cacagggctccccagcgttgcctcgtggccagataacc

SEQ ID NO: 29899 - DNA, 30 bp, Homo sapiens
  chr5:134376833-134376863
  hyper
cctcctctcaaccctcgacagcaggaaccc

SEQ ID NO: 29900 - DNA, 255 bp, Homo sapiens
  chr5:134385913-134386168
  hyper
ggaagggcaggagggcgaggggctagggcgatggaagggggagatcaagagtggcgcggcagggggagagcgccctgagcctcgctggagcccatcccggcatggctgctgggaccgacaggccgatcgcgggccgcgagcacatctcacagagcctgggcacagagggcccgaactgtgcccagcgaggaggacgcgtgtgggttttgcctgcaagggttctgaccacttggggacagcgagggcgcgtagagg

SEQ ID NO: 29901 - DNA, 43 bp, Homo sapiens
  chr5:134386184-134386227
  hyper
cgccgcctcactcttccgcgcgaggtgccgggtggcccagcag

SEQ ID NO: 29902 - DNA, 97 bp, Homo sapiens
  chr5:134801812-134801909
  hyper
ctcttctcaagtaggcggcaaagtttactggtgattgcgaagtgattgcagagcggttggagagtgaatggatccggagcagcgtagcaaacagcgc

SEQ ID NO: 29903 - DNA, 93 bp, Homo sapiens
  chr5:134802273-134802366
  hyper
agatttctaaacttgcgcctcctgggaagaaggctagagttagcgttgccgcagggctgtgcctcagacgaccaggcacgaccaagcacacag

SEQ ID NO: 29904 - DNA, 68 bp, Homo sapiens
  chr5:134825450-134825518
  hyper
tccgagcccgtggagcgctgcacaaaatcgtctagcgcggagcagggcggggacggggagagacacaa

SEQ ID NO: 29905 - DNA, 130 bp, Homo sapiens
  chr5:134825912-134826042
  hyper
ggagaggcccccgggacctttcaggcccacaaacgccgcgctaaatagccacgcgcacaatagcatgaaagggctcactcggaccttactgcaacacagtagattcacacccctccgaggggactaataa

SEQ ID NO: 29906 - DNA, 19 bp, Homo sapiens
  chr5:134826479-134826498
  hyper
cgtgcgctgagggcccgga

SEQ ID NO: 29907 - DNA, 481 bp, Homo sapiens
  chr5:134870446-134870927
  hyper
ggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatc

SEQ ID NO: 29908 - DNA, 626 bp, Homo sapiens
  chr5:134871417-134872043
  hyper
cgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagt

SEQ ID NO: 29909 - DNA, 523 bp, Homo sapiens
  chr5:134879428-134879951
  hyper
caagtcttgagcaaacgaccctagcgccgtggctcttcctacggcgggggcctcggagaacccggcggggcgcgcggggggacgcgtgggcactgccgcgtgggcgccctgaccccgcgcccgcgtggagcgagagccgggactctgggccagcaagttccagttccccgatggggccggctcgcccggagccgcgtgaggggattagggccgcacgagaggcgaccgcgccgcggcctccagccacgtgagcacagacacggcttcaaacgtccccaacgcactaatccttgttatccggcaggataaccgcggccgcgccagcacccggcctgcctcctccgtctggctgcgggcggggagtgcgcctggctcccgagcccctgacacggatttggggcctgcaatgacgatctaccccacaccatccacattcctgggaccctcggggcaaggtcctacagtccttggtgaccaccacgcctgcaaaaagcggtgggaaagttgttacgcttagaaaact

SEQ ID NO: 29910 - DNA, 501 bp, Homo sapiens
  chr5:134914251-134914752
  hyper
ggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgccagcagcagcaggagcagcgcggccgccaggagcctcatgctgaccggaggggcgcggcgtgggagcagggacatggggagggcgctggcccgtcggagcggcggcccggagacgccacccagctctgctcggctttctctgcccggggcgcgccttccggctctgctggctccggctgcgccgtcggtggatgcccagggctgtctgtggccgtgcgctgcgctctgcgcttgtctccgcgctctctccacagcctccctccgcccgccctggcctcttttaaatccgctcctgccctcgcagcgagcgagctcattaatat

SEQ ID NO: 29911 - DNA, 290 bp, Homo sapiens
  chr5:135170256-135170546
  hyper
gtgtctgggatgagccgcgcggagcgcacccttatccacccagagtgctgtgcctttaaggtccactgggggcgtgatgtcagccgccctccggcacttggagaggtgagcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagct

SEQ ID NO: 29912 - DNA, 172 bp, Homo sapiens
  chr5:135170997-135171169
  hyper
gtgggagccaggcttcgagattaggccggcccaacggggcgtcccgactggagggagcagagctctcacagcagggagcggagcgccggctgcaggtgcccattgccaggctgcgaggagcacttattgccttcagccgccgccaaccgtcagccatcgcctacctccaagg

SEQ ID NO: 29913 - DNA, 159 bp, Homo sapiens
  chr5:135265701-135265860
  hyper
gcattgataaaggggcgcccttcatcgggagtaagtcccagaaaccacaagcgttggctcatgcctgtgtggagtcacaggcaggtggccacggggaattagctgaagaccagcaggcaggaagcctcccacatgccacctaaggggcgctcccggaac

SEQ ID NO: 29914 - DNA, 12 bp, Homo sapiens
  chr5:135265919-135265931
  hyper
cgccaggtgggc

SEQ ID NO: 29915 - DNA, 197 bp, Homo sapiens; identical to SEQ ID NO: 485
  chr5:135265932-135266129
  hyper

SEQ ID NO: 29916 - DNA, 128 bp, Homo sapiens
  chr5:135266577-135266705
  hyper
ggagtttatagttgccacaaatgtcaaaaagtagccttctggcgagctgaaagcgctcacctgtgcgctttaaggtgtaccgtctttgtctttggcgagtgtgccttttaagacgcttccaagataaa

SEQ ID NO: 29917 - DNA, 62 bp, Homo sapiens
  chr5:135527945-135528007
  hyper
gcggtcgtggggcagcgcggcgaaggccgaatggcgcagctggcaaccgatgaagaggacga

SEQ ID NO: 29918 - DNA, 657 bp, Homo sapiens
  chr5:135528223-135528880
  hyper
cccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcggg

SEQ ID NO: 29919 - DNA, 25 bp, Homo sapiens
  chr5:136834026-136834051
  hyper
cgcgccccccagggccgggtggcgc

SEQ ID NO: 29920 - DNA, 203 bp, Homo sapiens
  chr5:136834289-136834492
  hyper
cggccgcgagccccgggcacccaggcgtcccagcgccccagcccggaggcggggaccccgcggcgggcacgggcagcgctcgcgcacctggggcgcctgtcgcgcctctagacccagggacccctctcacgaatgggggactcatctacgaacgaggaggctgcgtcacgaatccgaggctgccgtccaactacaggggaccc

SEQ ID NO: 29921 - DNA, 171 bp, Homo sapiens
  chr5:136834493-136834664
  hyper
tctcgtctattctccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctc

SEQ ID NO: 29922 - DNA, 175 bp, Homo sapiens
  chr5:136834706-136834881
  hyper
cgacagctaagggaaaggtctcccttgagcgccctgaggtctcgggggtaagaaaggcgcgcggaggtaaccccaggccctgaccctgccagccccctaggcggccgcggggaggtcccaactactccaagttggggcgcggggttcctctgggcacgtaccttgggggccggcc

SEQ ID NO: 29923 - DNA, 107 bp, Homo sapiens
  chr5:136834912-136835019
  hyper
cgcggcacggtcgccgggaaggctgatcgccggctcgcgcccctgcgctcctgccacacgccgccgccgagcgtctggccgctttgtgagcccgcagcgatgtgctc

SEQ ID NO: 29924 - DNA, 62 bp, Homo sapiens
  chr5:137225091-137225153
  hyper
cgtcagagccgggcagcgcgcgccgcaagactagcgcgcaagcgccgcggcctcaggcgaac

SEQ ID NO: 29925 - DNA, 364 bp, Homo sapiens
  chr5:137577620-137577984
  hyper
ccaggcaggggcgcccgtccggcaccggactcccgccctgggcccagctccggcgctcggccagccccgtgccccgggcggccgctgatagtcggctaatgcgtatcgaatttttgtggagttcggcccgcgcagagtgcgcgcggaggcgctgcccgagcctcttaattccctttgcatcgatcctgccgttaatgacataaccttctcccctaattaactgacaactgcattaggcggcgcgcctccgccgcacgccgcccacagcttcccccacgcagttccgcccgcgccggtgcggggctggggcgcagcggctccgcctggactcaactcagggtccggctgccgtggtggaggggag

SEQ ID NO: 29926 - DNA, 265 bp, Homo sapiens
  chr5:139047957-139048222
  hyper
acgcggacgtgcctgcgcggctctggcggccgcgtctgccgccccggcgcccgcccgggtcccaggccgactaattaggcccggctacctcccgcgccgcccactgcccgctccaggcccgctgcccgctccaggcccgaggtgatggcggctgttcctgccgttctggggcctgtgccccagagctggccgcgtttctcggggcgggagccagctctgctcgcctggcttaacccagacgagcccaggacgccctatccctgaa

SEQ ID NO: 29927 - DNA, 49 bp, Homo sapiens
  chr5:139175487-139175536
  hyper
gcgggacaggcagcccggcggcctccgatggccccgccgtgagaggccg

SEQ ID NO: 29928 - DNA, 62 bp, Homo sapiens
  chr5:139175815-139175877
  hyper
cgccgcgggaaagcccgagcccagcctgagggacggtgggggctgccgggccgattgtctcc

SEQ ID NO: 29929 - DNA, 58 bp, Homo sapiens
  chr5:139175929-139175987
  hyper
cgtgtgcgtggggggtgccagtggcagcctggtggtcggggatcggggcattgggtac

SEQ ID NO: 29930 - DNA, 196 bp, Homo sapiens
  chr5:139227725-139227921
  hyper
acgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactc

SEQ ID NO: 29931 - DNA, 36 bp, Homo sapiens
  chr5:139283710-139283746
  hyper
agccccttgctctcccggccgcgacgacccgctcgc

SEQ ID NO: 29932 - DNA, 490 bp, Homo sapiens
  chr5:139283973-139284463
  hyper
ctccgacattctgcacggggtcccaggcggtgggacggcctcagctctccgctgccgcgctgcgcccccgccgcctgcagcctcagtgcccgagcgcggcgcctttcttataggcggtcacaccctccgggggaggggagcagcgagccttaactcttcccctcccgcgccctccaccctcgccccccctccaccggctcgggccgcgggggcgtgtgggcggccggtctgggccctaggccccctccctgggcccaccgaggtaggcaagaccggcgcctaaacagggcgccacagacctcctcgccgaagagggggcttgagctgggctgggggcctgagcatgattggggagggcggagtagagatcccccagcgagggccaggctaaggacagcatgggggtggggagacagcgaggaaagggcccaggaagggaccaaaatgaagcccgctagccagcccagcggggtagcgagcacccttggct

SEQ ID NO: 29933 - DNA, 335 bp, Homo sapiens; identical to SEQ ID NO: 8065
  chr5:139525423-139525758
  hyper

SEQ ID NO: 29934 - DNA, 128 bp, Homo sapiens
  chr5:140012165-140012293
  hyper
gcggaggcatggtgccggttatctttaggtcctcgagcgtcagttccttgaggcgggagtacgctagcacacgcagggcgcctaccagtagctgagcaggaacctgtgcggctcccactgtgagccgc

SEQ ID NO: 29935 - DNA, 35 bp, Homo sapiens
  chr5:140012364-140012399
  hyper
cggctctaggttgagaccgccggcatggatctcca

SEQ ID NO: 29936 - DNA, 107 bp, Homo sapiens
  chr5:140174733-140174840
  hyper
gcctgttccgggtggcgtccaaaagacacggggaccttctggaggtaaatctgcagaatggcattttgtttgtgaattctcggatcgaccgggaggagctgtgcggg

SEQ ID NO: 29937 - DNA, 63 bp, Homo sapiens
  chr5:140187083-140187146
  hyper
ccacctggaggtgatcgtagacaggccgctgcaggttttccatgtggacgtggaggtgaggga

SEQ ID NO: 29938 - DNA, 32 bp, Homo sapiens
  chr5:140214378-140214410
  hyper
aaggaatctgttcatcgcggaatccaggccgc

SEQ ID NO: 29939 - DNA, 60 bp, Homo sapiens
  chr5:140248774-140248834
  hyper
ccagctccactactccgtctcggaggaggccaaacacggcaccttcgtgggccgcatcgc

SEQ ID NO: 29940 - DNA, 111 bp, Homo sapiens
  chr5:140261900-140262011
  hyper
ctggcttctgatcctcgcagcctgggagacgggtagtggccagctccactactccgtccccgaggaagcaaaacacggcaccttcgtgggccgcatcgctcaggacctggg

SEQ ID NO: 29941 - DNA, 367 bp, Homo sapiens
  chr5:140305805-140306172
  hyper
cctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcc

SEQ ID NO: 29942 - DNA, 176 bp, Homo sapiens; identical to SEQ ID NO: 8069
  chr5:140306444-140306620
  hyper

SEQ ID NO: 29943 - DNA, 113 bp, Homo sapiens
  chr5:140306674-140306787
  hyper
cggggtggatctacccagcggcaatttggtggtcagagagccggcggaccgcgaacagctgtgcagggccaaagctgcctgcgtcttgacctacgacctggtgctcgaggacc

SEQ ID NO: 29944 - DNA, 30 bp, Homo sapiens; identical to SEQ ID NO: 8071
  chr5:140345497-140345527
  hyper

SEQ ID NO: 29945 - DNA, 30 bp, Homo sapiens
  chr5:140345821-140345851
  hyper
taagcaggggagagacggtggagactggat

SEQ ID NO: 29946 - DNA, 40 bp, Homo sapiens
  chr5:140346709-140346749
  hyper
gcttggaagtgctggcgcacaaccccgtggcggtgagcgc

SEQ ID NO: 29947 - DNA, 199 bp, Homo sapiens
  chr5:140514751-140514950
  hyper
aatagtaaattaggacgcctggtggcgctgcaggctaagagtgtggatagtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttat

SEQ ID NO: 29948 - DNA, 182 bp, Homo sapiens
  chr5:140593316-140593498
  hyper
ctgctcactaaagtccggcgatattaacggtggtgttgtaaccttacatagtctcggggtgcatacaggcagagttgggaatattacatccattatcattccacaaaatgtaagatcctgtgaggacgcgtggtggcgctgcaggataagaaggcacaaaccagaaccgcagctgcagctcc

SEQ ID NO: 29949 - DNA, 75 bp, Homo sapiens
  chr5:140604438-140604513
  hyper
ctcctacaccctgttcgtccgcgagaacaacagccccgccctgcacatcggcagcgtcagcgccacagacagaga

SEQ ID NO: 29950 - DNA, 161 bp, Homo sapiens
  chr5:140613853-140614014
  hyper
agagtcgcatggtggcgctgcaggataagacggtgaaatttttgtaaccgcagatgctctggttttccttaaccatgggaactgaaagcgctggaataccaggagaaaatagtctttcaaaaggtagggcaccatcaacaccttcgcgacaggattaagag

SEQ ID NO: 29951 - DNA, 15 bp, Homo sapiens
  chr5:140614314-140614329
  hyper
cagagtcatctttga

SEQ ID NO: 29952 - DNA, 28 bp, Homo sapiens
  chr5:140614383-140614411
  hyper
cgagcagctggaccgggaggcactttgt

SEQ ID NO: 29953 - DNA, 120 bp, Homo sapiens
  chr5:140713985-140714105
  hyper
agttcaagaccagccggacagggcggcctgcgactgtagtcccagctacgcggggcggggaggggcggggcggggcggggcaggagctgacgtgggaggatcccttgagcccaggaagtc

SEQ ID NO: 29954 - DNA, 45 bp, Homo sapiens
  chr5:140767211-140767256
  hyper
aagtggagagcttggcgctccagatctcctcgcgcagccgcagcg

SEQ ID NO: 29955 - DNA, 197 bp, Homo sapiens; identical to SEQ ID NO: 8077
  chr5:140777472-140777669
  hyper

SEQ ID NO: 29956 - DNA, 85 bp, Homo sapiens
  chr5:140787848-140787933
  hyper
ccaccctgagtgagccgatccgctactcgattccggaggagctggccaagggctcggtggtggggaacctcgctaaggatctagg

SEQ ID NO: 29957 - DNA, 203 bp, Homo sapiens
  chr5:140797076-140797279
  hyper
ttttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcc

SEQ ID NO: 29958 - DNA, 305 bp, Homo sapiens
  chr5:140797327-140797632
  hyper
cgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgag

SEQ ID NO: 29959 - DNA, 507 bp, Homo sapiens
  chr5:140800458-140800965
  hyper
taagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccc

SEQ ID NO: 29960 - DNA, 228 bp, Homo sapiens; identical to SEQ ID NO: 487
  chr5:140801034-140801262
  hyper

SEQ ID NO: 29961 - DNA, 861 bp, Homo sapiens; identical to SEQ ID NO: 488
  chr5:140855598-140856459
  hyper

SEQ ID NO: 29962 - DNA, 87 bp, Homo sapiens; identical to SEQ ID NO: 489
  chr5:140856546-140856633
  hyper

SEQ ID NO: 29963 - DNA, 89 bp, Homo sapiens
  chr5:140864611-140864700
  hyper
cgccggccgaaccgcgccagagctggcgcggggaaagggagataggtgtctccagctgctgtggctgtttggggcgggtcggcttcatc

SEQ ID NO: 29964 - DNA, 38 bp, Homo sapiens
  chr5:141030807-141030845
  hyper
gggtctgaccccttccgacttcccgtctcctaccacaa

SEQ ID NO: 29965 - DNA, 425 bp, Homo sapiens
  chr5:141262718-141263143
  hyper
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtctgccgcggcgcgggggcagcctcaccccacctcactgctggactccggagaaccatttctgggaccgggagctgtccag

SEQ ID NO: 29966 - DNA, 288 bp, Homo sapiens
  chr5:141293747-141294035
  hyper
caaggctggagggaacgtgatgcaggcagtggagctgcgggctcggccccgggatcgtggggagagagagccccctgccgagcgcggaggggcgccctccctcccaggccccgggccaccgtctggggtcggttccctccagatttcacagccgcggcagcagcaggagcgcgcacacgcccgcgcccactgcactgcggcggtgctccgcagctcagcctcggggccatcacgtgggtgcggcctgaccccgggcgattctggggccgtctccgcaggcagttgagc

SEQ ID NO: 29967 - DNA, 25 bp, Homo sapiens
  chr5:141931330-141931355
  hyper
ctcacttctccttctcgcccttaat

SEQ ID NO: 29968 - DNA, 79 bp, Homo sapiens
  chr5:141931424-141931503
  hyper
cgccggcgccccgggtgggctcccggagcgcgcgggcctgtgacccggaggtcagagatgcctccgtcctgtttgatgt

SEQ ID NO: 29969 - DNA, 155 bp, Homo sapiens
  chr5:142781720-142781875
  hyper
cccgtttatctgaggcgataacgatctctaaacacgaggtatcgaatggagcccaatgaatttccatgccgcttttttgacagctgccttcaaacccgaaaccaaaacaatatttcctaaaacgaaaacgctccctcaagcgacattatccccca

SEQ ID NO: 29970 - DNA, 434 bp, Homo sapiens
  chr5:142784781-142785215
  hyper
gggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcgtcccggaagccgcccgccgccatcttggtagggtacagtgtcgccagcccgtccccgcggccaccatcttggcaaaggttcgcgatcgcgggtagcctaagccgtccttccttggttctcaagggtaaacggttccctgtgcattgtctgatgtgaaaggaaagaagtaggctttcagcaagcctcttgtccggagacgatctacgggggccgcctccagaggattctggagccgccatcttggcaaa

SEQ ID NO: 29971 - DNA, 287 bp, Homo sapiens
  chr5:143584834-143585121
  hyper
tgtcaccgaggaggacgtgactcggagctgcctccgctttctccaagccatattcctttaagatgatgtaatagtcatttccctggatggtttcttgcctgcactgctgaaacaacagcatccgaactgcactgggaactgtggaaccacccagctccgccgccagagaagccggagccccgggccccccgccggcatctctgcgctgcgttggcctctggctcgcaccggctcccacctggctgggaacatgggagtccgtttgcccttgccggcaggtggggtgg

SEQ ID NO: 29972 - DNA, 182 bp, Homo sapiens
  chr5:145214963-145215145
  hyper
ggccactcggagaaacgcgcagtcggccacgcccacgcccctactgccagagtccggggcctggggttacagagcgcgggaggcgctggagcgctcccagagcacccggggccccgcggtctccacgctggcggcgccagagcggccctggtgccctcccgcggccgcgcctgccgagaaaa

SEQ ID NO: 29973 - DNA, 50 bp, Homo sapiens
  chr5:145316176-145316226
  hyper
aagccggttggagggcgcagcgcacccctgctgcgcggaggagggggctg

SEQ ID NO: 29974 - DNA, 255 bp, Homo sapiens
  chr5:145713641-145713896
  hyper
cgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgag

SEQ ID NO: 29975 - DNA, 218 bp, Homo sapiens
  chr5:145716979-145717197
  hyper
cagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagat

SEQ ID NO: 29976 - DNA, 172 bp, Homo sapiens
  chr5:145717248-145717420
  hyper
cggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagt

SEQ ID NO: 29977 - DNA, 265 bp, Homo sapiens
  chr5:145717780-145718045
  hyper
acaagcttccttagacgggagggttggaggaagagtgggccaagttacatccctcaaatgaaagaaagaaaggcaagcgtggggaggaagccaccccggactgagaaggcagttactgcccctacctctaccccggagcgcggttgagggaggtggggcaggggtcacctgggcctcgttctggcagcccctcaccctctccagggcccgtctgggcgcttggaggcgcctcctcgctgcgccgcgggaccggactctggtggac

SEQ ID NO: 29978 - DNA, 36 bp, Homo sapiens
  chr5:145718465-145718501
  hyper
cccggcgcgtgagcacgcctgcgcgcgcccgggccc

SEQ ID NO: 29979 - DNA, 144 bp, Homo sapiens
  chr5:145718802-145718946
  hyper
gtggagcataattaccgctctaaggcacattttttgacaggcactagcttcatgtttttttcatgtcgcccagaacaatcgccgctgtctgaacccctctccttgtctcccccgcgttctctcccggcgcgctctctctctcat

SEQ ID NO: 29980 - DNA, 477 bp, Homo sapiens
  chr5:145719156-145719633
  hyper
gcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatc

SEQ ID NO: 29981 - DNA, 51 bp, Homo sapiens
  chr5:145719886-145719937
  hyper
ttcatctgagaagatcgcggccatcgctgagaaactggaccttaaaaagaa

SEQ ID NO: 29982 - DNA, 280 bp, Homo sapiens; identical to SEQ ID NO: 2659
  chr5:145720018-145720298
  hyper

SEQ ID NO: 29983 - DNA, 30 bp, Homo sapiens
  chr5:145720837-145720867
  hyper
tctctgaccccagctcgctgctcttgccag

SEQ ID NO: 29984 - DNA, 161 bp, Homo sapiens
  chr5:145722306-145722467
  hyper
cacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaac

SEQ ID NO: 29985 - DNA, 467 bp, Homo sapiens; identical to SEQ ID NO: 491
  chr5:145722560-145723027
  hyper

SEQ ID NO: 29986 - DNA, 169 bp, Homo sapiens
  chr5:145723301-145723470
  hyper
catggaaacctgcatcgggcctccggagggtgggactttgagaactacctggctggaacaggggcttcatctagaatgagctaggcatacacattccagcatgactaaagccctggtaggcagaacttggtggcaggagtcctgggctcctgaacggtgttatctctgg

SEQ ID NO: 29987 - DNA, 228 bp, Homo sapiens
  chr5:145724336-145724564
  hyper
gctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttcgaaggctccagacttcgcgctgctcctcctcccgaggaggggcggggcgccagagggcaaag

SEQ ID NO: 29988 - DNA, 45 bp, Homo sapiens
  chr5:145724793-145724838
  hyper
gctcttctccaatcacgttatcacaccgcccgttttatttctttc

SEQ ID NO: 29989 - DNA, 234 bp, Homo sapiens
  chr5:145725693-145725927
  hyper
cgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgc

SEQ ID NO: 29990 - DNA, 30 bp, Homo sapiens
  chr5:146256927-146256957
  hyper
ttttaaaggccccaccgatcgcgttgctca

SEQ ID NO: 29991 - DNA, 35 bp, Homo sapiens
  chr5:146257159-146257194
  hyper
tgagagacataacatcgtttcgctcagggaggggg

SEQ ID NO: 29992 - DNA, 36 bp, Homo sapiens
  chr5:146257448-146257484
  hyper
cccagccctagggcccggaggagtctccgccactac

SEQ ID NO: 29993 - DNA, 915 bp, Homo sapiens
  chr5:146257485-146258400
  hyper
cgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagc

SEQ ID NO: 29994 - DNA, 35 bp, Homo sapiens
  chr5:146614297-146614332
  hyper
cggacccggcccaagcgcggcgggacctccatccg

SEQ ID NO: 29995 - DNA, 35 bp, Homo sapiens
  chr5:146614703-146614738
  hyper
cctggatgaaagcatcgctccgagcctcatgggag

SEQ ID NO: 29996 - DNA, 36 bp, Homo sapiens
  chr5:146832654-146832690
  hyper
gagctgggagaggggcgcggtcgggctgccaagtac

SEQ ID NO: 29997 - DNA, 362 bp, Homo sapiens
  chr5:146888821-146889183
  hyper
ccttccgcgcttgcacgaagatgctgcaagtggcgacacgcgcgaatccagggtctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcc

SEQ ID NO: 29998 - DNA, 207 bp, Homo sapiens; identical to SEQ ID NO: 8108
  chr5:146889331-146889538
  hyper

SEQ ID NO: 29999 - DNA, 275 bp, Homo sapiens
  chr5:146889539-146889814
  hyper
ccagaggcggcagtgctgctccgattcctgcttgtccctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcc

SEQ ID NO: 30000 - DNA, 38 bp, Homo sapiens
  chr5:148033734-148033772
  hyper
ctgcgccctccctgccgccccctcgggtgcgggctcca

SEQ ID NO: 30001 - DNA, 160 bp, Homo sapiens; identical to SEQ ID NO: 8110
  chr5:148206272-148206432
  hyper

SEQ ID NO: 30002 - DNA, 272 bp, Homo sapiens
  chr5:148521059-148521331
  hyper
cctgcgctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgggttccggggcgggtcgctgctccttgaagccgggcggggacgcgctgcccccgccctgcctccctgtggtccacaccccctttgggctccggagccgctgggcaggaata

SEQ ID NO: 30003 - DNA, 184 bp, Homo sapiens
  chr5:148651223-148651407
  hyper
aagcccaagtgggagcgccgcggagggcgagcgagcggcagggcgcggcggggcgtgtgcggcaccacgggacagcgggctgcggcccagggggcgaggcgtgctcgggtctattccgggagcggctctgaggggcgggcgcgggcgcgggcggggcgggggctgccggcgagcatcctgtctg

SEQ ID NO: 30004 - DNA, 484 bp, Homo sapiens
  chr5:148651703-148652187
  hyper
ggtgccttcggctgccgggacaacccggtgcgtgtcaacgcccgtgtcctggggccaactcgcctctcgtgtgtgaaatcagagttttcataggctaacgatttgtaacttcataaaagatccccctctagtttccggaggacagcgagctcctcccacctcattccactctaaaggggaaaacaaggtgtacaggttcaactcccgaaacacccgctgtgggcagcccctagggagaagctctaggggaccgaagtttgcagctgcctagggcattgcgagaaggaggagcgccgtgagcaggcgcgcgtgtgcatgcatgtgtgcgccagggagggaggaggcgggggtggttctatcccgcaccagctgtgtcctcggcccagcccttctctctggaccagcgacaaagttggactagatggtctccaaggcaccttgccgacccttttccagtgtatttggtagacgtttcacagaagtg

SEQ ID NO: 30005 - DNA, 22 bp, Homo sapiens
  chr5:149546581-149546603
  hyper
actctcacgtggagccggcccc

SEQ ID NO: 30006 - DNA, 363 bp, Homo sapiens
  chr5:149569485-149569848
  hyper
ccagagagggcaggtcgcttgcccaaggtcacgcagaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctc

SEQ ID NO: 30007 - DNA, 135 bp, Homo sapiens
  chr5:149682031-149682166
  hyper
tgcgagggagttcagcgccccccggggacggtccagtgtctggtccgggactggctgccggacggctgggccggatctgctcggccgcagcggggcgctctggggaggtcaggcccgcgccgagctgcctcccgc

SEQ ID NO: 30008 - DNA, 734 bp, Homo sapiens
  chr5:150051058-150051792
  hyper
attcttgcctccccccgacctttttttttggtggagggagaaccctggtcccctgccccgctgagcttctctgcggtttattctaccccctcgttcccagatgctggccggaagcgccaggaggaaggtgactggaacagcggagtcggggacggtgagcgtggaggggagctccctggaagggaagctgggggaaggggagcgcggctgggggcgggaggtcgtcggtggcctctgagaacccgcccctgtgcccaggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggtgagtggcctcctcgggtcccgggaccagggctggggggcctgaagcatgggtgtgctccccatggggcaggaagagcacccagaaggctagtccgcccccttccccaacacacacgcgcacgcgcgcactcccctcgccagaccacgagccggaggggcgccgcgccccaggtcacacagcgagtcagccaaggccaagaccaacccgcgctgcgaactcgtggcttcctcactgcagtcctccgtgtttcctgggatggggaggggtctcctgtgctggagcaactgtggcttcccattcccgccgtcctctcccctaa

SEQ ID NO: 30009 - DNA, 30 bp, Homo sapiens
  chr5:150052081-150052111
  hyper
gcccgggggacagaccgggaggggcgggaa

SEQ ID NO: 30010 - DNA, 487 bp, Homo sapiens
  chr5:150399922-150400409
  hyper
aaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaat

SEQ ID NO: 30011 - DNA, 200 bp, Homo sapiens
  chr5:151066300-151066500
  hyper
agccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggcaggcggcaggcagagcgcgctctccgggcagtctgaaggaccgcgggaatgtggaggg

SEQ ID NO: 30012 - DNA, 415 bp, Homo sapiens; identical to SEQ ID NO: 8117
  chr5:151304224-151304639
  hyper

SEQ ID NO: 30013 - DNA, 33 bp, Homo sapiens; identical to SEQ ID NO: 8118
  chr5:151304708-151304741
  hyper

SEQ ID NO: 30014 - DNA, 126 bp, Homo sapiens
  chr5:152870193-152870319
  hyper
cagctagcatgaggacgggcttcttttcccgtgctcagttaatctggctgtcagttggtgttaacgctgcagtttaagtgttcggattccaagggaaacagacaaacctcacgaaaggaaggaagc

SEQ ID NO: 30015 - DNA, 879 bp, Homo sapiens
  chr5:153852425-153853304
  hyper
gcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgccagacttggctttggcggccgctggcgggtctccctcagcaccccctcttctttccccggctataagaaagctagaccagggtgcgcattcttcccgtgcctaggatacttcacggtgctaaaaatagtcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgcta

SEQ ID NO: 30016 - DNA, 133 bp, Homo sapiens; identical to SEQ ID NO: 2667
  chr5:153853386-153853519
  hyper

SEQ ID NO: 30017 - DNA, 232 bp, Homo sapiens
  chr5:153855179-153855411
  hyper
aggacattgcacgtgcgatccaagtgtgtggttgcagccgacgacctgccggcgctcagcagaagctccgcgggatgcgtagcaccagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtg

SEQ ID NO: 30018 - DNA, 270 bp, Homo sapiens
  chr5:153855657-153855927
  hyper
cgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcaccccacacacttccgccagcctcccaacctggtttaaacatcagggcttggatgcaggcttggggccccctaagccggagctgggagcctcagata

SEQ ID NO: 30019 - DNA, 512 bp, Homo sapiens
  chr5:153856148-153856660
  hyper
cgtccctggatgagctttcgtcagtttaccacaggcccccgcaggttggataaaccaggtggggcgcttcagctggctccactccgctacggccttaagccccccaacctagagaaactgattggccagcctgaaaacccagcgctcagaagcccccagccccggacagccagaccgagtgccaggaagtgtcaccctaaccggagaggatcaagaaggccaagacgagactgcgctctccaaagctaaaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattc

SEQ ID NO: 30020 - DNA, 336 bp, Homo sapiens
  chr5:153856862-153857198
  hyper
ctccatgcacaggatcgcacgctgtgaccaaccatctcagaactcttcccaacctttccaaatcggacacaggacaacacagcctccttcgactacctgcatggcctgaggctgctcaccgctcctgcacccttggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggca

SEQ ID NO: 30021 - DNA, 597 bp, Homo sapiens
  chr5:153857284-153857881
  hyper
cgccggccaagacggccgccaagcgcctccagccgcccggggctctgcccaggcctggcgtcaggaccataggcggtggcggctgcagcggccgcgggcggcggcccgcccgcagggaagtccggggcagcgtcagccgggctcagcagccagctctggaagtagggcctttcctgatgacagcgcgaggccggaccgaagaggaagggttcgtggagcatggggtgcgcagggtgcgggtggtgatggtggtgatggtgtgcgtagctgcccacgaggttcatgttggagcggctactggcctgcgccgccagccctattaacgccgctccatgcgccccagagactgccgggggccacctgtgggctctggagccactactgggcgccggctttgggagagtccgggcaaggctgaaaatgagacgcgcagcccactgtcttcttaccggtttctgccgcgggcgaggtcgccgaagcccaaagacctgtttaacccttctgcggactcccctgcggatctggcttatataagaccgcggctttgatgtcaacctctcccgggagccaatggcaggggggcggggataaggaaaa

SEQ ID NO: 30022 - DNA, 576 bp, Homo sapiens
  chr5:153858319-153858895
  hyper
gaagacaggataggccgctaacgttcttccctaacaccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtaggggtggggcgggaaggaggaggcggactccaggcccacgggcatcgacgggtttgttcccggcttgagggtctgagatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccg

SEQ ID NO: 30023 - DNA, 22 bp, Homo sapiens
  chr5:153858916-153858938
  hyper
cgacgtccggcatctctcacgc

SEQ ID NO: 30024 - DNA, 328 bp, Homo sapiens
  chr5:153859386-153859714
  hyper
tgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgctggggtagggcagagcgcggagccggaggcacgcgggg

SEQ ID NO: 30025 - DNA, 143 bp, Homo sapiens; identical to SEQ ID NO: 8132
  chr5:153862037-153862180
  hyper

SEQ ID NO: 30026 - DNA, 246 bp, Homo sapiens; identical to SEQ ID NO: 8133
  chr5:153862218-153862464
  hyper

SEQ ID NO: 30027 - DNA, 44 bp, Homo sapiens
  chr5:153863373-153863417
  hyper
cctctgtgtattttccgcacagagagatgtctgcttcgggacgc

SEQ ID NO: 30028 - DNA, 33 bp, Homo sapiens
  chr5:153863418-153863451
  hyper
ttcaacctaaacagaacccggtctgattggaaa

SEQ ID NO: 30029 - DNA, 30 bp, Homo sapiens
  chr5:153863972-153864002
  hyper
ctcggctcattgtcacgaaggtcattctca

SEQ ID NO: 30030 - DNA, 304 bp, Homo sapiens
  chr5:153990970-153991274
  hyper
gacgggccacacacccgcgtgtacacacagtccgagaacgcacacacgtacacacacacatgcgcaaggcacggcctggccttcaggcacagagagcccatccggtttcccactcagctcccacaacttcccccacactttggtactaagggctcagctgggtccttttgaagccaccaagggagggagttgggaagggccccagtgacaaacagtggggagcaagaattttacgaacttaagggctgtaaatttcggccagcaaatccccgcccctgtccgtccgccccgccttccttctcac

SEQ ID NO: 30031 - DNA, 491 bp, Homo sapiens
  chr5:155107388-155107879
  hyper
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcacaccgggactccggcacgtgggcgcgcgggaggtggcggccgctgctgccgctgctgccgctgccggagcccgaacccaagcccca

SEQ ID NO: 30032 - DNA, 96 bp, Homo sapiens
  chr5:155108172-155108268
  hyper
gaggctttccgcagccgcttggccggcgccggcccctattccgttggcaagtcccttgtctatcccggagggcgcacccggacgctcgagccggag

SEQ ID NO: 30033 - DNA, 494 bp, Homo sapiens
  chr5:155108355-155108849
  hyper
cgatgcgcccccacccgggcggcgcgccctctgccaactcgccacccatgggatcgactgccctcagctgcccggcttggagtgcgtagccttcgccgcgtggcccaggagaggagcgagacaccaaggcgtttcgcggactccgcgcgcaccagtcggcttggtggccctgcgggatagcgtttatacccaggggtgagtaggccgctaatggaggccccctttacccccagctagcggcttgcatggacggcaaagagacgggagaaagttgggtctccttgcgcttaatctggcattggcagaggaatgcaacactgtttcctccaactcgattgccgcgggggtttccccagttccctccatctctaagccaaggagggagtccccttccgcttcctaaggagaaaaggggctccctagagcagatcgctgacttcctcaccaacgtgccatttggggcttttcagccgcccgcgcgttaagctagctcc

SEQ ID NO: 30034 - DNA, 255 bp, Homo sapiens
  chr5:155109192-155109447
  hyper
catcctgtggctaggcgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtc

SEQ ID NO: 30035 - DNA, 455 bp, Homo sapiens
  chr5:156887049-156887504
  hyper
ctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggtgcgtacggcagggctggggaccaggcgggctccgcgcttcgcgccctcccctccttgccaccgctctccctcgcatcctctcctcccaggggggccaaagctggggaggggcagggccagcacgaggtggctcccac

SEQ ID NO: 30036 - DNA, 45 bp, Homo sapiens; identical to SEQ ID NO: 8142
  chr5:157001813-157001858
  hyper

SEQ ID NO: 30037 - DNA, 30 bp, Homo sapiens
  chr5:157002174-157002204
  hyper
cgctcccaggccacacgggcagggcgctcg

SEQ ID NO: 30038 - DNA, 332 bp, Homo sapiens
  chr5:157002447-157002779
  hyper
cgtgggaacaaagcccgggctcccaggctggggacggcgggggcgcaggccccgcggagttgcgggaggcgcaggggtcgcggtcccagcgctccggacccgcaaggctactcccaggtctccgggccacccagcctccatccccccgcgcctggccacttacttgtccatccaggctcccgcgccgcccgcggccggaggggctgcagggcaaacgccagcaagcagagccgggcggcgcctgcgccccctggcatggtggcggcggcccttagcgctcggcgctcacacgccctcagccatacctgcccactgcccggcggtggaggcgc

SEQ ID NO: 30039 - DNA, 439 bp, Homo sapiens
  chr5:157098271-157098710
  hyper
gccccgccagcaggccggggtcactgcagtccccacgtcgaagcggaaaaggtctgctcagctcaccgcaccccacttcttccagacccgtccgtcttcacagcaacgcgccgggtctcaccacggcggatgccgagggacaatattaccgcgtccgtggccgccggactctgcacgcatgtccaacagcccccgtccccttccccgcagccaatatgtgtctcccaggcaacgcgccgcgctcggttcagggctccgcccagggactcactccgcgtcagcgcgcgcccacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttcca

SEQ ID NO: 30040 - DNA, 25 bp, Homo sapiens
  chr5:158478441-158478466
  hyper
cccacccccccaccccgccgcccgg

SEQ ID NO: 30041 - DNA, 303 bp, Homo sapiens
  chr5:158478512-158478815
  hyper
cgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtgcacaatcacaatcgcagccagcagttt

SEQ ID NO: 30042 - DNA, 36 bp, Homo sapiens
  chr5:158524686-158524722
  hyper
atgtggagaagggtccgagggcggggctcagaactg

SEQ ID NO: 30043 - DNA, 289 bp, Homo sapiens
  chr5:158526129-158526418
  hyper
aaagcgtgggctcctcgcagacagctccaggtcctccggccgcaggcgacgaaggcagagcggctggagagcgcggagccccggcggagagcggagcgcagcggctgcggactcaccccgccgcccggccccgcggcagcagctgccgctgccgctgccgcctccgcctcccggctctcccgctcgcggctcacctcggccgcggtccccgcgcagtacccacctctgcgccgccgtgttggcgtccagcaccccggcgccctgcatccacgtccgcaccgcgttcatg

SEQ ID NO: 30044 - DNA, 406 bp, Homo sapiens
  chr5:158527411-158527817
  hyper
ataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagccc

SEQ ID NO: 30045 - DNA, 296 bp, Homo sapiens
  chr5:158527818-158528114
  hyper
ggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcg

SEQ ID NO: 30046 - DNA, 155 bp, Homo sapiens
  chr5:158533542-158533697
  hyper
ggtctaggcagggtgcggaccgagggcccaagggcaggcgtgcagaccgctacgactttggctttagggagacgccttcggggcgcagggcccgcccgaagacgcgggttagcatacagctcagctccaggcaggcgatgcgggttcccaatgcg

SEQ ID NO: 30047 - DNA, 96 bp, Homo sapiens
  chr5:159200128-159200224
  hyper
agcctgaatggctaacggtagagcaggtgactgaatgaggggtggacggacgcccagatgcctgcttcctggcttttctcccgctctgtcttcaca

SEQ ID NO: 30048 - DNA, 145 bp, Homo sapiens
  chr5:159343442-159343587
  hyper
gcggagtcagggcgccgggctcccccgcctgatgtcaccgccgtgcagtcagcccagaagcggctcattgaaagcagaccctcttcggcgctcgctgggcggaggacgcgccgcggtccgcagacccgagcgagctgggcaccgc

SEQ ID NO: 30049 - DNA, 28 bp, Homo sapiens
  chr5:159399072-159399100
  hyper
tcgcctgggcggctgcgcctacacctac

SEQ ID NO: 30050 - DNA, 188 bp, Homo sapiens
  chr5:159399509-159399697
  hyper
cgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccg

SEQ ID NO: 30051 - DNA, 86 bp, Homo sapiens
  chr5:159615222-159615308
  hyper
ccaggaatgccctcccggcctctcctcccgattccttatcagctacaagctcgagtttcctcagccacacgcgatcaaatgctgct

SEQ ID NO: 30052 - DNA, 30 bp, Homo sapiens
  chr5:159738710-159738740
  hyper
tccgctcagacactccgggagaaggtaaag

SEQ ID NO: 30053 - DNA, 30 bp, Homo sapiens
  chr5:159739156-159739186
  hyper
tcgccggacacggggcgatatggagctgtg

SEQ ID NO: 30054 - DNA, 61 bp, Homo sapiens
  chr5:159739813-159739874
  hyper
ccgcggcgccacctgcgcgcaccacgcgtgaaacgtgcggacaggacgcccccagaaagtt

SEQ ID NO: 30055 - DNA, 336 bp, Homo sapiens
  chr5:160973454-160973790
  hyper
aggaagcaggcatagcgttttcagcatcggatccctactacatttccctgctcacagaggtatgcagacagaacccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggacc

SEQ ID NO: 30056 - DNA, 249 bp, Homo sapiens
  chr5:160974612-160974861
  hyper
tgtctctccaggtttcggtctgattctgcagtgggaattattagtgggcagggtggggtttgcatgagggggagatgggacgtggaggcgtgagggatgcgggtgacgggcgccctagcgcaggtgcgggggactggagggcgtgggcgaccgcacagagcaggaagggcaggtggccgggtgggacgcgccccggccggtcccccagcgccccctccgctgcgcgcacccgcgcgcacacacgtgcag

SEQ ID NO: 30057 - DNA, 257 bp, Homo sapiens
  chr5:160975090-160975347
  hyper
gtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggcc

SEQ ID NO: 30058 - DNA, 100 bp, Homo sapiens; identical to SEQ ID NO: 8154
  chr5:160975348-160975448
  hyper

SEQ ID NO: 30059 - DNA, 210 bp, Homo sapiens; identical to SEQ ID NO: 2672
  chr5:160975724-160975934
  hyper

SEQ ID NO: 30060 - DNA, 15 bp, Homo sapiens
  chr5:160975955-160975970
  hyper
cggaagtagctccac

SEQ ID NO: 30061 - DNA, 30 bp, Homo sapiens; identical to SEQ ID NO: 8157
  chr5:161274605-161274635
  hyper

SEQ ID NO: 30062 - DNA, 110 bp, Homo sapiens
  chr5:161275376-161275486
  hyper
tcccagacttttccccggtcttaagagatcctgtgtccagagggggccttaggtaagtgcgactttggaccacgatacacagacagagctttgaacgtggcttttcctag

SEQ ID NO: 30063 - DNA, 55 bp, Homo sapiens
  chr5:161275816-161275871
  hyper
gttggggaggggcgtcgggggccatcatctaaagttaagacgctgggacggaaaa

SEQ ID NO: 30064 - DNA, 30 bp, Homo sapiens
  chr5:161495166-161495196
  hyper
tggggaggggtaactcgggagaccacccag

SEQ ID NO: 30065 - DNA, 69 bp, Homo sapiens
  chr5:162931214-162931283
  hyper
ccccggccctcttcccgccctcttctttgttgtcccctgattatgcttgtttagcgctggggcagtcct

SEQ ID NO: 30066 - DNA, 191 bp, Homo sapiens
  chr5:162931522-162931713
  hyper
aaaaggtttaggagtcggggaaaggccctaggaaaatccagacagtggtcacgtttgtggacgacgtttagagcttgctatcctgggcacacaagaacccttggactgttcggtgcaaagttggcaaatcctacacggcctgtgccagggtttactttctgcatcaatttcacaggcgtccagcctggctg

SEQ ID NO: 30067 - DNA, 100 bp, Homo sapiens
  chr5:166405747-166405847
  hyper
tgcacgtgtccctagcgcccctctttctcagccgtgagcccctccctggctgcgtaccccgcagccacagcagctgcagccccagcgccaccacccaacc

SEQ ID NO: 30068 - DNA, 42 bp, Homo sapiens
  chr5:166406152-166406194
  hyper
cgtcctcctcctaatcgtttccgaagtagcagcagcagcacc

SEQ ID NO: 30069 - DNA, 222 bp, Homo sapiens
  chr5:166406254-166406476
  hyper
atcgagctcagcggcacagcaggcagaactgtgcagaagcgagcaccgtttggggagtccggggggcgggtaagagggaggagggggaaagcctgtcttggtctttgggattattttttttccccttctttccctctctctctctttcttgagggtgtgtgttgccccctcgaagtgaaggaattttgctccaaagcgagctgggaccgaagactctaggct

SEQ ID NO: 30070 - DNA, 50 bp, Homo sapiens
  chr5:167001021-167001071
  hyper
gctgaggcaggtaagcgccgatcggagggtttgaccgagtggcttagtta

SEQ ID NO: 30071 - DNA, 177 bp, Homo sapiens; identical to SEQ ID NO: 2674
  chr5:167956090-167956267
  hyper

SEQ ID NO: 30072 - DNA, 65 bp, Homo sapiens
  chr5:167956413-167956478
  hyper
cggacaaccgccgggacgaccacccagagccaccagagccccctgacacccgccccgaggcaccg

SEQ ID NO: 30073 - DNA, 129 bp, Homo sapiens
  chr5:167956694-167956823
  hyper
gggccgggggcgcggcggcggcgacggcaaggatcgcggcggcggtggacagcggcggggcggcgtggccaagagcaagagccgccgcaggaagggcgccatggtggtgtcggtggagccgcaccggca

SEQ ID NO: 30074 - DNA, 136 bp, Homo sapiens
  chr5:167956844-167956980
  hyper
cggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggcc

SEQ ID NO: 30075 - DNA, 452 bp, Homo sapiens
  chr5:168727476-168727928
  hyper
caggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggc

SEQ ID NO: 30076 - DNA, 82 bp, Homo sapiens; identical to SEQ ID NO: 8166
  chr5:168727994-168728076
  hyper

SEQ ID NO: 30077 - DNA, 276 bp, Homo sapiens
  chr5:168728077-168728353
  hyper
cggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgactaagttgggaactttgctggagcgaccgagagcctggagggaggaggcagtagaggagggagagagaaggaaccagggaaggaaaggggctcggccagcagggccc

SEQ ID NO: 30078 - DNA, 30 bp, Homo sapiens
  chr5:168728570-168728600
  hyper
tgtcgcccacgaagccgcttccctaccgca

SEQ ID NO: 30079 - DNA, 508 bp, Homo sapiens
  chr5:169064022-169064530
  hyper
gcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagcc

SEQ ID NO: 30080 - DNA, 274 bp, Homo sapiens; identical to SEQ ID NO: 2677
  chr5:169064531-169064805
  hyper

SEQ ID NO: 30081 - DNA, 30 bp, Homo sapiens
  chr5:169930863-169930893
  hyper
tgctcccggggctcccgcacataccccggc

SEQ ID NO: 30082 - DNA, 104 bp, Homo sapiens
  chr5:169931223-169931327
  hyper
cggcagcctcggccgggcggccgctctggccccgtgtccagtgccaggcaggcttcagggcaccgtcctcggccctgggcgagggaaccgccgggccgggtcct

SEQ ID NO: 30083 - DNA, 131 bp, Homo sapiens
  chr5:169931353-169931484
  hyper
cgcggggagcggctagccctgagtccctgcatgtgcggggctgaagaaggaagccagaagcctcctagcctcgcctccacgcttgctgaataccaagctgcaggcgagctgccgggcgcttttctctcctc

SEQ ID NO: 30084 - DNA, 483 bp, Homo sapiens
  chr5:170107959-170108442
  hyper
tggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccgagagatttgaaaaagccgggctgaaacagcgtggtattggtccccgcctccccagtcgcgccccagtgctgcgctgtccgtcgtgctgaaatgtggtgcgcctggggagtgcgggagccaggaagttagggtctcctgctccggccctatgagcat

SEQ ID NO: 30085 - DNA, 209 bp, Homo sapiens
  chr5:170735112-170735321
  hyper
aacgattttagaattcgctggaagaaaatgattccgcttgtctccccaaagctgcagcggaaggtgactacttcgtgtgcggtcctgtccacggtgccctgggccgggtagacagtcactgaggcgcgagcagaacggggagtggttccagcgcccaaagtggactggagccgggaagggctcaccagtcgcgtttcccaaagaaatcc

SEQ ID NO: 30086 - DNA, 21 bp, Homo sapiens
  chr5:170735730-170735751
  hyper
cggtagcgtccaaggggcttc

SEQ ID NO: 30087 - DNA, 48 bp, Homo sapiens
  chr5:170736116-170736164
  hyper
gcctttattgaaagccgggagccaatgagaggagagaggcttgttgat

SEQ ID NO: 30088 - DNA, 116 bp, Homo sapiens; identical to SEQ ID NO: 496
  chr5:170736715-170736831
  hyper

SEQ ID NO: 30089 - DNA, 417 bp, Homo sapiens
  chr5:170737281-170737698
  hyper
cgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcact

SEQ ID NO: 30090 - DNA, 106 bp, Homo sapiens
  chr5:170737758-170737864
  hyper
cgcacacacacgggcctctcgcactctccttctcctccttcttccagcccgccctctcggattttcaacaatcctcgtggacgccggtttcctctccccccatctc

SEQ ID NO: 30091 - DNA, 755 bp, Homo sapiens; identical to SEQ ID NO: 499
  chr5:170737935-170738690
  hyper

SEQ ID NO: 30092 - DNA, 1116 bp, Homo sapiens; identical to SEQ ID NO: 500
  chr5:170738823-170739939
  hyper

SEQ ID NO: 30093 - DNA, 23 bp, Homo sapiens
  chr5:170740455-170740478
  hyper
aaggcaaaacactttcggggccg

SEQ ID NO: 30094 - DNA, 99 bp, Homo sapiens; identical to SEQ ID NO: 2686
  chr5:170740574-170740673
  hyper

SEQ ID NO: 30095 - DNA, 331 bp, Homo sapiens
  chr5:170740674-170741005
  hyper
ctcccgccgtcacctccacctccaagcccagctagcctgggatctgcgcctttcaggacataaagacacccagggagggactagggtgactcagaacttcgggtctcttccgtgagtgttttcctgaaatgcttttattttctccaataaaaagcctgatgaacgccgtcatcgggttgggaaaggttggcccttcggctgaggactagagggacccttgactttgctggcggagaagcgctttcctcagagacgggtgtcgcggtccagctcccttccgttccgttttattctgttgctccataataaggcctagcggggttttttttct

SEQ ID NO: 30096 - DNA, 807 bp, Homo sapiens
  chr5:170741469-170742276
  hyper
gggattacaggcgtgagcccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcc

SEQ ID NO: 30097 - DNA, 214 bp, Homo sapiens
  chr5:170742386-170742600
  hyper
cgcccattttacagatgcagggcagggagacaagaggcatctccgggggccgagtagaatgatggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggc

SEQ ID NO: 30098 - DNA, 177 bp, Homo sapiens
  chr5:170742672-170742849
  hyper
cgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggc

SEQ ID NO: 30099 - DNA, 331 bp, Homo sapiens
  chr5:170743149-170743480
  hyper
tcaaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccac

SEQ ID NO: 30100 - DNA, 482 bp, Homo sapiens; identical to SEQ ID NO: 504
  chr5:170743646-170744128
  hyper

SEQ ID NO: 30101 - DNA, 66 bp, Homo sapiens; identical to SEQ ID NO: 8189
  chr5:170744496-170744562
  hyper

SEQ ID NO: 30102 - DNA, 116 bp, Homo sapiens
  chr5:170745303-170745419
  hyper
gttgagctcaggggccgatggtgattatccagcatgcgaagctgccttgcatttgcatccactgttcaggtgctacagctggggcacttttgttcctgggacgtagtgagactaag

SEQ ID NO: 30103 - DNA, 102 bp, Homo sapiens
  chr5:172386993-172387095
  hyper
cagaagtacaatgtccgctccatgcccatccgcaaggacgacgaggtccaggtacgtctccctccggcgctagtggcgctcggacaccgttgcctaagaacg

SEQ ID NO: 30104 - DNA, 736 bp, Homo sapiens
  chr5:172655825-172656561
  hyper
caaggctgttgcctgcggcgtagaagcgctgggcctgagctcggaatgcttcccggaggatgcgaggggcgggcgctgcggggaagacggtgctactcccgcgcgggaccgcgtgatgtttccgagtcagcggtgaaacctgcggcttccgcgcgtcctttaaaaatacaggtatttagatacacaccgtggcgtcgacttaaggtgaaatctaaacaaaatgaaaggacgggagctattctgatttggccgaacctgtgcctgcgggctgggaatgacccaaggaaacgaagggacggcggagccagtgcggcgggggccgggtgggaggcggtggcctcgtgctggggacccccagccccggctcgcctttgccgggaaccaccaagctaatttttttccctttcttttttaaataaacctaccttccttcccccattttttccttttaatatcgctgtttatctccattttttttaactgcggcgtgttcttgttcgattttaaaaaatactaaaaataaaatgagtcccctaggtgcctccctggcgccctaggcatggagagctcatgcctgcgccaccctcatctccgctggctttgccacctcggaggcgccccacacttctcctttgttttgcttttctctgagccggttgagttttcttaccctgaatgcgtcgtttatacaattagcaactgaacacagaacaaatatcaccgatataattggggt

SEQ ID NO: 30105 - DNA, 482 bp, Homo sapiens
  chr5:172659544-172660026
  hyper
cagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtcccctaggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagca

SEQ ID NO: 30106 - DNA, 113 bp, Homo sapiens
  chr5:172660141-172660254
  hyper
cgcccggggccgctccgcgttgtccgcctctgtcttctccagctccaccgccttctgcagcgcgcacagctctgagggggaacagagaggcagagagacgcttggtaagagcg

SEQ ID NO: 30107 - DNA, 133 bp, Homo sapiens
  chr5:172660868-172661001
  hyper
ctatgaattctctcccggctggcagcggcccttcgcccagcgcttcgcccagcgcctgcggcctcccgggaatcgcccgggctcctgccttgggctggggggtctcccagaaggcccctttctgcagcggggc

SEQ ID NO: 30108 - DNA, 20 bp, Homo sapiens
  chr5:172661126-172661146
  hyper
cgcgccggcaagttgtgctg

SEQ ID NO: 30109 - DNA, 856 bp, Homo sapiens
  chr5:172661471-172662327
  hyper
acccaggagcagagccgaagccgcccggggctttgttaggccggggggaaacgttttttggtctcttgcttctgatcctttcaatccggcatttcctctgaacctccgattggacgcggggcgcgggagcctggcgacaacaccaggcatcttacattctgaaccccccgccgcagcccagccctcggcccaagggcgcgtgtctcctcctcctggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaaaggcagacgcacacttggccggtgaaggcgcgcggcccagctctgcgcgcagctctgggaggcccggcgcagccgcctcgggcccagcgtaggcctctggcttgaaggcggccagcatgcaggaggagggcgccagggtcgcctccaggcgggcagagagctctccggcggcagccaggctgcgctgctgctgttccaggtttaggatgtctttgactgagaagggcgtgggcgtgagagcagggctggggaacatggtggcagcgccagtctcacagcgccaggtgggcggcagaaagcggcgctgcccacggcccctggcagcttccctgcatggtgccgccgcccgcccgcgcacccgtcggccagctctggatgtgtccgggcagcaggtagcgctgagcacaaggggcaggagaggcgggaccaggccagaggagggggactcagcctgccattgggccaggggcctcgatgacaggagcgatgagcagttt

SEQ ID NO: 30110 - DNA, 387 bp, Homo sapiens
  chr5:172664210-172664597
  hyper
caaattctccttggacggagctgcatgtcagcggccttgcggcccttcctcgcctggacttttggccacgttaccgttatggctgtaaattaacctagcttgggggcccgccttgcctttgaagattgttttcgagcgcgggcgggggggggtgtcgttggagaggatgcctatcgccgaggcggtgacgtctggcaaacgagccacatccgattcaattaaatgtctcgctgaaaagagctcggaacgagggtcctgggagcgctgttaagtgaatctgctggccaggcggctcgcgatgacagtttgaaagattagtgtgagcggacgcctgaaatattaccgtttaatgggggacatcgaggctacatccgggatccctgtttt

SEQ ID NO: 30111 - DNA, 417 bp, Homo sapiens
  chr5:172665448-172665865
  hyper
ggaatgtcattaatgcgctggggagacgtccattggagacaggcggcgttatccgcggctttatcttcaacaacgcctcgctctcggcccgcgcgggggaaacagatgggagtttctgtctgggacgctcgccccatgtttatattttgggaagaatcgcaactcgtgggagtccccggctggccccctgataaatgaacattagcactttttcggactactgtatcaacaaaggggctgcggcgctgcaataattggcgagaaagcaaacagagggccgagagcgcgactctgctcttcgtccggctgatggatgagcagctccggctgcgcgccggactcccggcctcggcctccgcctccgcctccgcctccgcctccgcgctgggcccctccgccgcccggcttccttcctgg

SEQ ID NO: 30112 - DNA, 277 bp, Homo sapiens
  chr5:172670821-172671098
  hyper
gtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggacaacgactcagatacagt

SEQ ID NO: 30113 - DNA, 137 bp, Homo sapiens
  chr5:172671345-172671482
  hyper
ctccgcggctctggccgaaaccccggctggccgcagctccgggagcccccagccctgtgctgctgcggccggctcagtgctgaattgatgctggaaacggctggccagcgggcctagggtcgccgcctttccctcct

SEQ ID NO: 30114 - DNA, 160 bp, Homo sapiens
  chr5:172671639-172671799
  hyper
cgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggattcagacac

SEQ ID NO: 30115 - DNA, 146 bp, Homo sapiens
  chr5:172672747-172672893
  hyper
gctgttgtccccaaacgccgcctgtcaaaggagacgccacccgcattaggacctagactggggcccttccgctcggggtcaggcgcagcgccctcggcttgggccccgccgcccctttaggggtccgggagggtggagagaagggg

SEQ ID NO: 30116 - DNA, 97 bp, Homo sapiens
  chr5:172672960-172673057
  hyper
cgctgaaaccggcccatctgggagaaatattagggcgcatgtctctcccggagggcttccttttttttttttttcctaaccacgaaaatagggaatc

SEQ ID NO: 30117 - DNA, 109 bp, Homo sapiens
  chr5:172710849-172710958
  hyper
gagcactctcagccacgcccccgccaccccagcggcgctgcaggaaccagcccgccgccagcgcgaaggtgagaccgggcgccacgtgcttacccggcggcctccggaa

SEQ ID NO: 30118 - DNA, 576 bp, Homo sapiens
  chr5:172754355-172754931
  hyper
tgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaaga

SEQ ID NO: 30119 - DNA, 62 bp, Homo sapiens
  chr5:172755316-172755378
  hyper
tttccctcctcctcgcggccgcggctcggatagaggttacccagcgccctcccgtagctctc

SEQ ID NO: 30120 - DNA, 143 bp, Homo sapiens
  chr5:172755420-172755563
  hyper
cggcaatggcagggatggtgcctcaaatatccctggaagctctggtgtcacttgaatgaaggagtcgagcaggtgttgtcccggcggctggaccaatccgagaccccggcccttttgacaacacggccgggaggcggggcctg

SEQ ID NO: 30121 - DNA, 69 bp, Homo sapiens; identical to SEQ ID NO: 8207
  chr5:172755594-172755663
  hyper

SEQ ID NO: 30122 - DNA, 845 bp, Homo sapiens
  chr5:172756377-172757222
  hyper
caaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccaggatggccacggctggccgcagctatccggcgtgtcgagctctcctgagtcggaaggaaggagaggagggggtggggagggcgtcttcagagtgggcttcccctgcgctggagcgccagggagcatccataaattgtcactttgaaggtccgaacctgcggcggtagggaccatgc

SEQ ID NO: 30123 - DNA, 400 bp, Homo sapiens
  chr5:173738828-173739228
  hyper
actttcaccgcagagcgggggctgctggaggggcgggtgggctgcggcccggcggcggcggatgcctgtctctgccgaagccgaaggaaggctgcgtgggcagatcttccagctaggcccagagggacggccgacattcaacccgccagtcaaaggagggaagggctggcggcaggagcagctcaggaggcagacccgggcgcgcgggggcgcgggggctcgggggcctgtgagggatccccggacgggcagctgcggggtgcgggccgggctgcaccgcgacaaaggcggcccagcggcggcatcggaggacgcacgctgccccctggtggccaggccgctccccgcaaacgcgagctcctttgttttgcggtcccggcttctgcggcccaggcttgct

SEQ ID NO: 30124 - DNA, 201 bp, Homo sapiens
  chr5:174115388-174115589
  hyper
aaatgtgatcactctcggcaccgtagtctctgatgagaacatttaatcaattagcattgccgttgccaaaacttgcttcccaccgagcccaaaagccgccggcggcacatcccagcggcctccctcctcccgggctgggattcgcctctgcaagaaacgtcatgttttctctcccagacatcgttccgggagccccagatg

SEQ ID NO: 30125 - DNA, 55 bp, Homo sapiens; identical to SEQ ID NO: 8210
  chr5:174119987-174120042
  hyper

SEQ ID NO: 30126 - DNA, 176 bp, Homo sapiens
  chr5:174147420-174147596
  hyper
cctctcccctctctgcgcctggacgacttcatctgtggaatggggagaaagctcaggctttagggggccttcagtaatctgcatcgtgcttttggcaaaagctccttctctccagccccggctcaaacccgggctcggtcctgactccggaccttagggggcgggaacaggagaac

SEQ ID NO: 30127 - DNA, 37 bp, Homo sapiens
  chr5:174150431-174150468
  hyper
gaggcctctaatcctcgaagctcgctctccccttccc

SEQ ID NO: 30128 - DNA, 72 bp, Homo sapiens
  chr5:174151125-174151197
  hyper
gtaagccaattttgacgcatagtaggggcttcgtaaatgtttctgcaatgctgtttgcgaatcttgaactta

SEQ ID NO: 30129 - DNA, 306 bp, Homo sapiens
  chr5:174151463-174151769
  hyper
agagccaatcaggggcgagcgtctctggcgtcagcgccaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcgga

SEQ ID NO: 30130 - DNA, 294 bp, Homo sapiens
  chr5:174159299-174159593
  hyper
ggagaaaagggctgcatcttgcgtggctggcgggttagactggaatccgtctggggaactgcgcaccatccccatcgctccagacgccgaaacaaaacctgaggctcggagaggggaaaaagagttgttcaggctcgaacatacgcatcccagcctcataggtggatggggttaccgagctgagaaccaagccggaggtccgcgaagccgggccgcccccttgctctgggcctcccttcaagcctgcagtctggggatgggttccgagtcaccgcggtccgggcctcggtcagg

SEQ ID NO: 30131 - DNA, 30 bp, Homo sapiens
  chr5:174162217-174162247
  hyper
cctctcttcccccaccgccttctttgcctg

SEQ ID NO: 30132 - DNA, 37 bp, Homo sapiens; identical to SEQ ID NO: 8213
  chr5:174162509-174162546
  hyper

SEQ ID NO: 30133 - DNA, 86 bp, Homo sapiens
  chr5:174162770-174162856
  hyper
tgccatcaataaatacgcactgacaccggcccggcccgctccaccggcacggaagatcgcagccgaccaggcgccctcctccctgc

SEQ ID NO: 30134 - DNA, 41 bp, Homo sapiens
  chr5:174178168-174178209
  hyper
gggctcccccgaccccgccctggcagcgccccccgccgcga

SEQ ID NO: 30135 - DNA, 126 bp, Homo sapiens
  chr5:174178667-174178793
  hyper
agggagaagaggggccgcggccgcgcgccccgccatcagctgcgcgcacagagggagagttcactccggggacaagggcggcgcgaccggcccggggctcttgggcggccgcgtttcccctcccac

SEQ ID NO: 30136 - DNA, 86 bp, Homo sapiens
  chr5:174220856-174220942
  hyper
cgacgcgccacatggctggcaccggcgcgcccccgcgcggccgcctgcgagaagctcactctccgcggaggcgaaatctggttttg

SEQ ID NO: 30137 - DNA, 1179 bp, Homo sapiens
  chr5:174870699-174871878
  hyper
accttgccttggggtcgtctctctcaaagcccctggagcttggaatgtggacttcgctgggggcagcggctccgaaacgttgaggaagcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcaccagcaagcgcacaggccggcggggttcccgcggggcacagcccaccccgcccgcgcgtcccctcccctgccctgggggcggtcctcgcttgacaggcagagttgcgggcgacagccgcacgtggtccccctggatggttctgcgggcgaggtgggcggaggacgccccggtgagtgcttgccctccctggttacctcgccagtctccggatccccgcgcagcacgcgcagggcccgcgaggcaaatccaatgtcagaacctcaagtaagcttgagtcccctgaaagcaaagctcagccccgacatccagcgcctcttggggtcaacccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtg

SEQ ID NO: 30138 - DNA, 265 bp, Homo sapiens
  chr5:175085050-175085315
  hyper
aggccgtgcgcgcgccgcccgctgcatccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccac

SEQ ID NO: 30139 - DNA, 220 bp, Homo sapiens
  chr5:175085524-175085744
  hyper
cgaaacagtccccgttttgtctccgggtctgggtggtggcattttctcgcggcgatgtgtctgtcggagcatggagcaactttctgctaaagggaagccagcggagagcgggggctgctggggaggaggcttctatgtctcaggaaaccagaacgacctgccttcatcccgctgggctgccgcccgctgccggatgaccgatgaccggagccacaacagg

SEQ ID NO: 30140 - DNA, 30 bp, Homo sapiens
  chr5:175223481-175223511
  hyper
tgccacctctgctggcgtcctctctcatct

SEQ ID NO: 30141 - DNA, 70 bp, Homo sapiens
  chr5:175223880-175223950
  hyper
agagcttcctagaggcggcttcctccggcctctccccctccctggagctctcagccgccggcggctcttc

SEQ ID NO: 30142 - DNA, 321 bp, Homo sapiens
  chr5:175224441-175224762
  hyper
gggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcag

SEQ ID NO: 30143 - DNA, 35 bp, Homo sapiens; identical to SEQ ID NO: 8221
  chr5:175298647-175298682
  hyper

SEQ ID NO: 30144 - DNA, 40 bp, Homo sapiens; identical to SEQ ID NO: 8222
  chr5:175298910-175298950
  hyper

SEQ ID NO: 30145 - DNA, 192 bp, Homo sapiens
  chr5:175299156-175299348
  hyper
cccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcc

SEQ ID NO: 30146 - DNA, 550 bp, Homo sapiens
  chr5:175299591-175300141
  hyper
acccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgc

SEQ ID NO: 30147 - DNA, 29 bp, Homo sapiens
  chr5:175300142-175300171
  hyper
cagggatagaccaaggcttcccgcagaat

SEQ ID NO: 30148 - DNA, 196 bp, Homo sapiens; identical to SEQ ID NO: 8226
  chr5:175300216-175300412
  hyper

SEQ ID NO: 30149 - DNA, 54 bp, Homo sapiens
  chr5:175488184-175488238
  hyper
agccaggagaacccgcgagcccagcggcgcctgcacctgcggcttccgggagcc

SEQ ID NO: 30150 - DNA, 308 bp, Homo sapiens
  chr5:175560514-175560822
  hyper
agtagcctgggtccccgtacctctgcaggcgcagccgctcttttcacctggtgcgccagcttgcaagtcgtgcatttacctcttttggctgcacagagggcagggaagcctcgcgggtatgcaagatcgggaatggctgggggtgcgaccaaggggacttggagaaccgccccgcctccccaggttcccctggtagagcgcaccaccccccacccccgcgagttttcagaggcccaggccctgtggagctgggtctctgcggaaggggtggggaccgggcagaggcaggaggacggaaagagctgggc

SEQ ID NO: 30151 - DNA, 163 bp, Homo sapiens
  chr5:175621342-175621505
  hyper
gccggcgcctgctcccgcagacctgccatgccaatgctctccaagctgaggccgggtggcctgcgacgctcagcccgctgcccatcacaagaagaaaagcgcttatcagggcgctgtgcgcacggggccaccttcgcgctggcccgtgcgggcaccctcagcc

SEQ ID NO: 30152 - DNA, 83 bp, Homo sapiens
  chr5:175626566-175626649
  hyper
cgcgtaggagcggggcgcgggcaggtacagaacgcgggcaggagcaggacgcggaggggagcggggcgcgggctggcagaggt

SEQ ID NO: 30153 - DNA, 108 bp, Homo sapiens
  chr5:175792208-175792316
  hyper
cggttttcccttctgcgtggtatcattgtaaggggtaacggagaaaagccgtgagctaacccctggtggatgctagcaagcaccgccgtctcccgtcctccccaggca

SEQ ID NO: 30154 - DNA, 392 bp, Homo sapiens
  chr5:175792540-175792932
  hyper
cgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaa

SEQ ID NO: 30155 - DNA, 221 bp, Homo sapiens
  chr5:175792997-175793218
  hyper
cgggtgttccagcgggggccggagtttggagggcgcggctcgggagcatcccggggcccagccgggtcggctcgcgcccctccggcgcctgcgcagtgcaccccgcccgggggtggggatgtcgggagaaaccccatcccctcccgcctgcggtcgggactccgagaccggtggaggaagcggggcgcgcgagcgtttaaggaattcgccaagggtttgga

SEQ ID NO: 30156 - DNA, 204 bp, Homo sapiens; identical to SEQ ID NO: 8233
  chr5:176024005-176024209
  hyper

SEQ ID NO: 30157 - DNA, 71 bp, Homo sapiens
  chr5:176038550-176038621
  hyper
gcttcctcacatttccggtcctgaaaattgctcattcactgcccacaaggccatttcgcttcagagcttac

SEQ ID NO: 30158 - DNA, 313 bp, Homo sapiens
  chr5:176046289-176046602
  hyper
gcctcggtgcaagcgcggagagagggcctctgcggcaagagggcaggggcggggcctcgcgcagggactgcctatgccaataaaggcagcgcatggggggcggtgcctctgcgcggagccagcagtatctccgcccccatctttctcactctgaggcggtgttgggggccccctagtgctgatcctgatccgctcaaggctcccgggcggcatcccagacctctgcgggccctcgcccacctcaaactttcggcctcaaacattccggcgccttcgtgggggtgggagggtggagcaccggaggccagggctc

SEQ ID NO: 30159 - DNA, 659 bp, Homo sapiens
  chr5:176056505-176057164
  hyper
cagccccagaaaccccgccccttacccaccgacgtagaggacgccctccttggtcttctccgccgcctcggtgaccccctgcttggttttctccgcggctgccacaacgccctccttggccatggacaggcccttcatgaacacgtccatcctggcggcctggggagggcgatacacgggcaccggtgcactggccccgcactctcaccccagcccctcccgcgggacgcagatgcccccctactcccgagaccgcggcgcccttctggaccctgagccccctcccgctttccccccatcccaccccactccccagtgcgaagcctcagggccgcggagagtcctagcgtccttgaaacctggggacgcgggaggggccactgcctcggttatccgggccctgcaaactgcagccccgtcgaaccggagtgctgggttcggcgcgaatatccaggacccgcctgtacacgcacggcacagtcacacggtcatgcacacaaacatacaccacggacaagctcacgtgcacacacaggacacgcagacgctccaacgcgcacgaataccccgacccacatgggcgcggacacacgtccccacagccgcccgggcagctgcaaacaccggagcatactcacatactccggggtgcacactga

SEQ ID NO: 30160 - DNA, 141 bp, Homo sapiens
  chr5:176057373-176057514
  hyper
gaggggggatagggccgggatcaggcgctcgggtcgcgggtcctgagcaggagcgcagcagtgcccgggtctcgggtgcgtagccagccaccgctcgttcctcgcgccctgcgagctcgcgcgctccggctccggctccgg

SEQ ID NO: 30161 - DNA, 30 bp, Homo sapiens
  chr5:176057751-176057781
  hyper
gagttctgctgggctcgaatctcagctgtg

SEQ ID NO: 30162 - DNA, 405 bp, Homo sapiens
  chr5:176107080-176107485
  hyper
gccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaatttattactggaggccgcagaaccagcggcgtggagtgcgcctcccgggagccgccgctgtcggagaaaggcacccacccgcctgggccggctcccgggcgcggggcggtgtctcagggaggcgtctcagccgagctgcagggcgaggggagcgagccgggtcccgggggaaggcatccggtcagggcctcgcccacccggatggctcctg

SEQ ID NO: 30163 - DNA, 69 bp, Homo sapiens; identical to SEQ ID NO: 2710
  chr5:176107517-176107586
  hyper

SEQ ID NO: 30164 - DNA, 30 bp, Homo sapiens
  chr5:176170309-176170339
  hyper
ccgggggtgcgggtgcgccgagccctcggg

SEQ ID NO: 30165 - DNA, 277 bp, Homo sapiens
  chr5:176236721-176236998
  hyper
tgccaaagcccagctcgttcctttacacccacgtcgcgggcgccgtgcgctctcggggctcaaacaccgcgcgcccagtcgggtgtgctgcgcctgaaggttgttttccttcggcgaacggcgccgaggggttagggaaaccttgggtcatggtgtgaggcgcgcccctggaatccaccagcctgcgaggctgggactgcgggtgtccccgagtctggcctgccagctctggtggccagggcacctctgcgcgcgggccagggccccggggctctcc

SEQ ID NO: 30166 - DNA, 17 bp, Homo sapiens
  chr5:176237148-176237165
  hyper
cgcgccggggtcgccgc

SEQ ID NO: 30167 - DNA, 95 bp, Homo sapiens; identical to SEQ ID NO: 8241
  chr5:176264805-176264900
  hyper

SEQ ID NO: 30168 - DNA, 95 bp, Homo sapiens; identical to SEQ ID NO: 2711
  chr5:177411327-177411422
  hyper

SEQ ID NO: 30169 - DNA, 702 bp, Homo sapiens
  chr5:177411507-177412209
  hyper
cgcggagatgggccagagtccggccatccagaagtgcctggagcgcacagcaaggccctgccctcggctccgtgaaggtgagggggtaaagtcggcccggagtccccgggggtgcaggaggggccccgcgggttccagcagaccctcgacggaacgttccaggcaggcgagatctcgcacagaatctgcccttttaaaggctcggctttgtcctcgttaaacttgcgtctggcaacgcgaccgctgcggctcccgagcaagattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcg

SEQ ID NO: 30170 - DNA, 90 bp, Homo sapiens
  chr5:177412560-177412650
  hyper
gctgggttgctggggcgccagtctgcggtgttcaggcccaaagcctgcagcctgttcagtccagggcaccgcaggcgccagaactctggc

SEQ ID NO: 30171 - DNA, 30 bp, Homo sapiens
  chr5:177666777-177666807
  hyper
ggtcctgccgagagccgtgtggcttcctgc

SEQ ID NO: 30172 - DNA, 87 bp, Homo sapiens
  chr5:178004287-178004374
  hyper
cgtctcccctcttctcgggacaccagccctgttggatcagggcccccccacaacgacctgtgccacctcatccgcctctttaaagac

SEQ ID NO: 30173 - DNA, 303 bp, Homo sapiens; identical to SEQ ID NO: 509
  chr5:178016681-178016984
  hyper

SEQ ID NO: 30174 - DNA, 52 bp, Homo sapiens; identical to SEQ ID NO: 510
  chr5:178017519-178017571
  hyper

SEQ ID NO: 30175 - DNA, 344 bp, Homo sapiens
  chr5:178017572-178017916
  hyper
ggcgccggcacccgcccccgcacgcacctctgaggcttccccagcccaagcccgcactgtggaccccagaggtcggaggggagcccggcgacaccgcgccccttctgcagcccacccctggctggagcacccaccactcgtgccttagcacattcctctaaacttgtgaattacctttctgacacttgtaaaagttcaaaacttcaaatcctgcaaaaaactgagtgggtctgtcctcggtggtggattagcgccgcttcgtggcggaaagcgacctctgcgcactcacatttagagaggcagggtcgagattgcgccaaacagaaatacgccccttagaatct

SEQ ID NO: 30176 - DNA, 43 bp, Homo sapiens
  chr5:178422264-178422307
  hyper
caagccagtcacctgcgccagccgctgtcggttcaggacaagt

SEQ ID NO: 30177 - DNA, 217 bp, Homo sapiens
  chr5:178450901-178451118
  hyper
ccaggtacaggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgctggactcctggg

SEQ ID NO: 30178 - DNA, 46 bp, Homo sapiens; identical to SEQ ID NO: 8250
  chr5:178487258-178487304
  hyper

SEQ ID NO: 30179 - DNA, 403 bp, Homo sapiens
  chr5:178487341-178487744
  hyper
cggcgtggggccggaggcatgccgggagtggtagttctcccgcggttggcggggtttcggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtg

SEQ ID NO: 30180 - DNA, 338 bp, Homo sapiens
  chr5:178594123-178594461
  hyper
cgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgaca

SEQ ID NO: 30181 - DNA, 145 bp, Homo sapiens
  chr5:178770760-178770905
  hyper
tactcaccagcccatcgcagttgctgagcgccacagaggaggcttcggctaggccggccacgtctccgacgtagagacagctcccgagcaggggctccacgcgggtggtgcccttctcgccctgccactccatagtggccccggg

SEQ ID NO: 30182 - DNA, 433 bp, Homo sapiens; identical to SEQ ID NO: 2717
  chr5:178771198-178771631
  hyper

SEQ ID NO: 30183 - DNA, 58 bp, Homo sapiens; identical to SEQ ID NO: 2718
  chr5:178771723-178771781
  hyper

SEQ ID NO: 30184 - DNA, 78 bp, Homo sapiens; identical to SEQ ID NO: 2719
  chr5:178771782-178771860
  hyper

SEQ ID NO: 30185 - DNA, 15 bp, Homo sapiens
  chr5:178771967-178771982
  hyper
cgccagtgctccgag

SEQ ID NO: 30186 - DNA, 546 bp, Homo sapiens; identical to SEQ ID NO: 2721
  chr5:178772184-178772730
  hyper

SEQ ID NO: 30187 - DNA, 58 bp, Homo sapiens; identical to SEQ ID NO: 2722
  chr5:178772778-178772836
  hyper

SEQ ID NO: 30188 - DNA, 349 bp, Homo sapiens
  chr5:178957597-178957946
  hyper
cgagggtgatctgagatccaaagtcaggagtcttctgcatcctgccctttgtcagcgctggtcctcatttcacctgcccagggccttcaggaggggcgacactctccggctgcgggcggcccagcgctcgcccccctcggccccacgtactcttcctgcctcgcccccatcgccctcctccggcttcccgcgcctcccggggctctgcgcttgcgtccagggcgccctctccggggacaatgggcgggtgcttcgcaggctgcagtcagggccgacttcacccggcgaggacagggcgaggcgctgggcccagaggtatgtttgaaacgattcgcgtatgtgaatctac

SEQ ID NO: 30189 - DNA, 31 bp, Homo sapiens
  chr5:179243847-179243878
  hyper
ccccagcagtgcccccgggtctccggccacc

SEQ ID NO: 30190 - DNA, 22 bp, Homo sapiens
  chr5:179244320-179244342
  hyper
gggcgttcgtcctccatccctc

SEQ ID NO: 30191 - DNA, 34 bp, Homo sapiens
  chr5:179498329-179498363
  hyper
cctggctggggctgtcggccgggcagcgcgggag

SEQ ID NO: 30192 - DNA, 30 bp, Homo sapiens
  chr5:179498867-179498897
  hyper
ctcacgtccactgcccgcctgtggggacgc

SEQ ID NO: 30193 - DNA, 55 bp, Homo sapiens
  chr5:179635756-179635811
  hyper
cccagcaggggctggcggcgcgcggcagagctgggtctcccgccaggtggccggg

SEQ ID NO: 30194 - DNA, 39 bp, Homo sapiens
  chr5:179636267-179636306
  hyper
ggagctgcgggagcccgcgggcggcgctgcacaccaggg

SEQ ID NO: 30195 - DNA, 135 bp, Homo sapiens; identical to SEQ ID NO: 8263
  chr5:179779648-179779783
  hyper

SEQ ID NO: 30196 - DNA, 173 bp, Homo sapiens; identical to SEQ ID NO: 8264
  chr5:179779840-179780013
  hyper

SEQ ID NO: 30197 - DNA, 1257 bp, Homo sapiens
  chr5:179780035-179781292
  hyper
cgggtgaggggcagccaggcccggccgacgacagcccctcggtaggggcccggggcagatcggcgcccccagccaggtcctcggcgcctgcttgcgggcggaggcgcggagaggctgcggcgccgggacccgcggacggcgtggaggaggcggctcgggcgggcgcggcactcaccgcacatcgtggctgcttctcgggctccttcgcggctcgagggggtctgcccgttcggacgctggggctcctccgtgggctcctccgtgggctccgtgggctccgtgggctccgcgggctccagctcccgtccgctcggcctccagcccttataacccggagccctccgagagggcggggaagggggcggggaaggggcggggcttcccccgcccgcctgctcccattggcccccggttgtcgtgacaacgacgggacccggcccccaggagccagggaggggggccgaggggcggctcccaggcgcgggtcgggcgtgtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacggggtgctgagaagtcagacgggccgcgtaaggggcagagcgaggggtccggcatcactcgcgcgctccggaaacccgcgtgagccgctgttcctgccgcgctcccatctgagtgacaggcttgtttcagagctccgcagacctctaagcctggccctcaccctgcgtggagagaacgcccgggcttggcggagagacgagaaaaccgaggctcccggaggcagacaaggactctgccaaaaccggacgccgcggcggtggcagaattcgaccctgggatttgccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcactctgggcccctcgtctcccgaggaaggtcacgagaaccggcccaacgtttgcgcactttgaagttt

SEQ ID NO: 30198 - DNA, 62 bp, Homo sapiens
  chr5:179867486-179867548
  hyper
aaggggatggagggtcgcattaaacaacacctcaaggcagcccagatcgggagggagggtcc

SEQ ID NO: 30199 - DNA, 544 bp, Homo sapiens
  chr5:180017145-180017689
  hyper
atggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggccttcagggccttcacggcccccacggcctggggacccagctcagccacacacttctgggagccctctatgaggtggttcac

SEQ ID NO: 30200 - DNA, 442 bp, Homo sapiens; identical to SEQ ID NO: 2726
  chr5:180017690-180018132
  hyper

SEQ ID NO: 30201 - DNA, 195 bp, Homo sapiens
  chr5:180018484-180018679
  hyper
ggggaacctgcggctgcccgggcaaggccacgaggcttcttatacccggtcctcgcccctccagcgccggcctcgcccgcgctcctgagaaagccctgcccgctccgctcacggccgtgccctggccaacttcctgctgcggccggcgggccctgggaagcccgtgcccccttccctgcccgggcctcgaggact

SEQ ID NO: 30202 - DNA, 67 bp, Homo sapiens
  chr5:180075791-180075858
  hyper
tcctcagctggccttcgaggcccctgtcccctcaaatccggggacccctggccttccgccccttctg

SEQ ID NO: 30203 - DNA, 405 bp, Homo sapiens; identical to SEQ ID NO: 513
  chr5:180076053-180076458
  hyper

SEQ ID NO: 30204 - DNA, 552 bp, Homo sapiens
  chr5:180076532-180077084
  hyper
cgccccgctgcatctccggccgctgcgcgtgggtccgacccgagcggccgcggctcggggctgaaagtgtccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcgggtaacgcagacggtctcgcgatgcgctccggaggtgatggagcctggtgggcaaaggggagcaaaatgcggcacgcgctcttttccgtcctttctttccatcggtaaaatctagactaaacaagaaagcaatccttgtaaaaatagtatgttacatctttgaaaatagtggcaccagccggcgtaacatagggagacccagtctcaaaaataaacaagcaaataaataaaataatacgccgagcttggttgtgcgcgcctgtaatcccagcttctcggggg

SEQ ID NO: 30205 - DNA, 258 bp, Homo sapiens
  chr5:180100616-180100874
  hyper
cgtttttgtcgcttccagctcggtttcccctgtggtcagttggagccagggtggggaatctgcagcttgcagaggggaccactgcgcctcctgcctgaggcgggctggggggtcgttgtcctcgcagcgttaaggcgagtctgggacaggaccccggcaccccctccggatctgtggcatcctccaggactccggcgcaggacgcgctccaggagccgctccttcagggcctccggtgcgcgcagtccgggcgccgga

SEQ ID NO: 30206 - DNA, 153 bp, Homo sapiens; identical to SEQ ID NO: 2731
  chr5:180101015-180101168
  hyper

SEQ ID NO: 30207 - DNA, 346 bp, Homo sapiens
  chr5:180527353-180527699
  hyper
atctcccacccttgccgccctctggatccagcgtccaccgagcactttttccagttccttcattctgcgcgcgagtcagcttgctgtgtagggacagaagatgacgaagtgaattcctgcagcccgccgagctgttgctgtcgccctgggagcagggcacgctcttgaccatccactcgcagatctgcgacagcgcgagccgcttctccgccgagctctcgtcggccctggtgctgaggtcggcgtgggacaggctgcgcgacgcggtgcgacgggacgagctgcccctgcgctgctgcccggcggaggcggggtcccgggtgggtgctgcggcgcggcgtcccgg

SEQ ID NO: 30208 - DNA, 46 bp, Homo sapiens
  chr5:180527793-180527839
  hyper
cgactggaaatccgggtgcacctccgccccccggggcgcttcggcc

SEQ ID NO: 30209 - DNA, 29 bp, Homo sapiens
  chr5:180530748-180530777
  hyper
gctgggattacaggcgtgagcccccgcgc

SEQ ID NO: 30210 - DNA, 139 bp, Homo sapiens
  chr5:180531166-180531305
  hyper
gctgccacaccctctcgtccggtctcccatgcccccttatgctaccgcgtcgggcatgaaaacttccttttctttcttctccttctttccttccttttgagacagggtcttgctctgtctccgccgctggagtgcagtc

SEQ ID NO: 30211 - DNA, 284 bp, Homo sapiens
  chr5:180600774-180601058
  hyper
cctacaacactccaccgctatctccacctggttaaggaaaaaaggctatcaagggtatttatacctttgcctttccgcctcaaccattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggcaaaccacaacaagctggcagcggtgggat

SEQ ID NO: 30212 - DNA, 284 bp, Homo sapiens
  chr5:180601118-180601402
  hyper
cgctaccttcctccgggggttcacctgcatcttttccttccttataaaacatccccagggttcccgggccaacaaggcgttggggcgaatccacagggcatcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggagg

SEQ ID NO: 30213 - DNA, 243 bp, Homo sapiens
  chr5:180632859-180633102
  hyper
cacaccctctctcctcgctcactctggaggccacttggatcaagctttcgcccgcaccctcctcagaaaccgcccttgccaatgtcaccgggaacttcagcaattctcacccaaaggcgaagacctcgcctcacctcatctgcccccggatgctccctccttcccgacttcccttctcagggccttccaggacccagtgtccccgatcttcttgctgttcctgaaccccgtggcctctgcgct

SEQ ID NO: 30214 - DNA, 553 bp, Homo sapiens
  chr6:391190-391743
  hyper
atgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctc

SEQ ID NO: 30215 - DNA, 20 bp, Homo sapiens
  chr6:391744-391764
  hyper
cactctcagtttcaccgctc

SEQ ID NO: 30216 - DNA, 135 bp, Homo sapiens; identical to SEQ ID NO: 517
  chr6:391765-391900
  hyper

SEQ ID NO: 30217 - DNA, 25 bp, Homo sapiens
  chr6:392409-392434
  hyper
gctctcccgggcctgctccggggtc

SEQ ID NO: 30218 - DNA, 372 bp, Homo sapiens; identical to SEQ ID NO: 519
  chr6:392587-392959
  hyper

SEQ ID NO: 30219 - DNA, 115 bp, Homo sapiens; identical to SEQ ID NO: 520
  chr6:393124-393239
  hyper

SEQ ID NO: 30220 - DNA, 233 bp, Homo sapiens; identical to SEQ ID NO: 521
  chr6:393240-393473
  hyper

SEQ ID NO: 30221 - DNA, 196 bp, Homo sapiens
  chr6:711053-711249
  hyper
tccagtggcatttcccgtcttacacgatgagcttcatccacgttctccataaccccctccccgccacgggaagcgtcagccacctggaacagccctattctgctcggttgtaaaaagcgtcaggcgcttttgatttgaaaagcgttaggcctgggaatcgctgttgctccctcggtgggcacgccctgctgacacg

SEQ ID NO: 30222 - DNA, 189 bp, Homo sapiens
  chr6:1311809-1311998
  hyper
ctacagaagcacatacgccgcgtgcagcttaggcccgagcaaagtccctgctcccctagacccagtcccttcaggtgtccccctaggggaactgtggcgtgtccccccaaccaggcgcactcgcctaaactgcgtccccgaactccagggcgcagggagccctcgcgggctgcccggggctggggccca

SEQ ID NO: 30223 - DNA, 30 bp, Homo sapiens
  chr6:1312754-1312784
  hyper
agagaaaaagcccagcggaagaggactccg

SEQ ID NO: 30224 - DNA, 62 bp, Homo sapiens
  chr6:1314000-1314062
  hyper
ggcggcggcccccgccaagccactccgaggcccggcggccggcggcgcgcacctgtactgcc

SEQ ID NO: 30225 - DNA, 277 bp, Homo sapiens; identical to SEQ ID NO: 2742
  chr6:1378199-1378476
  hyper

SEQ ID NO: 30226 - DNA, 210 bp, Homo sapiens
  chr6:1379267-1379477
  hyper
cgaaaccaccccggggaaagccgtaggggcgcgccggcccacgcgggaccgagttcagaggactctgcaccgtcagtttcagggccgacgtttatagagcgcttcccacgtgccgcacgcggttctaagagcttggcttgtattaattcgtttaatcctcccagcaacactgttaggcattataatgatcccaatcgtagaagtcaaaaa

SEQ ID NO: 30227 - DNA, 253 bp, Homo sapiens
  chr6:1379699-1379952
  hyper
cggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacccgcgaggcgcccttgcgagctgcgcagtcgagttttctttcca

SEQ ID NO: 30228 - DNA, 191 bp, Homo sapiens
  chr6:1381893-1382084
  hyper
cagagaaccaaataacggaactgaatgatcgtttcttcagcaaagcctaaagacgcttgcgtcccgcggagaggtgcccacgcgcgactcggctgccccctcttcttgcgggtccgggtagggtagggcgggaacgcgggacgtgccctaagcgggccagccgagcgcgagacaggcgatgctgcagaagc

SEQ ID NO: 30229 - DNA, 186 bp, Homo sapiens
  chr6:1382452-1382638
  hyper
cacccacgaggataccgcgaccaagccaccaaagcactctctggccaggccgagaccccttttcccccgggccccaagagaaaaaagcactttctcctaaaacacgaactccccgcggaggggcccggggctgcctggcacggggcagggtgtgcggctgccgtgcgggcgcgggccagagtcacg

SEQ ID NO: 30230 - DNA, 448 bp, Homo sapiens
  chr6:1382993-1383441
  hyper
gtgtggggcacagggcgtgaggggaggatgagctccccctgagcagatggagatttctccttgcctgggccgtttgacccccaaagccttgcagactggccgcgtgggtgccatggggcgatttcttgggaaaggagggcagcagaaaggcccgtgggctctcagcgccttggagtcaggggagcaggaaggggagtggaggtgcggacacgcctccagccaccgtgctcccctaggaggatctcccttcagcccctgtagaaccctgcatctcaaccaccctcgtgcatgtggtttaccttggcatagatttccaagccgctacagaaaacctgtccacctcccccaaggtggaggcgggagttgggaggcaggggtgctggaaagggtcacctggctcaagccgaccccaggtctgacgggcggagagcctcgagggccacgcccc

SEQ ID NO: 30231 - DNA, 32 bp, Homo sapiens
  chr6:1383677-1383709
  hyper
caaactcatctagggcgcgcccggagcttccc

SEQ ID NO: 30232 - DNA, 41 bp, Homo sapiens
  chr6:1383859-1383900
  hyper
ggggcccggggcctttggccaggctgcggggaggggtgggg

SEQ ID NO: 30233 - DNA, 72 bp, Homo sapiens
  chr6:1384108-1384180
  hyper
gctcggcggggaggacgagaggggagttttgatgcgccaggaagttcatctatcgcccaggcgctcaggacc

SEQ ID NO: 30234 - DNA, 19 bp, Homo sapiens
  chr6:1384625-1384644
  hyper
cgagcgttgccacagccgg

SEQ ID NO: 30235 - DNA, 325 bp, Homo sapiens
  chr6:1384971-1385296
  hyper
tctccactcactccccgcaaccccgcaactcgccacccctaaacgcagcgggctgtaggcgaagtcgaagaggtgctccgcctggtaccgcggcctgcgcactgggatcggggcctgcaggccgctgggctggctcctgggatcatcccaaggttttggtctcgcaaccgaggggacccgcgcccggcaatttgggaagtgcggaaatggggtgaggccggtcttcgcttgagggtctcgtagattggacccctttttcccccttcaagcaccctcagacctggccagtgggtcatcgagtcgtgcccaccgcccaggccaggag

SEQ ID NO: 30236 - DNA, 33 bp, Homo sapiens
  chr6:1385653-1385686
  hyper
ccagcactgagttctcgccgtccacatttagaa

SEQ ID NO: 30237 - DNA, 35 bp, Homo sapiens
  chr6:1386121-1386156
  hyper
ggagagaggacccatcgcggcggaggctgcatagt

SEQ ID NO: 30238 - DNA, 269 bp, Homo sapiens
  chr6:1389006-1389275
  hyper
acactaactggggtgcgggggtggggggaagaagtggaagcaaatgcaaccctaagtcccatgagatccaggtttccagagtctttgaaacttggcctaggtttctcagtgtaaatccctctgctcaaagttccgaaaacgtccacgatcgccagcggcccgcaaccctgcggcggcccccagtcgccctaacaattgtcggggagcctgcaggccctgccagaaagagagaggattggcacgttacctttgggcgtctggcaccccgg

SEQ ID NO: 30239 - DNA, 411 bp, Homo sapiens
  chr6:1389950-1390361
  hyper
gctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctc

SEQ ID NO: 30240 - DNA, 44 bp, Homo sapiens
  chr6:1390362-1390406
  hyper
tcctcctccaattcggccagcgccccctcggctgcctgcaagag

SEQ ID NO: 30241 - DNA, 145 bp, Homo sapiens
  chr6:1390423-1390568
  hyper
cgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagtt

SEQ ID NO: 30242 - DNA, 451 bp, Homo sapiens; identical to SEQ ID NO: 8299
  chr6:1390955-1391406
  hyper

SEQ ID NO: 30243 - DNA, 210 bp, Homo sapiens
  chr6:1605301-1605511
  hyper
aaggaaggctggctgcggccccggcgcctgggtccgctgcggcgccgggccggagacctgggaacagccagccacctgcaaggttgcagcccacctcaccccgccggcggctccggggctgtctgtgggtctgtctcacggggcaaagcctttcttcccacacccacagccaaggcgcgtccgtgcaggggcacacgccttctgctccag

SEQ ID NO: 30244 - DNA, 370 bp, Homo sapiens
  chr6:1611389-1611759
  hyper
cccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccct

SEQ ID NO: 30245 - DNA, 10 bp, Homo sapiens
  chr6:1614190-1614200
  hyper
ccgggaagat

SEQ ID NO: 30246 - DNA, 49 bp, Homo sapiens
  chr6:1614286-1614335
  hyper
cggcgctaggtcccggggctgcctccagcttcctcgggttacagcctct

SEQ ID NO: 30247 - DNA, 39 bp, Homo sapiens
  chr6:1619896-1619935
  hyper
cagccccgcgttccccgcgcccggcgctgccggggaaaa

SEQ ID NO: 30248 - DNA, 471 bp, Homo sapiens
  chr6:1625220-1625691
  hyper
tgccgcagggctggccgcgccaagcgcgcgtcctacccaaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcag

SEQ ID NO: 30249 - DNA, 500 bp, Homo sapiens
  chr6:2903017-2903517
  hyper
ctgggattacaggcgtgagccactgcgcccggccgagactggtgactgtaaaggacagtgaagaagcaggacagacgtcatcctgcggatcccagagcagagaagagcagtgagaacacagggccggcaggtggggaggaggctgcaggggagggcttcggccagggaagggcagcgaggagacatccgggagggaggcgtccgcggtggctgtgggccgccaaggcggagaccggctgccgctcccaggcaccccccagagaccgttgctgaccccaccgagaaggcaccgcctccccggggctcttggctgagcgacctctcctgtcctccggtcccatcactcggtggcagccggtggacctgaagctcgccactcccgtcccctaccccagccgtgcgcggggacgccctcacctgccacctagtccagcgctgccgccgtctccgtgccgcgctccgagcctggacgccgacccccgaggcgcaggacccggccc

SEQ ID NO: 30250 - DNA, 92 bp, Homo sapiens
  chr6:3228298-3228390
  hyper
caggtgctccagtgccggcaggtgggagggctgaggtggcacaggctgctccgccacctcggactgcggctcctactcggccactggccaga

SEQ ID NO: 30251 - DNA, 90 bp, Homo sapiens
  chr6:3228984-3229074
  hyper
agggtggcccaagcccgagtaacaaactttcttatcttccatcgcggcgacctggaggtccgaggcttcgtgctgcggttgaagggtggg

SEQ ID NO: 30252 - DNA, 66 bp, Homo sapiens
  chr6:3229387-3229453
  hyper
acacttcggaagggccgttggcgaggtgacgtgacctctttcatcccctggcgagaaaggccgaat

SEQ ID NO: 30253 - DNA, 358 bp, Homo sapiens
  chr6:3231580-3231938
  hyper
aggccttccctcctccgcctgggaagccagcggccccggcggagctgcccggcactgtttagtcgcaggggctgcggggtggcagcctcagagccctgtccttccgcagccgtgggccccgcagggaccagccaagcagggcaaccaaaagctggaaccagcagcgaaaaccccgagcccacgaacgcagcgcagtgcgggaacacttgccctttgttcctcagtaaggccgggtgttttcgcatccccggaggttgtgaatttgagttataatggcctcggtcgggactgagagagccgagcttccacgagagagctttgcctgctttgtcctacaaatcggcggagggagtagcat

SEQ ID NO: 30254 - DNA, 37 bp, Homo sapiens
  chr6:4135160-4135197
  hyper
cttcaaggccaccaccgtgtttcggttttgttcccta

SEQ ID NO: 30255 - DNA, 41 bp, Homo sapiens; identical to SEQ ID NO: 8306
  chr6:4775411-4775452
  hyper

SEQ ID NO: 30256 - DNA, 137 bp, Homo sapiens
  chr6:5026605-5026742
  hyper
gacagcttagcctcccgcctcccagagcctctcctgaggctcccacccagcgcctttctttccttcctcccttcgtttatttctgggacccctccccacaaactttctttaaagcctggtcacgtgaggtctcctct

SEQ ID NO: 30257 - DNA, 591 bp, Homo sapiens
  chr6:5085738-5086329
  hyper
ggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcc

SEQ ID NO: 30258 - DNA, 30 bp, Homo sapiens
  chr6:5851459-5851489
  hyper
cgctgcacctcggggcgtgttctcccaccc

SEQ ID NO: 30259 - DNA, 114 bp, Homo sapiens
  chr6:5851703-5851817
  hyper
ggtgcccacgcgtcccgggcttcaggggagcacctgggaagcgctgggggtcgcgtgcccttggccggaggcctggtcacccgcaggccctgccatcctcggcttggccgctgc

SEQ ID NO: 30260 - DNA, 683 bp, Homo sapiens
  chr6:5996021-5996704
  hyper
gcctgaagcccactccgtcccactcccaatactcccaccatctcatcagtggggcatgctcgccctggttaatgtcatctccctgaactgccaacgaggctagcagctttgctgcttaaaaccggtaacatcaaccaacatatggagatgtcatcatgattaaacggcaaattatagccgaagacggcgcgataataatctaaacaatcaccacaagaagaaacgttctctaacgctccagttgcggaagcctgcgtttccaagactcgcggccctgcgttcccagggatatctccgtgctcacgtgagcgtggtcctcggcttgggacagacaagggagccccagacaggacgataaggtttggagattcccagggcgatctgggactccgtggcgtgggggcttggaagcgcgtggaggggctgagagaggggagagggcgcccttcctctagggcggccccgtctgggaagcagttggaacagcagtaggagccaggggttcctagagaagaaccctgttaggagagcagaccagcccgcgctcccagtccccgccccctcgccccttctgccccgcccttagcctgcctcttcctagatcttccaggacattgatttccgagtaggaagcccgcgctgctaggggaggggcgtcctctgtgggtcgtgggggggtttcc

SEQ ID NO: 30261 - DNA, 291 bp, Homo sapiens
  chr6:5996952-5997243
  hyper
atcatcctatttatacgcagaccgaaaataaccattgaaacgaaaccaacaaaatgcaactattttccaaaaccccgagcgtttgctggtgggtgaccaccccgcgcaggtagcgcggatctgctttggttttgactgagaacccgggttttgactgagacctccgtcgggaggaggggactgggtgggagttagcgggcgaaacgattccccggagtggccccgagcggcgcgtgcgtgaacgcgcggccgtaatatatgctgccattaagaatccgtgcagcttccagc

SEQ ID NO: 30262 - DNA, 248 bp, Homo sapiens
  chr6:5997557-5997805
  hyper
cagttctttctcccccgcctactccaggcctgcagtccccggacccgggtcgcctctgcccatttactccggaatgtttacttctctttaaggccatgcggggcctataaataggagaggtggaatcagccccactgccagatcaatagggcccgtctcctcgccatttcagctgagctgtcttattaattatgaaaggattcacctgatccctgccagggaacacagcctctcggcccctctgctgg

SEQ ID NO: 30263 - DNA, 260 bp, Homo sapiens; identical to SEQ ID NO: 525
  chr6:6003269-6003529
  hyper

SEQ ID NO: 30264 - DNA, 395 bp, Homo sapiens; identical to SEQ ID NO: 526
  chr6:6004349-6004744
  hyper

SEQ ID NO: 30265 - DNA, 492 bp, Homo sapiens
  chr6:6004836-6005328
  hyper
cgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaacccccacttttcttgccaaatgtcaatgatttgggacagctcccagccgtgaattaataaagaccgaggttctgttgcaggaaagggcagacattagggaacaaatacgttcaatttcaattccacagtcaacaaatagtcatttttggaccgaggttaatgtgtt

SEQ ID NO: 30266 - DNA, 54 bp, Homo sapiens
  chr6:6006358-6006412
  hyper
gttccctatcactctcgatttgcccaccagccgggtctgcggtgcccgtgcaaa

SEQ ID NO: 30267 - DNA, 278 bp, Homo sapiens
  chr6:6006674-6006952
  hyper
aagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggctgcctcccgcctccagcctccagccgggctgagcggccacttacctatttgcaccgcgaggatcagtga

SEQ ID NO: 30268 - DNA, 421 bp, Homo sapiens
  chr6:6007249-6007670
  hyper
acagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctc

SEQ ID NO: 30269 - DNA, 778 bp, Homo sapiens
  chr6:6007671-6008449
  hyper
attaattcgaaagcgctcctcggccgcccgccccctgcgcttgcctaccctctttttctccaacccagcagctgagctctgggcgcagcctggagcgcgtgagcacgcagcccggccccccgcacgagcacacacacacacacacacacacacacacacaaacgcgcgcgcgcacgcccgccagccgcgccgagcgcccccatgcccgcccgcacacaaggcacgcgagcgcgcgcacacgcccaggccccgggggtttggtttgcacacgtggggccccagaaataaacaccgaatgtcctctgaattttacccacctgcgatgccccagcgggccaaaggccgcttcaagggacacagcgacacctgttttagggggcgagtagggcaccggggaaggagcctctgataagacagttttcggatactagtgatttaccaaccaactctcagcgctttaggaaatttccaaggcaagcgctggtgtgcggacttctttctaatcttgatgcgcctcttgggcttatttgttgggctacacacacacgtacccacacgcacacacgtacatcacgtacgcacacgcacacccggacccacacacacctgcactgtcttttgatgctcaggcacagaccctgtgtaggtgtagcctaccctgcaacaaaatacttctgcagctggctttgtgctaggtgcaagctgctatcgacgacagcttgagtcaaaaccgaaaaactaacagggctatttcctttctaaacgcctttaagctctg

SEQ ID NO: 30270 - DNA, 294 bp, Homo sapiens
  chr6:6009258-6009552
  hyper
ccaggccaccagctgcgggcccccaacctcgctcagactcgtgcagagcccaggcttgggagtggcttaaggttttttgccctcaacgtccttgccttcctcctgcttatccacctgggatcttcacagcatcattttctgggatcctctccaacccctcccctgtaactctgagcgtggggcgctggggatgtggagtaggcagggctgagggcctcaatgaagcgggtgaacccacgcgcgtgcgcacagccgcccgcgccgcgccccgggccgatccggttcttgcccttg

SEQ ID NO: 30271 - DNA, 676 bp, Homo sapiens
  chr6:6546546-6547222
  hyper
caccgcaaccgcagccgcagccgcggaggggaggccgtgcacccgcccgccgggagagccgcgcgcctgagccgggcgcacgtgggaagtgggccacgagactggagtccaccgagatggaggccccggcactcgggctcaggcctttgtgcttagcacgtactgttggaatccagcacgccctgctccggcgggcgcctccgatcctgaagcgcgcacctgggaactcacgcaccgcccagccgcgaggggcttggcctggctgaaagccacattattctcgaaaacaaccgtgggaagcacacgctgagctcccggggcccctagagtatgcaaagaggccggccctgcgagactaaataagtctctccccctaggacctagtcccttgccaccggctcccgcggccaccgcgcagccagagtgcaccgtccctagggctttggcggtggccagagccagcaagtgcggcggcctggagctggggtggtgagggcggatggcaggttggagaaatgcagccgagccgcaggtttctagaggcctctacagcccctgccatctgggcactgcacagacagacgctgcgtgagacctggagctcgccacctccatgcggcgctgccagccactccgctgcgggtgcaggagcgttccatgtcggggactgagggac

SEQ ID NO: 30272 - DNA, 40 bp, Homo sapiens
  chr6:7051798-7051838
  hyper
cccgggacggcctagcgcggccctctccttatttatccac

SEQ ID NO: 30273 - DNA, 1 bp, Homo sapiens
  chr6:7051873-7051874
  hyper
c

SEQ ID NO: 30274 - DNA, 82 bp, Homo sapiens
  chr6:7726308-7726390
  hyper
ggtacctgagccgggcgcgcagcagaaagcccacgttggccgctgcggggagcgcggcgtggagaggcgggagaccgaattc

SEQ ID NO: 30275 - DNA, 1069 bp, Homo sapiens
  chr6:7726700-7727769
  hyper
gaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcag

SEQ ID NO: 30276 - DNA, 1035 bp, Homo sapiens
  chr6:7728086-7729121
  hyper
cggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataagctgacttagtttagcgcagacataggatggagggacgcgctgtcagcggacagatcatgggtgcactggctacgcccgggatggttgcagctgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctggg

SEQ ID NO: 30277 - DNA, 15 bp, Homo sapiens
  chr6:10113574-10113589
  hyper
gccgactggggagcc

SEQ ID NO: 30278 - DNA, 55 bp, Homo sapiens
  chr6:10113619-10113674
  hyper
cgggtgcgcaggcctggcccagcgggggcgccgggagagccggcccaattatgat

SEQ ID NO: 30279 - DNA, 86 bp, Homo sapiens; identical to SEQ ID NO: 529
  chr6:10381507-10381593
  hyper

SEQ ID NO: 30280 - DNA, 275 bp, Homo sapiens
  chr6:10381694-10381969
  hyper
cgccggctaagggcagcctgcggcaggtccccgagcctgagcactcctcctatctggggcctgagaggacgctctgggctttttcccaggcccagggtgcgcggcctgctagcgcctttcgaggcacagtcccaagataggctcttgtccttcgacgcccccttggcacaagcgcactggcgccctccgctcaacccaccttgcctttggggcgggcttcaaccctgggaagacaggcctgggggaagcgagaggagaggcccgaatagaggttc

SEQ ID NO: 30281 - DNA, 46 bp, Homo sapiens
  chr6:10382321-10382367
  hyper
cgaggggcctaggttagggacacgctcttctcgctgggtcccaagc

SEQ ID NO: 30282 - DNA, 272 bp, Homo sapiens
  chr6:10382722-10382994
  hyper
tattaagggagacttcgaaggcctgttagcaggtgactgcggcaggggcaggggcgcatcagctgtccggcttggaccggcgtgggcgtgggctgggggcttttccgatttgctgagtcagccgcgggcgccgcgggctttggtgtttccagcccaagcgactgtgcttcgctgactggtgtgtcaacttggtagtgtaattattgttttgttttctaatatgtaattactctttgtcgttgctattatgaatccaccgagcttgactcttg

SEQ ID NO: 30283 - DNA, 237 bp, Homo sapiens
  chr6:10383837-10384074
  hyper
cacccaggccctgcccgccgccctctgcagcctaggcggggtgtgtggcgtcgcggtcagccttaccgagggacacgccgccccgggccgggacggggtggggctgtgggggatcctgggccgaggaaagcgatccattttctctaaccgtttgctccagagctgtcaggttagcgtggcctcctcggccgcccagagaagaatgtgttaaaattctttgcacgggagcctttccca

SEQ ID NO: 30284 - DNA, 65 bp, Homo sapiens
  chr6:10384438-10384503
  hyper
tgcccctgcgggtcccgattacagatgaatttttattccgaggtggggcacgtaatggaacggaa

SEQ ID NO: 30285 - DNA, 25 bp, Homo sapiens
  chr6:10384950-10384975
  hyper
ggaaggagggggagccgtggcgggc

SEQ ID NO: 30286 - DNA, 994 bp, Homo sapiens
  chr6:10385279-10386273
  hyper
gtgaaaatttgcgattcagggcaaatgattctccgacagacgctgggctccacatcccacccctcccagcccgcgccccctccggtcctcgcgctccccggccgccacgtcccgggcagttcaggaaagcttgctaggtttccacgccggaaagcccaaggagaaggagccagcaggcctctgagcgtgtgagcgcgtgtgcgtgtcagcgcgtacatgggggtgttttcctcttcgggaagtgttatcaaacagtaatagctaccctcgactccgaatcacagcattccccccagaattcctgatcagtaaaacccaaatcgttttcaagacaaaggagcatcaatcagcgacaaagacagatttaacgtattaaatctttattaaagtgaagtcattcttattgaaatgatgtattgggtgtgcagaaagattggatttttttttttttttttttttgacaatgtgtaaaatggagatggtggcggagagcttgcgccgcgtcttgccctgattgttctgggctgggattggattactgggactgcccagggtcccgcgccaggaaacaccaccttggactacagggaagagactgatctccctcctcctgccggcccccacgttgatttcccgagaaacaagcgtgtcccaggtcttctcaaaaacttccctccttggtctccgcattagggaaactgaggtactgctggcatggctgtccatacgtttgctaaatcagctactccagaggcctagagaagggagggaacgccctgggttttccagaacaagacacagatctctccgtagcctaaagaaagtccttgcgccccaggtctgaaagccaaggggagcctgtgtttgctcccagcggggtcgccggccgtctccacaacccttgcttcctacaggcagaattgaatgcaggagctggctgtcttcccgcctggggtgggctctcaattcaactggacctcgggtcctgtcaagg

SEQ ID NO: 30287 - DNA, 1307 bp, Homo sapiens
  chr6:10389909-10391216
  hyper
ctccacataagcagtcgatttctgtggtttcaaagaaaaaaaaaaaaaagatgaaacatgtcttctctttgagggtgacctttgacctttctttccaatacacctgacacaaagggcttagaaaagacccgtttcgggtgcggggtgctgatgctgcttttttgttgttcgtttgcgctcgcgctcgctctcgctctctctctgcatccccctcaccccctttctcggagactgaactaagtgaaaagttgtttcaataatcgcagctctctgctccgccagggccgagggaggcgggcggaacacggagggtgttttgttaaatgctcccgtcgttcgcaggggctgggacttgataaaaggagacagttttctgaaaagatttgattgaaatggcgtgtgccagggctgatgggagccagcgagggacaaagcgccgagaatccatggacactcgagcaattatgcctccacgctgaaggtggattagcgcgctggaaagaagcatatgtttggcccggggcgacacttccccccggctgagcttagagaatgggagcgcggagagcggctggacccggaatatcaactatctgcgaagcccccccttctagcccaactccgccagcctccccgcccccgccggggaaaagtcggagtgcatttttacaaagatgagaggagaagagagggctaggggaggagcgggcagggaggggagtaggtgcctagaggtgcaaatggccctgggatcccccaggagcggccctccaggctctcctctctggcgatcccgagggcgcgtccgtccttgggtgtggaaacccagagggggtcaaataaatgctcccctatggaatttcccactgctaaggtagttcggtccaggatgcccgctcaacgcgtattggaaggtcagccgaattgttgcaatgaaacaaggttttaatgactaaagatgcaagtgcctaaaaggttgcgttgggcaggaggcgcttggagggcagcgcgggttcccagccattccttgggtccaggtcgaggaaggcctcgggagacgagtcccacagtgagatatttgatgaaatgggtcggggctggaaagctcggacaggccgcatgggagagaaagggtgcgggtgcggcagtcggatccccacgcagctctatctgcttagacacccgggcgagggatgctttgggagtttggagccagaaagtttcccagaccctgcctccagtcattaattaaagcgcccttcccgtggaaaaaaaaaaggcccttaaaactctgacctggagcctcc

SEQ ID NO: 30288 - DNA, 132 bp, Homo sapiens
  chr6:10391324-10391456
  hyper
cgcgagtgccggtggccgctgcccaggccgtccacatttccctccctggctgtccttcgagcccctaccagtccttcctctccctgccgcccaagcccaggcaagactcgaaccgcccgtcccacacaatct

SEQ ID NO: 30289 - DNA, 430 bp, Homo sapiens
  chr6:10410518-10410948
  hyper
cccagctggggcaaccgtgccgtcccgttgctggtgccgtcgtgacggtcctagaagagagcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtc

SEQ ID NO: 30290 - DNA, 293 bp, Homo sapiens
  chr6:10411253-10411546
  hyper
gagagaggtgcaccccggggctgtggccccccccccccgccccttccaccccagccccaaagggcagaagaaacgcctgactttaggtttctctattgcaattcccttgcaaaacaagcgaagagagttgattccagagaccgcgaaccctcggcggttcggccgcaggtcccgagggtagggggcacaccgcgctgcacttttcctgcagacagtttaagcatcaaatgttgagaacatctcggggacaagtgaagactcaaggaaatcaagatgaacgtggggagaaacac

SEQ ID NO: 30291 - DNA, 90 bp, Homo sapiens
  chr6:10411946-10412036
  hyper
ccaggactccagtcacggcgccgacgctccccggagcgcgggagcccggctcggatccatccgaacttgaaccaccgattcgcgcggcgc

SEQ ID NO: 30292 - DNA, 310 bp, Homo sapiens
  chr6:10414201-10414511
  hyper
agtgttggttgtaaccgttcccagcgcctcctgcgggtggacaggtcgcgctagggtctcccttgctgcctcaagaaggcgagctcaggggactctgcgttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctca

SEQ ID NO: 30293 - DNA, 268 bp, Homo sapiens
  chr6:10414978-10415246
  hyper
agaagggagcatccacgtcctctctctgcagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgc

SEQ ID NO: 30294 - DNA, 193 bp, Homo sapiens
  chr6:10415559-10415752
  hyper
aatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattcccctt

SEQ ID NO: 30295 - DNA, 30 bp, Homo sapiens; identical to SEQ ID NO: 8339
  chr6:10416118-10416148
  hyper

SEQ ID NO: 30296 - DNA, 372 bp, Homo sapiens
  chr6:10417158-10417530
  hyper
ctgagcacaattcctcggctgaaccgggctggaggcttggcgccgccctccgtccagaaaatggtcgactttccagggctagaccctgcagggctgtcccagcctgtcgccagtgcagtggtttgaagtcaggatctgggctgccaggagcaccgacaccctcccagcagcggccatagcctgagcaggccaaaccctaggcctgagagcatgggtttttacactccgtagacgtcgccgcggtgtgcttaagggaactccaagtttcgctttcttgccctctgcgggcttggaaaggccgccctccatcctctgccaccccatttcaacccccgtttccacctccccgctgccccgcgcccaacagatctc

SEQ ID NO: 30297 - DNA, 363 bp, Homo sapiens; identical to SEQ ID NO: 533
  chr6:10419077-10419440
  hyper

SEQ ID NO: 30298 - DNA, 56 bp, Homo sapiens; identical to SEQ ID NO: 534
  chr6:10419476-10419532
  hyper

SEQ ID NO: 30299 - DNA, 258 bp, Homo sapiens
  chr6:10419744-10420002
  hyper
ccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaac

SEQ ID NO: 30300 - DNA, 150 bp, Homo sapiens
  chr6:10420118-10420268
  hyper
cgaactgggggagtctccactcccgggtgggggtcgggggttggggaagggctagactgctagaagcgtccagaccccatgatccccgcgcacctggacacagtggggacaggtcgccgtccccgcctccccacccgcccacgaggtgca

SEQ ID NO: 30301 - DNA, 37 bp, Homo sapiens
  chr6:10420718-10420755
  hyper
ctttaaaagaagccacgggatttggggctcccggagc

SEQ ID NO: 30302 - DNA, 207 bp, Homo sapiens
  chr6:10420876-10421083
  hyper
cgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaaccgtgcccgagagcctccgacccctgggccct

SEQ ID NO: 30303 - DNA, 96 bp, Homo sapiens; identical to SEQ ID NO: 535
  chr6:10421356-10421452
  hyper

SEQ ID NO: 30304 - DNA, 1113 bp, Homo sapiens
  chr6:10421548-10422661
  hyper
cgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcact

SEQ ID NO: 30305 - DNA, 155 bp, Homo sapiens
  chr6:10423932-10424087
  hyper
gcgtggtgtcccaaccggcctggaaagaccgagagtaccatgagctgtgaagctggggtgtgacagggatgcccgtccagggctggcaagagtgcagaatggctctcttggatctttggaataggcacatctgcagaccccgctccaatgtttac

SEQ ID NO: 30306 - DNA, 15 bp, Homo sapiens
  chr6:10425463-10425478
  hyper
aaaaacttgagaccc

SEQ ID NO: 30307 - DNA, 161 bp, Homo sapiens; identical to SEQ ID NO: 2765
  chr6:10425629-10425790
  hyper

SEQ ID NO: 30308 - DNA, 972 bp, Homo sapiens
  chr6:10425838-10426810
  hyper
cgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccct

SEQ ID NO: 30309 - DNA, 386 bp, Homo sapiens
  chr6:10881854-10882240
  hyper
gactcttcaagaactcgaatgccattctccctccttcggatggacagcgccccgcgtgcccgcacacacccggttcacttacctgaggcatctgcggatcgttgatgtcccagctgagctgcatcccgtaggagcacacgccgaccgcttcctgcaccgcggccgccggcatctgcccaactcgctcgcgctttccgcccagggttctgaaaaatagaagaaaaaaggacaggtgcgccaggtgggttttttttcttctctttaaagaagaaagtggggtgtgtgaaggggaggtgcagagagagagaaagagagagaggctgtttagatatctggaagctggggacaatggttatggacccgggcggggccttgtccttggccgc

SEQ ID NO: 30310 - DNA, 47 bp, Homo sapiens
  chr6:10882241-10882288
  hyper
gtgctgaacgttctccacccgaacggcagcatcgacctctggcagct

SEQ ID NO: 30311 - DNA, 15 bp, Homo sapiens
  chr6:10883008-10883023
  hyper
ttgggcctccactgc

SEQ ID NO: 30312 - DNA, 72 bp, Homo sapiens
  chr6:10883114-10883186
  hyper
cgagcccaggcgccttcacgctcccggggacttcggagggacctggccctgcaggaacggagtcctacaaag

SEQ ID NO: 30313 - DNA, 268 bp, Homo sapiens
  chr6:10886917-10887185
  hyper
attacaggcgtgagccaccgcgcctggccgcccctctggctttttaaggcggggcaaaaacttggaacagctaccacaaagcgaacgcctatctgtttggaatttcgcaaataaggaacgtttaaatgacgtagttcacatcctttgagtgctggctttctcttaaagggtgagtgcgtgcgcccaggtggtttggcctgtgtgcgctagttacttgcacgcgcttcttgagtctcaaaacacagagctctagtaaacttcagggggc

SEQ ID NO: 30314 - DNA, 530 bp, Homo sapiens
  chr6:10887186-10887716
  hyper
gattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcggtgagtgacccccgaagggcccggaccttctgtccacagtgctagggcgcgcgagggcgcggggtccctggggctcaggttctgccgccttgaggtgttcgctcagagaccgggtgctgggcatagtcccccgccacctccttgggtttgctcggagtgtattggcagcctgcggggagaccaggcagaatagaaacctcggatccctagctaaatagcgctcagggaaaggggaaccggagaattcgtgttcggaaagcaatgagatagttcttttctagttgctttgcgtattttcctagccggttttccagccctctttccaccttgctgcgtagaaagtgcaga

SEQ ID NO: 30315 - DNA, 416 bp, Homo sapiens
  chr6:11043690-11044106
  hyper
acacgggtgaacacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggcc

SEQ ID NO: 30316 - DNA, 434 bp, Homo sapiens
  chr6:11044107-11044541
  hyper
ccgcgaaggaggggcggcttcctcgggcatcccgggcgcccggccccgtgcatgcaacaggggactgggcgcgagcgggcgcctcgaggtgccggggcgggaccggggagaggggaccgagacaaagttcccgagacccgcgggcctcgggccgacccgcgcgcccccggcccaaacgctcagctcccgctccccaggcccgcgcggacccggcccctccgagggtagcgggttccagcggcgaacccgcagcgcccgcgccggcgcccgctcggccctttcccgcccggtgcgtgggtccaggagagaaagaaagcgcggcggtgtcggtggcggcgcgcggccccactcaccatgatccgcagcggctgtggcgcggcgacccgggcgggcggcgatgcgctgtccagggtagccgggtccctctgcccggc

SEQ ID NO: 30317 - DNA, 366 bp, Homo sapiens
  chr6:11044542-11044908
  hyper
ctatctcggcgcccgcgccggttacccccacccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaat

SEQ ID NO: 30318 - DNA, 121 bp, Homo sapiens
  chr6:12749820-12749941
  hyper
ccctcctcccccttccgcctctctccctctccctccgtctccttctccctctcagctcgccgggcgaccctgctcctgcctcccacattaatggcggcatcctcggaggatgatatagacc

SEQ ID NO: 30319 - DNA, 100 bp, Homo sapiens
  chr6:12750364-12750464
  hyper
gggcgaggttggctggcgcggctactacggggtggaacttgttggtgacattcagactctgttggctttgacgggttgacgccgccgctgcggtgttgga

SEQ ID NO: 30320 - DNA, 506 bp, Homo sapiens
  chr6:13013570-13014076
  hyper
gaaagtcaagggctacgggttggacccgccggagagggtaatttgctgtggccctggaggggagcttgcacccgaggtttcccagtgcagcgctttccgtgtgaaacattttgctttcattcggcagctttaggcgtgaagaaaagggggagggggttggcgttccgccctggagctcttgagagtgaaggtagcttcaaacccagcaggctctcagtagctggtgctgagatttccggaggggtggggctgccagaggaggatgtgcacgtgagaccccgagagaggtgggagtggagcttctcaggtaggacccaggagcgccctgcctaccccctcctccggcttcgggatccggattggctggggcagcgaggtcggcgaggtcaagaccctttcggcgccctccccgacccgccccgccgcggcggtgcttatatagagcggccggcgcgggcggggcgggggcatgctggcgaggccgaggggcgcgagtggcagcgcgc

SEQ ID NO: 30321 - DNA, 176 bp, Homo sapiens
  chr6:13488419-13488595
  hyper
taagcaacaggcctgcgattggaatccaggccccagagtctgggcacggaaccgcagacttctacggtctccttccaagctagcctgctccaatcgcgcgcccccgctccggccgcgcacgcacggttcagccgccttcttccaagacagtccagtcttggcgggctcccatctgc

SEQ ID NO: 30322 - DNA, 699 bp, Homo sapiens
  chr6:13924890-13925589
  hyper
gtgcctactaggatgcgaataccacttggccctgggctcgctccgctttagccttcccctctcgctggggagaaacaggcggtttgtgagggagactgagagaggggcgtgtttgtggtggtggcggcccatcgggggtccttgtcctctccgaatacccggactgctgaggggaagggccgggggggccccggcggttgccatggtgacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccaggtaaggcgatcgcgcccgcggccggggaggggtcggcgggacgccgggcctccccaacgctggggcagcagccagccccgcagtcctggacggcgccgggccgcccaagcgcgccgaggagagggggcggcaaacttcgggccgagcggcgccggggcccgcgcgcggagtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttggggg

SEQ ID NO: 30323 - DNA, 30 bp, Homo sapiens
  chr6:17102273-17102303
  hyper
ggcaaccattcctggcgactgcccagaaac

SEQ ID NO: 30324 - DNA, 37 bp, Homo sapiens
  chr6:17281225-17281262
  hyper
gtggagagctgtcctcggcactcgtcttccagatccc

SEQ ID NO: 30325 - DNA, 386 bp, Homo sapiens
  chr6:18122677-18123063
  hyper
aggccaggcagaccacgtggccgcaggacaggttgcgcgggcgccgctgctgccggtggccaaacttctcaaagcacaccttgcactcgagcaggctgatctccgcctcgcgcatgagctcatgcagcgctggcccgctctccgaggcttcggccgccatggcgcgtcctgtgcactcccgccgcgccgcctggccgtgccccagcgacgctctcggtcacggtcacagtcatggtcacggggtgggacgtgcgccctgacgtcgagcgccgcgggcctctgcactgcgatctgctgccccttggtgggcacgcgcggcactgtttcctgagggcctgatggtggacgtttgcaagacaaatccacatgcgcgttgtgtagacctg

SEQ ID NO: 30326 - DNA, 430 bp, Homo sapiens
  chr6:18277531-18277961
  hyper
gagaggctctgagggcgcccgcggggcggaggggagcggggcagagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagccgcggcgggcggcccacgggggatcagaccctcgggcatccg

SEQ ID NO: 30327 - DNA, 64 bp, Homo sapiens
  chr6:18277979-18278043
  hyper
cgccggacccccacctcttctccaagctccactcccgacttttcttccccgcccccgggaagct

SEQ ID NO: 30328 - DNA, 186 bp, Homo sapiens
  chr6:19691811-19691997
  hyper
atgctaaccttggagcgcaacctctccatttgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaagggg

SEQ ID NO: 30329 - DNA, 78 bp, Homo sapiens
  chr6:19692142-19692220
  hyper
cgtcccgagggctctcccttttcccagagcgcataccaaaggcagactcctttgcaggctccacgagccccattcgcg

SEQ ID NO: 30330 - DNA, 246 bp, Homo sapiens
  chr6:21664923-21665169
  hyper
gggcatctctggtcccgggatgcgattgtcccggtttctccttctggcccactcgccgcgcgcacgaactctaggggaagttggttgtaaagtttccgagagcggcgtgggctggtgcgagtgaagcgcggggcgggggaggcgaggacagaagctctcctcgcggcgtctttgttctgctctggaggagagaccttggcaaggagtcgccgggcgggtgcagggacctaccgccaccacattccg

SEQ ID NO: 30331 - DNA, 141 bp, Homo sapiens
  chr6:21665754-21665895
  hyper
ggcggcctgggaccccgagtcagatctttggggtgagcacgaggacgtggtgtagggaagaggacgagtgagcagcgcctggctgtagggtcagagggcgcctggtcatcctgagagccttgccttcgcagtttgagatta

SEQ ID NO: 30332 - DNA, 42 bp, Homo sapiens
  chr6:21666457-21666499
  hyper
agggctggcatctcccggggaaagtttcgagcctggcagtgg

SEQ ID NO: 30333 - DNA, 175 bp, Homo sapiens
  chr6:24126308-24126483
  hyper
gcgcgccagacagctcggccccgcccactcgccgctctcggaaagctggaaccctgcccctttggagggggaggcggcggcggcggcggcggctgcgcgggcctcgggtgcgcgggcacgcgggactcccagctgtcaatcaggcgcgggctgagctctacgaggcggagcggcg

SEQ ID NO: 30334 - DNA, 208 bp, Homo sapiens
  chr6:24494664-24494872
  hyper
cgcggggtcacacttcgacccctcagagaacgatcgctcccaatcaatactacgtgctcaggagctacaactgaagaagcgtgatcacggccttggcatttagggcaggcaccagcgcatctatggaccgcgcacaaattccggggatgccgaatttgggggatgctaaggggagagagtgggtctctagcagcgattgggggctcag

SEQ ID NO: 30335 - DNA, 94 bp, Homo sapiens
  chr6:25652379-25652473
  hyper
gcgcgcagggcggggcggggacaggcgcgccaggagcggggcgggcttccagccgctggttttgctgagggctgagggacggctcagcgacgcc

SEQ ID NO: 30336 - DNA, 229 bp, Homo sapiens
  chr6:26020909-26021138
  hyper
aaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggt

SEQ ID NO: 30337 - DNA, 30 bp, Homo sapiens
  chr6:26034014-26034044
  hyper
ggcttgacgagccttcgacttgaatactaa

SEQ ID NO: 30338 - DNA, 90 bp, Homo sapiens
  chr6:26087615-26087705
  hyper
gccccccaaaagaagcggagatttaacggggacgtgcggccagagctggggaaatgggcccgcgagccaggccggcgcttctcctcctga

SEQ ID NO: 30339 - DNA, 88 bp, Homo sapiens
  chr6:26088186-26088274
  hyper
acccacagcaggatccgcacggggtttccacctcagaacgaatgcgttgggcggtgggggcgcgaaagagtggcgttggggatctgaa
